United States Patent 11,001,841 (CCCTC-BINDING FACTOR (CTCF) RNA INTERACTOME) - sequence listing, part 48

SEQ ID NO: 113749 - DNA, 1199 bp, Homo sapiens
acattagtgtatatgggtctaactcatgttaatcagctatatatatatatgtatgatttttcacctttataaaaacagtgcaatgagtgaacatttttatatttgcatccccaaattttataagctggattcctcaaaatggaattggtggatcaaagagtacatgcatatattaattttttgatagcaatgccaaattgccatctgaaaatgtgtgtttatttatattccttctaacagggacactgtgttttgaggacaacaaaaataactaggactaaattcttaagaaataatctttaaattctacttgcacaaataggaagttgttggctcaatccttatccctgctaactagttgaaatatgctacagaatgaattcggagactgaaatctttgcacttgttaagacatgctatcgattgttccatgtgaaatactggcagtagtaaggcctcctggtgatctttcccagatggcctcattagcttttgcttagaagttccagttgtgaggtaaggcatttgaaaaaccttggtcaatattggggttgtttctaaatgtatgcatcagatgctagatgaactttttttttttttttttaacatggaagaaagtgtttggtatatgtcatgagatcactgaactaatatgtcatctcgttctggtcttttaggtacatttagactatttgctagattctggggcattgttttcaacaagagtttatcttggtttctttttgttcattctttttattcattttagtgcatgggcctcattatgtccttatatttgaccttcaacaaatgaattactgatttctttgattcacataatgggccacatgggagaaaattgagaaaactcatttaggccttagagactaaactgtgtgaattcagccctgaatgttgtttgtagtagttcttgtggtggggacatgggcctattaggaattaggagaacacctctcatgtttcttttaataactatcatgttccagtcctgaaatattagtcatcacagcctttcagaaaactcttgccatcctaatttgcctcttgtgtatatattgcttagcttttagaatatgcaggaatacattctaagagttacatttggcaggcttattaaatgcttaacatttgtatagttttgttttgttttaagtttttaagagggagagggatatctc

SEQ ID NO: 113750 - DNA, 1027 bp, Homo sapiens
acagtgggaacagaagtttctgtaattcaaatgtttcttggtggtggtatatttttctcactggacctagactcaaatcttttaccaggtgacctcccttttgaaagtttctgttttagtagtaaagtataatattgggctagaaagtatctttgggattgcatgttttgatgcagaatcattgtgccgtagaatgctgaggtccagccatctgttggcagtcagttggcgacagaacagggccatacccctggtttcccagattactagtgtagggtctcttccatgataccatatggtctccttattacactaattttaaacaatataatacctatttgaagtgaaggttgttaacttggagtcagaatgagggaatgagtaatttaaaaaattaactccaaagaagggactattgttattatagtcccttctgatttatacaagcaatagggctttaattcttggccattccaggtttcctagctttttgtgtgtttgttgctgctgttgtttttttgtttgtttaggtttttaaactttggctttaagtttggatatttggttttatttatggcagaattggaggataatttgagctaaatgaatttacaggtttttttttaaagggagataaaaggagaaccaatattttacctatgactacacttgtaattcaacttttttgttgttgttgctgttgagtgaattaaaatttaacttgtgtctagagtttcaaagcaaactttatgaactgcataaatctgggaaatagagaaaatacagtcaaaggctattgaaaagtatgctctttgacatttggtggttatggacacctttgagaatatgatgaaaaactgtcaacccttttctaaggaaagggcacattagcttatctgcacaaagttttgcatacattttcaatacactttcagagaatccatgtaccttgctgcttgccccaccttccactgttaagaatacttggctttatttttaaatttttaaatttttttattttattgag

SEQ ID NO: 113751 - DNA, 1100 bp, Homo sapiens
gtagacagagaaagcaagcaagccaaagacataatctggggcattccagattttagatgagcagatgagggagatggagtactggtgatgtaggaggaaaagcaggtgtatgtggtgtcacagaatgctagttctagagaagaaggtgcttcaaggagacagtgtttggctgtgtcagatgttcttgataggtcaagaaagtgaattgagccatatcagtgtaggtgtcattacattcgtttgcctgagacagtcctattttatgcctgctaatctggtgtcttgtctgattagtgtttactttactcagaaatgttccagtgtggatgataaattatatggtcacactggtcattagtgaccttgggaaaagctatgtagaggtgatggtgagaatgaaaactggtttggagtggactaagaataagtggactcagagagtaccgaaagttcttttaatgccctttgctatgaaaggggagagaatgtgctggctgaaggggatgatgagtttaagggtgtttttgtttgtttgttttgttttgttttttgatgggtaatattttaaagcattttttatgttaattagaataacctagtagaaaagcgaaagttgatgtgataaaggggagaaagaaacaaagggtataattgcaaaagtgagaggggttggcatctaaaacaaaatgaaggggtttaccttagatgggagcaggaaaacttctctgttaaccagagagaaggcagactgtgttgttgtcagatacaagttagtggcttggatggtggaaaggtaggtattttatcagcttgcatataattataaaggctgtggcaagtaattagccaaaaggaagatgaggaagagggatgctggagatttgaactaaacatgataaatcattgtcttgcaaaggatgaagatgaatttactagtgaagtgtagtcgaattgtcaggccatattgggagctcatttgagattcgcagtcataaatatcaggtagaatggttgtgtgattttcttcagccatgttaaaccacttaatacttagtatagagatgatgaatgtgttagttagctattgccacaaaaatgcc

SEQ ID NO: 113752 - DNA, 1031 bp, Homo sapiens
ccttcagagttgatcagacttttgggaaatagctcagagtagccaaaatcagaacactaatacataaaccaaaatgatcttaaactaattttcagtgggtaacaggtgtttctagggactgtgtttacattatccggtgtgcatcattctcaggacctagatacctaagtgatagaattagtaatcagagcttcatttggtgagcagggaatcacaaggaaagggaatttacttcaaagtggtaatggaaagtcttaccaaactggcatcccactgcaaaatatacctttctagtgatttgagtattgattacatactgtgaaatccaatgtctccttacctttcatggtactgggaaaactctgacaaataattgctctttggataacccatttctgaatttttttgtaatctggtagttgtctttttctgtccccaagcacttgaggatgtgccaaactccaccagacacagtggttcattgacacagagattctcaactagagggcagggtgccctggtatttttaattcttatttatctccttgtggagatttaataatgtggaccattttaaacctcatgttaaaaatagtttcttttggccgggtacggtggctcacgcctgtaatcccagcactttgggaggccgaggcaggtggatcatgaggtcaggagatcgagaccatcctggctaacacggtgaaaccccgtctctactaaaaatacaaaaaattagctgggcgtggtggcgggcgcctgtggtcccagctactagggaggctgaggcaggagaatggtgtgaacccaggaggcggagcttgcagtaagccgagatcaccccactgcactccagcctgggcaacagagtgagactccgtctcaaaaaaaaaaaaaatagtttgttctgacagagactatcactatatatttgattatgttttgagctttgttacagtcatattccagatctgctcctccaacattgccctccacccattttgagtggatgaccatgcttcattcgtagc

SEQ ID NO: 113753 - DNA, 1087 bp, Homo sapiens
tctcaattttttataatttaaacagcactataattaatagttctttagctaagtatattcacattcgcagtttgttccattgtgtaatataacagcttggggtccttctgcaagcaaggcttatgtgcagttcatttatttgggaagtgatcccaaggagccacagtgagtgaatggaggacttgagctggaaaggagggaaaaccggttcataggtgcagtacagatctggccatagctacatgtgacgggacctttgaaagccttataaaatatgtctcagaactgtcttctaggagaataccagggggaagtatttctcttcctttgatgcattctccactagtcaagggtggtcccacagcattatttcctgcatgcttccagactgtgtgggtatgagcccagtgcatcactgaaggcctaggataggaagccagagagaggtatggccaggggctggggtgaggccctgttacgttacatcttcagaaaggtggtcaaagcctgcttgggcctggttgctgcagtggtgggttgggcaagaagtaaggctgagaagatttgtggtaggctacaagaagtgtctggtacatatacattcctagaaacagagcttgtaattttgtctcaaaggacatgcacaattgtatctcaaaatagaaatacacatgggagtcataaaattatgttcaggttgattcatttatgaggtacacattctgagacctgaggatgtggcagggggtaacagacgtgatcctactgccacagagcttacattcctttgcaggaagacagtaaacatgggaacaaatacataacatcagtgctgacagcagtaggtgctgtgaagcaaatgaaatggagcagtgctgttagtagtgacttgaaagggactgagcccatggtgagaacaccagggttctcatgattttagatggcacacagataaactgagagtgaagagactcagggttcggttgatggaatagaactaaaggagaaggatgtaggaaggaggggcgagggcctctttacattcactgtccgctttacatttttcctagaggcagatgtacccaag

SEQ ID NO: 113754 - DNA, 1069 bp, Homo sapiens
ttttccaatcattatctcttcttttcctgaaggtccttgccattctttacagtttttgatttgagacatcattaatgtttacattattctgatttgatggctgttattttcactgttgccagagagtgtctgtgcatactcagtaaaaggcagacacattgatttctaaattctatccatttagcaagaccatagatcaggttccaggaagctttcactaaattacggcagcttttcattttctgatcagcagtagcagttacgtctatactaatcacataatttttcgatcatatgtaattgtgtactcttcttgagttacttcataagtcttgtctccttagtgagatctatcaagtcttgaagggtagagaccatgtcttatatttcttatgtataacacctaacatagttctggacacatatagaccgtaggcatttagtaaatagttgttggattgagttgagggaacttatagacctcatttattctcaaaagtagacttttatgtatttgttcattatgatatctagcatctccattacatgtcctgttaggttgttttatttgtggggcatcaggaaaggtctctactggagattcgggaatctgtactcttgtgagctccaattcaattactcctcctttttcaatattttttttccttcttccatctttcttttaatacttactgtccgtttcacttcacctacccagtaacatatgtttcatttctatcttctctcctggattatggagttctaatgcctggtcattgcaaaaaccaggatctagtttatagcaagccctatgacatactgcagccttgccagtaataactgcgtgctgtttttttgcttaaataactgcttttgcttgaaggatcagaaacttagtttctgaagtccttatttttgactaaatgtgctggacgatagaattgtatttttaacgtgtgtccccttggttgatgtttatgaaatgttggttaggtggttagatgtttgtattcgccagctcaccctatcatcttcatcctaacacttcccacaccagtgtctttgtagg

SEQ ID NO: 113755 - DNA, 1033 bp, Homo sapiens
acttatcaaatagtgttacctaaagatataatgagtgtgctattttatcagattattgatgaaagtataaaattaacatcatcagctataccctgcagatcttcataacatgatttgattaccccatctgtcaccattaggcaagaccctaatatatttcataaaaatcagcagcactttaaggggaaactctgctgccatgaaggaaaatatattaatattttctggcttgaaaaattagtgttttttgtttgtttgttttttaataaatttggctttctatgtgattttatgtgtaggtttgctctatgctgtaggaggttatgatggagcatcacgtcagtgtcttagcacagtagaatgctataatgctacaacaaatgagtggacctatatagcagaaatgagcaccaggcggagtggagcaggtacatgtgaacctgttttagcaactgaagcacaaaaatgatggaaaatagttaaagtaaaatgattcagtggcatcactttacattatctgaaaatatatgatatgctgattttagtggcactgctaaatgtcttttgaattgtgcaggtaatgggagtaattacaaagtaattttactttaaaatttaatgtctaagtgccatagacatttctgtttcatttatatattcaagttgttagcactccttttagttttttgtttttagtgcttattggggaacttgcttaataatcaagtcttttcatgtatatttcttaaaattttgtgctttaatatgcggttattttactatggatattgttttcaaaaggattacattaaaggactttttccctccctgtgtttcacctacatgttattaatatttttattctgtttgacatgcctcttttttcagaataatagtttgttgagatgcttatttaatcatcaattgtattgatttccatttcttaaattgtaggctatagtatcagcttgcttttattatgaattataacttcgaaagttttagttacaagtcatttaaataaacctaatat

SEQ ID NO: 113756 - DNA, 1070 bp, Homo sapiens
aagcactcccttgaactttgagtgttttaaggaggttatctctgatgtttaaatttatatagatcgtggcattgcatcttagaaataaggtttaggaagggcaagcttggaggcagggcaagtccagaaaatgaaggagctggtgaaatccgtgttaaagtgccaaaggacagagactggctgacagctaaacttcaaggtttctgagaatccacaaataactaaatttatctagtcaacctgttccagaacaggcttccagtcatttaggttgcccaagaatgagtaaaggaaaaggaaattcaattttccaagaccttgtttcccctctcctctttaattccttgttcggttagcaacagtatatccattccctcgctcctttgtgaaaagtaaattcctgaatgttaactaaaccaagtgtttctaaattgggtaagagtttgaagacttaaggcagcagaatgggagagacttaaaacgttatgtctgagaattaggcattaaaggaggcctagtatttgggcgggggttgtgaggagcacatactgaacctttggacctgttgagtgagttcatgtgcctctgaactctctgactggatatgaccagtaaacttggataattagatcctggagtttaggggagagggctagagatagagatgatggatgtcagcatatttttaaaacagaaaatagttaagatcacccaagacaatctggaatcgttagaagggagtaaggaaggcattattgggaaactttccagcttcaattctcatattttttctaatctcctggttgagtctttggagttgctgttctctctatgcaaaacccctcccttgaccctctctccctcactctattttttaatttgtcacctccttctcctgttctaggtctcagtttagatagcacctttctctagaagttcatagcactgtgtattcccccctttattgttcttatcacataatttttgatggtttggacactagttgttattcctcactaaattttatgttttatgaactcaggggtaagggcaccagctagcacaatgaa

SEQ ID NO: 113757 - DNA, 1078 bp, Homo sapiens
ctttgtctttctattccccagtaggaggtacttaatttttatatactcatatttggcaggctttttctttataggttcttttggctttaagtgatacttttaaacccagctattgctcatttaaattagaaccttttccatgagaaccacactgacgatttctttaaatatagcttgaaaaaatttttcccctattgttcttttagctattgttcttgaaaataatgtgttttttaaaggaatatctacaaatagaaatggtgatgatatccagcaaatgttttaaaatggtgtaaaaccatttgtactcctttagtaattttttggtaaaaaatttatactcctttagtaattatcatttttaaaatgatcagaggatgcattttttaactgttttattttttgaaagctcattgtttaacttattatatatgtattcatttctacagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggtgagtataagggactagaaatagaatattatcattaatgttgctgaatattttaaaagtacatagggctttgttttgtgaggctaaagcagtgatatccaatagaaatatgaagccacgtatgtaattttaaattttctagtagaatacatagaaaaggtaaaaagaaataaggaaattaatttcataatgtgtatcatttagctcaataaatgtaaactatcgctgggtgcagggtccatgcctgtaattccagcactttgggaggccaaggcaggaggattgcttgaggccaggagttcaagaccatcctgggaaacatagcaagaccctgtctctacaa

SEQ ID NO: 113758 - DNA, 1105 bp, Homo sapiens
ctttaaaatataatgtggcaaaggaaagaataagctgtagtctagttggtcagagctagttgtttatgaacagattgtaaggctggataatttgacttcaagtctgtactcagcaagtctttatgtttcataaccattaaagtccatgctttgagcatttttgataaaaaatgtgattttaaaccaggactagttttcacaagttaaaggagttttaaaagaaaccaaaatattggtacaaattaattacaggtttatgcatttcgaaggcagataccctgattaacattgagggtatcaattgtttaagataaaatatttgagaattatatttaacatatgcaataaatgtttttattcttaaaattgtcgaaaagaatagaagaagttggtggtggtgatgaaatagtactaaagactttctgctttcaaacagaacagacaactggagagctaatgcacatccttgctagttaggcgaaaatttcacaggaatgaaaaagtaaagcagactttgcaggatctatttctttaaaaaaaaaaaaaacatacatcttagtaattctccaaaaattttcctcaaagataaatgtactaaaaatattatttctgaagtttgtggcccttgtaaaggtattcctttatattaagtacagttatgcataaagaaagtaaaatatggtaaactttcatattgcactaggtatgaatttgtattgctaactgtctttgtaactaatttatgtatactgtaaatggtatagcatgtgattttattatagttgattaactttgtaatttctgtaactgcatcgatatcccagtctacctggaaaattaagtctattaaccatagttgctgtaggagacagtactattgccaactgaagcctgaatccttcatttattttgtccccaattacagagtggaggtttagaggagtggggttagataatgctcagattagaaatacaaaggcagctgtcagatcctcccattttattgttgaagaaactgagttgtaaacatcacaagagctagttaactggtgagtagcagccctggtattagagcacaagtctctggattgattcttagttcagt

SEQ ID NO: 113759 - DNA, 1023 bp, Homo sapiens
ccagtgaagcagaatcattggggtatatatatgcagagagagatttattttaaggaatcagctcatgcaagtgtgcggctgtcaagtctgaaatctgtaaagcaggctacagactagaaatccaggtaagaattgttgcagccttgggtccaaattccatggagcagcaagttggaaactcaggcagggtttcagtgttgcagtctcgagaatccttcttcaggaaacctcagccttttatcctgaaggccttcaaatgattggatgaagcccaccctcattatgaagggtaatcacctttactcagtctactgatttaaatgttaacaacatctaaaaaataccttcacaacaacatctagactggtatttaatcaaacagttggatatcatagcctagccaagttgacacataaaattgaccatcacaatagctaagaaattaagaatttcttatctgtttgtcttaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccataggtgagtattaatttctgttcaggtataaagcataatgaaatatatttattttcatggccataagattatcatatttctaaggagactaataggagaagttaatcttcttaatgttatattaagaaaacataactgttggataaaagtttaaataatagatgtttttacattctagcctatgctgttataatttttatagtgataatgtgttattagggcaagtatatattcaggaccagcaatttccttatccttctgtaataaacctaaacttaactcatatttgaaaaaaatatcaaagcattcagccttccttgaataagactttctaatctctactgttcagcactgataaaggcacttgcaagatgaaactactacttgtaacacatacatat

SEQ ID NO: 113760 - DNA, 1967 bp, Homo sapiens
tacaccattttctgtgtttgctgtttgtgaacacttagaaataaagtggtctaggcaaagtggcatgttatctaaattggttaatgtgaacacatgattattaataaaaacaacaatcatttgagatgtatttattccttaataatctttatcatttttgtttcagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaaaggattggtttcttttcttttttttttttttaagtgcttcctttgccgaaatgtttcctggctgtttgaacatgaatttttcaggtttaagtattgtgggaaatcatcttgacctaataaagcaatacatactgaagcagttctttgccctgcttagataatgtatgttttctgtacagttgaagaatagagctaaacttttcagggctgataaaatctcaactatctagtttgtaactcatcaagggttgggaattcttagtatgtggtgttaattatttttatttttttaagctgcggagtcattatctggtaacttccttttttttctttttctttttttgaaaccttacacggtaaagatgtccaggtgtaagggattcagata

SEQ ID NO: 113761 - DNA, 1026 bp, Homo sapiens
gattgggcttaaggaataatatagtatgtcagatcatgtcacatgaagctccaagttcttctccagtagaaaggtagacttagagggatgtgcatttctttaatagatcagtggggatgaagtcttttaccctgttgtcttctccgaagcccactccagcaatgtggaaggtgggtaatgtctgcattagcactctgcagcagcaaatgcttttgcttaggaacctgagagtttgtgcttttaaggtataacaacccccgacctatgttgttcaatcccttacagcagatgatttcccttaagttttcccacaggcttcccaaatgccctggtttgtgtaccttttacttggttcttgattcagaagactagcctgtgtagagttttaggctccttgtgcatattttgactttccatttggtgttttggcagggatgcaagacttcaattaccttagcagcaactgttttgagatcaccgtggagcttagctgtgagaagttcccacctgaagagactctgaagacctactgggaggataacaaaaactccctcattagctaccttgagcaggtaaacacagtccccagcataaaaatgcaaggtttacaagcattcaaacctgtcctacaatggtcttgtaagaggagtccaggagaatccgtctggtgcagaatgaggatgccatatttggaaggcaggtgtcagcagtgtttcagttaggcttttatttgtcataggttttgtggctcaggactattcaccaagaactgactaaactggagagtatacagaaaagacgtagactctcgtttctgtttgtattattctaagcaagggcaatcctaggactctctcccaccctgatcaccgtgaggcatcccaggcagagccagaacaaaagtaaggcaagcgaggcacctgaatggaaaatttaaggaggattttaatcttaggggcatgcaagtacaggattagcacttgagagtgagtgtctctttaagttttgagctgtacaagcctcatc

SEQ ID NO: 113762 - DNA, 1080 bp, Homo sapiens
tattgactagtttcacatcccaggcattctgtgaggcactggggatagtgaccgtcctcaggaaggcttcacacgagtgctgtcagaaacaagaatacctaatcacaagagaggaggagagctggctgaaaaacaataaaagcttagctacaaggagcaataacagtacacagaaggggacctaaccgagtcacgggagtttggaaaaggcttcttggagccgggctataagatttactaaagttgatgccaataagatcatcactgtgatcaacaatttaaaaacatgcttagctgctgtttaaatcatctcttagttcttgagaaaaaaaataatacaaaacaaataaaacacgtcttcttaccatcaggaaaaaggagatttgtcatacttatggtagcaggtgggcatgcatccaattcatctgacagtaatatcaatttatatataaataagctaaaaagaagaaggttaaagttatacaatcctattttatgccacgcaaaataagaatttgctctgtccacagatccatgtgatctaccttgatatggcattgtcattaggatgcaaactgtgtctaagcagtgagtggtatttataaccagctcatctagcttgcatcatagaacactccagtttaggaaaacaaaggctgatgaaaaatcagtgagggctgccagaagttctgtgttgtaattgttgtcttgacaatggtggtgattagtaattgaacacctgggcctaaaatctaagcttggactagtttacaactcatggaaaataggtgattaggagatctatttctgtaattgtttgagaggaaatcccttgcagagttttaaagagatgtttgcagggactagaattgtaaagctaattagagtagagagtctgctaaggagaagagcctcccttccactcagtagctttgaaagagtctagttctcaaaattctcaaaaaatttcttaaagaatggttcatgggccaggcgtggtggctcacgcctgtaatcccagcactttgggaggccgaggcaggcagatcatgaggtcaggagatcaagaccatcctggct

SEQ ID NO: 113763 - DNA, 1031 bp, Homo sapiens
gtctgtaatctatagataacataaccgattaggtcaggagtccatctttaactaccaggcccagggtgtggccccgggctgcctgcttgtggatttcatttctgccttttagtttttccttctttggaggcagaaattgggcataagacaatatgaggagtggtctcctcccttaatatgacactttttaaaatgatttggaaggtactaaaatcttttttttgggaagcaaacaagacattaattttcacttatctatttagggaaaagcagaataaaatgcacaaaaaattcagtggccttttgtgcatgtcttgattcttaaacaatgggggtctacggtatttgctggaaaataaagagatgcttgatatgaaacatatttaaggccatttctataaatttataggtcatattaattttttggttatttttgaccttcacagatacaccgaggagttaaaggatttgtccgagaccttcaaggtaacccaattgcgaatgccaccatctccgtggaaggaatagaccacgatgttacatccggtgggtctttgccacaattggaggctctacgttatgtacaagagcataattactaattatcataattataagtcttatgttcttctaagcaaaacaaatagctcgtatctctacagcgtttctcagctttgatctggtgaagtttcctttgtgggctcaggtcaggcggagtgagtggagcccagggcggctgctgcgttagaaatccgggtgcagcagatggcgccctttcctcagctatctcgccccagagctgggaggtggtgccacaggctgccgattcttcgcggttcttcaggcaaaggaaaaggagctgctggagttaaaataccagtgactttctagtctctgttaagaagtgctaacgagctgcgaatggggagaccgaaggagggagcggaaagaggaggaaggaagaaaactgctgcgggttgtgtgtctaaaaattctcacacagtttttcatttaatccgtataataaatcc

SEQ ID NO: 113764 - DNA, 1281 bp, Homo sapiens
ttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtgtgctaagcactgcatagcctctatgtatgttattgtggcaggcaaaaggttctgattttgggcacaacctttatataaataacacaaaaattaatgtttggacacaaactctaaatcagtaacacactggttaatatgtaattatgcattgtgataagtaaaatgacaagaaagagtagggaaagagaaagaatgacagagcaacttaaattagactggatgagaagagtcagggatgcatcttaatgcacagacctagaatattgagtgggtgtgagcagtgcagagtgcaggggtgtgtgtgtgtgtgtgtgcatggtggtggtggtatggttgatcaatgctg

SEQ ID NO: 113765 - DNA, 1032 bp, Homo sapiens
tttagagtttaagctaaaacaaatgctatccattgtattttttaaaagaacttctttgaatgatagtaattttaaaaagttgaaatcatatattaaatgggtcagaagtgctctaaatatattattttttcccaatcaaaatctagttttatgtattggtatgctacttgaagcattcaactcagtgtttaaaaaagacttcaacagtttttaacacaccataccattttacaagtcaggggagttgttacggaggtggagataaaagccatatatttactctcagcattttaaatattctgtgttgttgagttttccattgacgacatttaatttgtgtgatgagggaggcagagatggaggggtaaaagggtgaaatagttccctcattccttacatttctcatctatgttaaactgtcagcacatggattgtgtaccacagagccacctctggtagctcctggccgggttgctgctgtaagtgtcttctgagctctcttctttgcctctgagtgtatttgaagagtttattgggataatctcagtttcttgttaagtgttggaaaccaccttggcattagctcagttgattgaccatccagaaaagatggaactttgttcctctgccctattcttttcagagcacaaatacctaatagttgaggcttatggtattttgtgtttcgtattcagattaaagataattaagtatatgcctcattgcatagaagttaagatctttcaaatatccccgggagaaacaccatgaataattaggaaacaccaaatggagaatattaaagaagggaatgagtcctcacctatctcaagtacctcgcatatctaggaagtctcttcatggctcacatcataacatagtttacatttttgcattaaaaaatctagagcctcctgtcttcaccatatccccatcaattaacattatccctccttctggatacgtgaggaaaacaggcaagtggtgagggcttgaacctgagtttctatatttctgatgactttccttttt

SEQ ID NO: 113766 - DNA, 1079 bp, Homo sapiens
tacagatggaaatgggcactcagagaaagattaagttgctttcccaaaagaactcaaatcatggtttcttcatcaggaacattttgctgatatatttttattttttggccatttctctccacaaacattatgctcccaacaacattggcatttgcagttgctggaataagtgagccattttatatctgtatggctttgtcatgcacttgcctccaaggtgcttcccaccaccctcctttttttttttttctagctaaccctccatcctccgccaagactcagtttgaacaacagcatcacttacagcaggaagccttccttctctgtccaccttaggctgaactaaaaacaatactgtgggctcccatgtcattcttcatgttttatcttttcattttgcattgcagttactgttttgtctatctccatgattgggttgaggcaaaagtaacctcctatctgtatttgtatcaccagaacgtaatctaaccgaataccttccagtataaagtagtagggaagtaattgagagcagaatgtgtgtgtgtttgtatgtgtgtgtatatattttacataattatatatatactatatatattaattataagctgtggaatttgaacaaattatttatttttagcttctgcttcttccattgtaaaaatgggttcaatactattccaccctcatgggataactgtaagaataaagataatatatgttaagcgcatacatgcccttagaatgcttacttaataagtgacagctgtttttatgatcattattagtgtcttagattatatggagacttttcatgtaatcacatatggacattttctcaggaaaccaaaatgtgtagtttatcactggtcctggatcatgggcaccatttattttcatgtcagatattttcactgagaatatttcagttaattgttgaaaagagcagaaaataattcttcacttaccaaaggtgaataggacattcaagttccctttattcgcctttaaatttgcaacatttgtctaggtacgttaaatcaaaattaattgtattgcaagattaactccattattca

SEQ ID NO: 113767 - DNA, 1035 bp, Homo sapiens
ataatctctccaattcaaattcctttacttaaccatatttgcaaagtcactttttcatgttaaggtaacattatagattctggagattaggaaatgaatatctttggtagggcaatttttctgccacacttgtagaagaaattttgaattctttgcaaaatgcacagtctgacatgaatttctataacaactgggatgagatcaatattactggactggaaatcttgcataacatacctcaataatgattctgcttttagcacatacattttaacaaatgatagatttttaacatgtgataattttccagaaaatggatctttcattatctttgataaataagatagaaaacaaattactttctaaaaaatattcttaatttttataaggattttatcttgcagaaattgacagtattcagtcaaataaaggttatgtttactttcacttgttttaagctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaa

SEQ ID NO: 113768 - DNA, 1049 bp, Homo sapiens
aattggaaacttgtttgcaagtggcattccttagtatcaactgaccttcttatgccttctcacttcctcagccactagtgcaacagaacataagtcagacaatactgatggcaaattgtctcttcacctgcaaggtgaactatcttagagagtaagcagttgaatattagggacatatagagttctaaggccaaaatccatgaaaagtactcaagtttggaaaatggtgggagtggagaacatctgttaaaggcaaatttgccatctatgcattttgcaagaactctgcttggtgagagattacctcctccccccagatagcagattctctcaacttcctctttgtagggattttaaactctactcactgctttttcaactgtctaaatccttttatctttatagcacatatggcctcccaccctgaaactggtaggcacagtttctgatctaatttaatacccacattagagtatgttttaaatatcatatcaccaagtccataaacaactatgctaatgtatgaagtagctcagcactgctcaaaacacattacagttgccaacaccataaaatcccatttactttttcttaaaagtgtttgatatcgaatttgctttccctgaactgtaattaacaacattctgaactgcttacaagattcaattgactggcattattaatcacacattcacagagaagttgaccattacatttgatttttttttctttcttatgtgtttttggcatctaatcactgatgaaaactaaggaaatggcccttttcaccatgttccatgaacatttattttcttggtgtatttagtctataaagatttatccccatttctattggatgctgattctaaatttctatagacatggaattaaaccaagaaacagtatttcttgtcaagaggaacagtttattccagataattaaacccagaaatgttcaaagaaaacacagcaaggagcataaattagattctatcaagggatataggttgttcctcatgaatggatactgacaaaacaattttgtggga

SEQ ID NO: 113769 - DNA, 1122 bp, Homo sapiens
tcggcttaatctcctttgcatctattgctacttttcctcacaccttccaataaaactttagttcggttttcaatgaggtcaacagaaggtgtgatttctttattcacattattttcttccgtttgtttgttcaaagcattcctcctaaaataactataccctttctatctttgttgctgtcatgtgactctcattctaagacattctttgtcagtatattatatttcatttgcttatttatattgatggatttttttttctcgtggctgcctcttttttgatttactactttaataggaaagaatagcttccagtagtttcattaccataaaagcatgatgatggcatgcctgctgattgaatcttactgcatcaacctattatgccttagtgtggttgccagcctgggttctcatctcaccaccattttagagacatccttgactattcttttgactgggtcttcagttttctctattttgtggctgctatttacttgctcatattgcttggggacctcttccagcagtcccctgaagaagagtctgttaaacacaaaagtttggagacttttcatgtctaaaaatgctttactcttctcacatacttaattgatgtgtcaataaagtatattctagattttggcagggtaaaaaactctaaattggaaataattttcctttagaagccattggtccattgacatcttccttccagtgttgctgttgagaaagcccaggccatttgatttctttcctttgcaaataagcttatttgcttgctgaaagacagttagattttttctttgttctaattacaatattttgtcttagagttttcaatctgttgtgctgggttctaggtagcccttttaaatttgggaactgatatacttcaattatgattatttagtttataatttgttgccttctgttatctcagtggaatgtatcctgtacttttattcagaaattggacttctggatttgccctctaatttactgatcttttctttcctattttccattgctatctttttgctctactttctggaggtgtaataaaatgtatctgccacctgtgttgtgcaagcaaagacagatggacaagcacacacacagc

SEQ ID NO: 113770 - DNA, 1030 bp, Homo sapiens
tctaattagagtattaaattctcactaggatttatatatatatacaccacttttcaaatgcaacctttgcagcgtgactttccccagctggactgcctctgctttcctgtattccgaagacttgccctaaagcagactctgctggaatcacagcttggccttacattaagctaatgagtacttgctttgcaaattgagctgttctgtgttgccaatgaaactgcagactacccttgctgcagctattctaaccactccatttaaattaaaaataaaatggcattttcttatttcttattcgtcttacctttatcttattatggataaacaggggcaagaaatagaagtaagactaacatctttcttgtctgaatatgctcaggggaatagtttcatatgcttttcacttatatggctttttctattattatttaaaatgttctttgctgtttaaatatcaatgatgcatgctgtataaagtgaaatttagaatttatcttaattctatctccctcccccagtggtcactatgtaaatacttgcatcattttatattatattgaaaaattaaaatgaaatcctaagtccctcaactgactggatgaaccccttcctggccaagggggccccagagcaatcttgaaaactgagttcctagcaatgatgggatggaatttagaatacaccttatggtaccccctccctagctcactgcctttctttcctaagagttaaccagaaaccagccctttggaaagacttactccacccctgatatcaaccaaccctcttacactgcctctcctttttgtggtttagacaaaacaaccagccagcattctttcctggctagagaccactgaccgcttagtggttctggccagtctatggaggatgtgcagtgagggttttctgtcacctttcagtgtcagagggctgaaaattccaccctcgcaacatgctaacaccaccatgttttgaacgtgggtcctgtggagaggtatgaagcttaactgcgcatgtgcgtgtt

SEQ ID NO: 113771 - DNA, 1057 bp, Homo sapiens
tgtgctcatgagggacctatgagaaaatgaacgaagcaagaaagggaaggtgaagaaaagcaagaatgtggcttctgctagaatatagcctgattctaaccctactgggaatgccaggacaccagagaattgccccaccttgagtcaagggggctgatttttatacttcatgtcactcagacattgggtgtgggctatttcccatccccaggagaggtcgtaaccacccaggcatctccaagaggcctctgtcagtttagggcaattgtccagggaatggtgcagctgagagccttagcaacccaactcaaagcagctgtagcatccactacaaggagggaaggagaatgactagaattggcaatgtggagcaaggagaatgcctaccttacatccaagcccagggtcatgaaggccgaggaagagaaaatgatcatcactttaacaaggagaaacagagttatcttgggagaactgggtttggcaagactacagccagaaggaaaaggaacatcccagaaaatatcaatatgtgatagaattttctcatgatggatcataacatccagaggctgaaaaggaagggcattagaggaagactgagttattaaagatgcacagcaggccgggcacggtggctcatgcctgtaatcccagcactttgggaggccgaggcaggtggaccacgaggtcaggagttcaagacaagcctggccaacatggtgaaaccccgtctctactgaagatacaaaatttagccaggtgcggtggtggacacctgtaatcccagctactcgggaggctgaggcaggagaattgcttgaacccaggaagtggaggttgcagtgagctgagatcacgccattacactccagcctgggtgacagagaaagactccatcttgaaaataaaataaaataaaataaaataataaagatgcacagccgtggaagtctgggtgagaagactgacttgggaagtcttgggcatcctctggtggccaaatcaaattaattacttcattcattatttacaatttcattaattaaaattttat

SEQ ID NO: 113772 - DNA, 1011 bp, Homo sapiens
catgcttccctggcacgctgagttcttccaaagctgctgtggataccatgtgctctactttataatttccatagcaggtagtaaaaaagaaaagaagaggcagaaagaggaagatacaggtgaaataggatcacatcaagatgtgtaaactcacggcaagtgaaatgatcttgttccataatacctccaaactgacagttcttctgagcaaacctagttgatctgtcagttttgagcatctccacactttgatccatttaacacatgacctccatgttctctccaacaccctgacctattgtttctctccagcaacctcctattgtttctgctgcttaattgggaatgatcaagtgttatgcattgtttttctaagtgaactgctcacctagaaaaacagtgcataacaatcagtatgaactgtattacatttcctttgtagcctcttactgtattcagtaggtgttagttaatattgttaaataggtgaaatataggtgattgattagaagaaaccctgacataataagtatgaaataattagcagagcagaggaacaaaaagggtatgtatgaatataaagcaatggagagagattagcaacatctagaatgtgacagttggaagaggtggattgaattgaagggctccaatgagtacaccaaatacttatctgtggtcaaccataggactcaataaatgttgctaaggttttaaccagatatttcaagtaataaagatatttttctttgaacatagtagagcacatatgaaaataaaagatggagaaaatatttgttattcttcctaaacttttacaaacttgagcttttttgatcttatttctattatgaactacaatttttttcccaacactgatatagctacatctcaacaatccacagagatgatgaagtgtggatagtggaacttcaattttactttatttggtcctttctactccaaaacctccactaatgccaagtgagatagtgaggccatctagatgat

SEQ ID NO: 113773 - DNA, 1043 bp, Homo sapiens
gcaaactagtatcaaatagttgttttgaaagaatttgaccctgaagtttcagataccttcacagtcaaaactactcaatgtctcaaatcttttctgcagagtctattttaagtacttttcaacatgtttcttcatttgccttggggccatacctcctcatggatcactgaatctgcttaagcataattacagcaattcaaggactccatttagacattgcattcttttgacgttttggagttactttataaatgtaactgtagcaaatacaattttaagtatgaaactttatatagcttactgtgctgaccaagatgcaaaatagttctaccagttggtgtttgaatgatatataacaatagaaatggttctttcctatttaattttaattgatttgagccaagaaatagcatcctattggatatctgctgaaataggactaaactgctggtctcctgaactgtgatagagaaatccaatcaaaagcttttcctggccaaaaataatactaattgcaagtgaaaactagctttgttctctcggttatgagttccaatggtgaagtctagttccatataacagtgcatggtaaattaggccacagaaacaagcttccagtcactgtttatatgatccacatgttgtggtccaaaaaatgtaaataaaaataccctagggaataagaactttttcctaagatgacagcttttagccttggttgttgaaaatggtgagtatttctaatgaaattgaaaacaagtctagggaaatgaatttccaagtaatggaggagaatctttgagaacgagaagaaagaggagaggagaggaggggaggggaggggagggtaaggaaggaggaagggaggaaggaggggggagggaggaaggagggaggcagacaaagaaaactctcatctgaagattaatggttcttttaaagtcagaaagatcttcaaaataattttcaccattatatagacattacagaccaattgctttgacagagaatattctaattgtgttagtgcaaagagaatgcaa

SEQ ID NO: 113774 - DNA, 1039 bp, Homo sapiens
agcttcaaaattacttttccagctctatattccctattatttctcgctgtttgcttttagacttaagtaaacttcaactccaattctataacttagtaaaagaatcacattgatgtgaaagtccaaaaagacatttgatgttgtaagtggaattttctcattcgttcactctctgtcaatgagaaattaaatgactaacactaaatggagtgctacatatgtctggcattttttacaaaggaatttatatactgtctctcatccagttatctcgcaagctctgtagggtaggttctgttattacgtgttttagatgtgagaaaactgagactcagagaggtaggcaaactatccaaagacataacgtgacagtaatgtgtctgggattattaacaccaaaagttggctttttggtggaatttgtaatgatgagtgattcatacatttgaagtggtgcttgacttatttaatggtacataacaaaccactccaaaacttaatggctcaaaacaatttattattttctctcacttactagtctatttgaagactagctaccacaggggaactcttaggcatttttttcacgtctgttatcctggaatgagtaaactctaatgagaacaaagaataccgaatatcatggagtttggatgaggagtgtgatacaacagggttacagtttgaattaggagtcacgccaaaaggaaggtagaaaggaatccagatcagtggaaaggaggaagcacctaacataagaactaggtgtgccattaagaattatgctttgggccgggcacggtggctcacacctgtaattccagcactttgggaggctggggctggtggatcaccggaggccaggagatggccaacctagtgaaacttcatctctactaaaaatacaaaaaatttcgttgggcatggtggcacatccctgtaatcccagctactctggagactaaggcaagagaattgcttgaaaccaggaggtggaggttgcagtgagctgagattgtgccactgcactccagcctga

SEQ ID NO: 113775 - DNA, 1037 bp, Homo sapiens
agctagcacagtccttagtgcattgtacatttgaacaaatgtttgagtgaataacaagcccgttctccattctggttaacttacgagtactgtaccaattttcttccctgggcggaaaaaattatgaaccatggttcttgtgaaagttattatttttaaatgcctagacattcattcccagaactagaaacataagaaacaagttgatacatcaagggaccaagagatataaatgataataacttggaaatatttaaagttgtaaagatcctgcttagaagagggaagttatcaaaaggggttgagacaatagttgaatgactgagaagacattaatgaaaatcacataggagtatgatctaagaaaaggtacttgacatttttccaagtgagaaaactgcatgatcagataaccatgcataggttggagatgtgtccagagaaatttattcctgaaagacagcgataaagtaccagagctaaaatagtccatctgatagagacattggagctgagatctgaaatgatgcctgtttcttattaagttggattctatttactacacattttttagtgtatagatagaaaagggtacacaataggtacctaaaagcagatagctgtaattactactatttatcttttgtgctctgaggtttctcatactgtgttggtgccacactctaatcagctgcataaaagggtagatcacttgccaccacagaggcatgtgggagaagacagcatgtctaggacattacgctgaggctgaggcagtaggcaaggaagtccaacctgcaggctaagagtcagttttcactcctgtgggaaaagcatgcccagctctcagcaaaagcatagaaatcaagagagaacagtaaaggcaaacaggatatgtagcctagttccagttgaaggtattattcctaacaatgaaaaatgtcaatataactatttccagagttaaaacttcagacacatgctatgacaatgagacagtatgtttgaaactacagatgtccaaggaaattcaggct

SEQ ID NO: 113776 - DNA, 1054 bp, Homo sapiens
gtctgtaaaggaaaaaaacacaaacaccggaggagaatcatcctaacaagccgacaacatatctatgggcctaaaaaacttaaattctttcccgttattagcacttctcgatcgttccaggaaagcccgatttgtagcttggctgccccaggaaggggcctgcgaccagaaagatgcaaagggcgggacaaggttacgagtgggtgcggggaagcctccctaacctgggggccgcgtcccagagctgcgagccacgcctcctctctcccgcccgccgcgccgccggactcttattttgaagggcggcgggtgaaggctcggagcctcctgagtcacccggcgggcgaggtataaagcccgatacctgccccgcgcccggtccgcggagcccgctgcagctcccgctcgctccggacgcggaatcgggcagcagcgggaggcggcccggagagccgaggtaggcgcggggaatcggccctgaggctggtggaagaaatgtgtgaattaaagggagtgcagcgtgcagggtgggccgcgagtcgggagtgcagggctcgggacagggtgggggcggggaggacaagagactcgtcagcgcactttccacccggccggttccttcccgagccctctccctcccccggcccgcgggagcacagatccctgaaagcggagctccagataggaatgtctgcatcatcttggcagggcccagacgggagaagatgctctgctgccacggacgatccctcccgctctcctaactcttctctgaacacctcgcacccccacggccccccgcccctctcttaatcttggccacgctccctgaggggtcagacctggggtgggagagcagagaaagcggggctggcagagacaggggtgagggccgggagaggcgatgacatcattccctggcagctggcggggagagggtggggacggaggggtccccccgacctgagccgagccctcccttcccaagcccatcctcctttctttgggatggttcaccccacctgggcgccattcaaaggaagtttgcgcgtaa

SEQ ID NO: 113777 - DNA, 1052 bp, Homo sapiens
aaagatagcaccaagattttattggtgttttgccctgtggagtggaattgtatgaggattggtggttatgtgggaaattctttacatttactttattatcgtactactttcactttattttttaattaatattttatctttaatttttgtgggtacataggtgtgtatatgggctatttggatatggacatgcaatgcgtaataatcacatcagggtaaatggggtatccatcacctcaagcacttatcctttgtattacaaacaatccagttatactcttatactttctgatacttcagtttctcacaatgaatattccttttctaaaaaagaaaaaaaaaggaagaaactaagtcccaggcatattaagagagagctaattagctgtagaactaattctgacactctatttcccaatcagtattattcagaattattttttacttccctgtaatagttactcaattttagagccagaatttagcctaatctactcatttaacctctaagaaaactgagcccagggggtgctaagttcctggagagtggtcctcaggtggtgactgaggactgagttagcctcctccggcaaccctacccccgtcccaccccaccccaccccaccccacccctgggcaaagtgaaagtgaagcaaactgagaggaactcctccactgtcccttctgcttactcagcagatgggagccagccactttgttttgtcctggggcctgtccttgatggcttctaagactaaaaatcaaagctgtaaatttgtgtaatttagagattgaaggtactgatcgttgttgtcagtgactggaaaccaggcctattgagcaagagccattgttcagtgcctgtcagcccagagagtgtgccgaatgcactggccatcttagacacagatctacttggtggtgttctgtgttttttctcctaaaagaaggcttctcacaccaccactgatgagaaaacaattcgaggaaaacgtaggcacactcagtacatgaagggagacactattaaaagcaaaaagagggttattgtc

SEQ ID NO: 113778 - DNA, 1048 bp, Homo sapiens
ggagtgccacatagccacagtgccacaatgttgtatgctcttaactacctcttttatataagcagggctttggtttgaaatgttgccccatgtttgtcacaaagaagagcatgtgtcaataagagcttttatacagatgtattaatgacagcttttattatataggcccacagctccttatggacattatctcattgtcgctctctttctccctcataggaaacgggtaggtggggacactatcatcgttactcaagaggtgacgggatttcccagggttctggaagaaatgcctgagcaaggagagcatagcgtgacttaggttcatctcaaataactctaatgtctaacatttcttgattaaagaaagctgttgtagaagcagcaaatcagaatccccgagtcaaggaaaactttgtaacaaatttaactgtactttaagattcatgacacagggcattttcaccagttttcaagtcaagactgtggttagatagtaaccagtgaaaaagaatccaacagatacaagccgcaatgtactttgcagacatctcatctacctatctttctcctatttttcaggaaacagatagtggggggcttttcattctctgacctgaaggggttggaggtgttattactgggctcattagggtccagtatcttatcaagttgtatccaatcctggacaagtatttaccaacaaattagtaggcaaggcctccaggatctgctgcgactgggttattctgttgaaatgtctctgcccctggggcagctcaaaatcagacctgtacggctgtgtaccaagttgtacagaatgaatgaacagaagtaacccgaagccagtggatcacgaggtcaggagatcgagatcatcctggccaacatggtgaaacaccatctctactaaaatacaaaaaattagccgggcatggtggtgtgcacctgtagtcccagctacttgggagggctgaggcaggggaatcgcttgaacacagtgggtgaggttgcagtgagctgagattgcgccattgcattccagcct

SEQ ID NO: 113779 - DNA, 1086 bp, Homo sapiens
agcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatagtagagtgatagatgctatcaggaaaacaactaatgggacaagcttagtcagggacatcctttccaaggagtcattaagctgaagactgatgataacaaccccagataaaggagtaggaggggagagaggttccaggcttgggaaaactagcaaactatgcacgtgtttgttaaaggattccatggtactagaaattgaagttataaataattcctatggttcttactgtctcagggtctccttaaatatcaaaatgagtttgtaaagtctagtgttaccttatttgaacttcagggcaaatgactaaaagggacaaacctagaatagcaggttttaatcagttagcatattttccactgtaggtatcagaagactcaactacaaggagattcgatgcacagggtttactgacttatgaaacaagtctggggtagggtagttccatggtaggttaagacagtgcccccaaaacattatcagggcccaggtattctccatcttttcagtctatcatcattggcacatatgggttctcctcttacagttatggagtgaacaatgccgcttttgacattgcatttctgacacagtgatatccagtgaaagaagaggggcatttcttccttctgtttcttttcagagatgagagaattttaactagagcacc

SEQ ID NO: 113780 - DNA, 1005 bp, Homo sapiens
ttaaagatgggaagcagatctctccaaagagtgatcactacaccattcaaagagatctcgatgggacctgctccctccataccacagcctccaccctagatgatgatgggaattatacaattatggctgcaaaccctcaggtaaagaagggtataggtctgggctcagttctgtgtctagtgcttacaggcatttgattagacaaaggaactatttaaaaggtgaagttaagaagtttctttgatttatgaaactatttttccaaattctacatccatcttggtttcagaggatagaaaaattctttgtttcatgaatacttatttattccatcaggtgttattctactccttccacaaatattattaagggtctaatatgtacacactttctatgtgggtgatggggttgcagtggtagactggacaaagtcctatggtaaaaaataagcaattaacaaataatataacttcaggtaggattacatgaagaaaataaaggagaaaaagagtgagtggcatgcataggctgtataagaaaaactcaacaaagtaaaatattttaaaagaaacacatcagtgggatttaatgtgcaaatgtagacaaatgataattttgatagcattcaggtttatcagttttcatcaaaatgttttctcttgtatttgcctttagacttagggtcaaaaaatcagttgccttcttagaatttaataggaggctgctgggtatcatgttgccagttcgagcctgcaaattcttttttattatgttatacattttagtcactatgctggatataggggatacaaaaatgagtaaaaagttattttgtaccttaagagctcaatgtatgacaggtagttttactaaagtctgcaaaagtagtataaataacacacttttaaaaagaaaaaaaaaggcatggtaaaatgagcagttttctctagaagtcatctttttagaatctctgatctacttatatcattccatattatttctttt

SEQ ID NO: 113781 - DNA, 1021 bp, Homo sapiens
tttatacaggttgcaaaacatagtattcattaaagacatgaatttagaattgatttctttgagtggtatttctcttgattgagcagctagacaaaataatctgcaaatttaaatgtggcgcatttgactcattcttgagaaattctcataagtgaagaggattagcccttaaggttttaatacctggtacagtagtgaaccgcacagatttcatgaacttaggatgtgttttttattcatgaaaaacttagaatagtgaactattaatatttaaaaacgagaaatacaacatttaaaaaattaagagtattttgcattagtgattatgattcttatcccaaaattctagaaagtaataaattctgtatgaataagcataaaaaataaataaatatgcaataacattaaattaaatgtctttacaagaagcagtgaaggcactggtcttaagtgagaatatttgcctgggagtagagataaagacacaaaccgaatgtgaaataccaggtaataattattttgcattaaactctttttatcgggaatagtatgatattttcagtgtcactccattcatgttgatttggagctgacagttattttgtgtaagcagagatttaattttatattgaaagtcagtgcaaaattatgaataggatatactaataaatacaaagtaataacaaaagtcaaagcagtgttctaaataaaaattctgggttccttaaaaattattttaaatttatctttgaaatagttttcttagattaatctcaggatatgagaaagtcaattaagtgtgagtaaagttagtatcattaaacaaattgtctattaaatgcaagacgtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtctcaattgctggcctttggctacctgtac

SEQ ID NO: 113782 - DNA, 1034 bp, Homo sapiens
ggctcgaatcccgactgatatgacccagcggggacagaggatccccctcagtgccacaagtacattccccaccgagcagcgcgcctgcgccagttgctctcatgcgtcaagactacaggtcccagcaagcatcgaggccctctccaggccattcttccgccggcggggagctctcgtcggcgtatttgttaggtgtggcgcggaagagtccgtgcgtgatgacgtcgacgcggcgacgtcgagctcttcctccttttcacggcgtcttgcattactattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggtaggtaccaaactggagttgtccagttgtatggccgcggtccaggcgcctaaagaaaatctcctttgtaaaaagagcgggtctggcctttagggctctagggttactcgatgtagccgcgtgcaggcgctctcccgttccaagggtagaatgcgtctcgtgcagaaacccgcgatctccctatgcctcgcagaatgccggccacgcagcttgccgccgagggctgaacacttggggtgttctttgagacctcgtagtcttttgaggccccgctatacgcaccctccgccctgcggctagtgctaacgctgaggagcttccctgttgtgggagagagccacgtaacagtttacttttaatgtagggaaaagggcgagttctcggcccccggagacagggctgggtcgaaaggagttcaggcaggaaaggtgggagtgcaggtaccaacggctc

SEQ ID NO: 113783 - DNA, 1011 bp, Homo sapiens
gtaacaatgaaaaactattataaataaatgacacagagctgctctgttcttaaaaatcaccacatgatcaatttgagagacatgcatgaagatgggactcaggagattttgttttaattattctgcccgaaggaaaacaatactttgctctttgctggcaccgctgtacagagaagcttaaagagactttgaaaacatgatcctgttcatccttctcaaatcacaggcagacacagttgccctcattttttgaaaggggaaactgaggtgtagacaaatgagtgttttctgtgtttagcaggctatttaaagactcatatatcatcatatccaacatgtttttatgtctctcccctactcagctgttctgatcattgtatttgaaaactcaccaaaaaggggagaaattaacaaaaggctatagagaaggtgagcttttacttttataagctgccaacttcttaaaataattttaaaatgaggtgtgtgcacgtgtgcctgtgtgtgcatgtgtgcgcacacacatacatacacatgtttgagtatgccttggtattggggtcaggaaatagtaaggatagaaagataggaagaagtgagggcacttcattgcagccaccaaacccaggagtacctgcccctccccgaaggctgcagcctattagccagagggcctgggatatagccagcgactggggctggattagcgaggttgatgaaaaattatgtactttatagttctgtcagaccagggtacccttggaataaaatcttttagaatttgaaaaaatatccacttactagtgaatacaggacccccatctgagacctactgctgcccaggatggcagtttataattaatatttcatcaggggtcaaactgcagaccaccaagaagaccctgtgagactgtattgaaaaatcaacttgttaccctttgccattttttaaaaaagaaaaaagtgaatccatttgaaattcatagataggagtctgcgactgcaaaatgt

SEQ ID NO: 113784 - DNA, 1082 bp, Homo sapiens
agccatgatcatgccactgcactccagcctgggtgatagagtgagatcctgtctcaaaaaaataataaaataataaaacaaaataaaataaaataaaatgcagtgacacttctaccctcatatgctggagtttgatgggggagcacattgatttagatgccgcaaaagcagcatttagctgtggaattacagtcgttacccatttgggtatattttactctgcctggaagagttcatgtgtttcacggttgctactaggtaaggacgcaggccctgggagatcctggttcaacagtgactgtcttatgtaacagagtcattctctttatgaccaccttaggaaccgctaaggaacataataagaaatacacagaactgattgtggaactgctctttctccctgcgattcagaggggaaaagataaagccacacagccctggggcctcttgcttaagaacacatctcagtttaaccaccaaggccgttatgataacaaatgtcagtatggaggtgtgaacatcaggggctattcaaggacgcttctctgatcactgccatgtctatctgctgtgatcacgactattttataaacacccttcctacccaatgccatcagaattttagggacgatgcttcagtaattatctttttttccctccttcctccctattttctttttcctctgaatagctgccaaagtaactagagtcatataattttagagctggaagctcagggagaggcttggatcctgatgacccaagcatgggaggggcctgaaaaaatgtcaacagcgctccgttgttgatcccacacatttacttaatatgagctggtgctggcagaggtttatgttggaaaggctgcaactttctgtgccccacataaatgagataaaacctggggaaaggagtgttggtttaaatcagaaaggctctggtttttatttgatactaaacaaatcatgcagtttacaagtctgtgacactctaagagttaactagcagttttgttttttttcttttttttgagacggagtttcactcttgttgcctagtctagagtgcaatggcgcaatctc

SEQ ID NO: 113785 - DNA, 1484 bp, Homo sapiens
caatgacaagaggtttcatggtcttaaaaagatactttatgtggttgaagatgaaatcattcctaaattaaccttttttttaaaaaaaaacaatgtatattatgttcctgtgtgttgaatttaaaaaaaaaatactttacttggatattcatgtaatatataaaggtttggtgaaatgaactttagttaggaaaaagctggcatcagctttcatctgtgtaagttgacaccaatgtgtcataatattctttattttgggaaattagtgtattttataaaaattttaaaaagaaaaaagactactacaggttaagataatttttttacctgtcttttctccatattttaagctatgtgattgaagtacctctgttcatagtttcctggtataaagttggttaaaatttcatctgttaatagatcattaggtaatataatgtatgggttttctattggttttttgcagacagtagagggagattttgtaacaagggcttgttacacagtgatatggtaatgataaaattgcgatttatcactccttttcatgttaataatttgaggactggataaaaggtttcaagattaaaatttgatgttcaaacctttgtatgtcccttgtgtcagtccttaaaattttgctttttaaaaaaacaaaacaaaacaaaaaacacgggacacatttgacctaatttgtacctcacaaaaattctttgcatacatctcaagcggaagatgtctacaggaatcaatttggtgattatgacacattttacctctgcaactaacaaaccttgtttatttctccaagaagcttaaaaagagtttgtggagtcgcacgaggtcatgtatggcacttgtgttcccctcttcctcttccagttactaaaataatctggtgagtgctagttgtcttagccatagaaggaaaagcagacctatcaaccaatagtatgataacccgtaagtctcagcatggcttggggacaaaatctttagattcaccatggttttaatttcccatgaaatgaaaggcccatgtaagtcatgttaaaaactattttcttattaacttttggctactgtcaaatgacttatcagaattgaaaatcaggaattctaggttgtattgtagcttttccaaaaactatctctgtagccacctgggcaagttgattattacttagtttcctccttttggtgtcccatctaccccactgggtgaggatgaggagcaaaggagataatctcactgtttttgaaaagtgctattttaatgtgtggcattaagtttatctctggtttcaaatattcatctcactctcttggagtatatgatataatgcttttcagggtctgattggttttagaaggaacaaattaaggtgatgtttccaactgctatgcatttaactttctgttcctataatagaacatatttgcatacctccagaagaacattcaattctctgaatatttcaatc

SEQ ID NO: 113786 - DNA, 1097 bp, Homo sapiens
tttgtgtgggttttgttagtctggattcggatgtataaggtgtgccttgtactgtctgatttactacacagagaaacttttttttttttttaagatatatgactaaaatggacaattgtttacaaggcttaactaatttatttgcttttttaaacttgaacttttcgtataatagatacgttctttggattatgattttaagaaattattaatttatgaaatgataggtaaggagaagctggattatctcctgttgagagcaagagattcgttttgacatagagtgaatgcattttcccctctcctcctccctgctaccattatattttggggttatgttttgcttctttaagatagaaatcccagttctctaatttggttttcttctttgggaaaccaaacatacaaatgaatcagtatcaattagggcctggggtagagagacagaaacttgagagaagagaagttagtgattccctctctttctagtttggtaggaatcaccctgaagacctagtcctcaatttaattgtgtgggtttttaattttcctagaatgaagtgactgaaacaatgagaaagaatacagcacaacccttgaacaaaatgtatttagaaatatatttagttttatagcagaagcagctcaattgtttggttggaaagtaggggaaattgaagttgtagtcactgtctgagaatggctatgaagcgtcatttcacattttaccccaactgacctgcatgcccaggacacaagtaaaacatttgtgagatagtggtggtaagtgatgcactcgtgttaagtcaaaggctataagaaacactgtgaaaagttcatattcatccattgtgattctttccccacgtcttgcatgtattactggattcccacagtaatatagactgtgcatggtgtgtatatttcattgcgatttcctgttaagatgagtttgtactcagaattgaccaattcaggaggtgtaaaaataaacagtgttctcttctctaccccaaagccactactgaccaaggtctcttcagtgcactcgctccctctctggctaaggcatgcattagccactacacaagtcatta

SEQ ID NO: 113787 - DNA, 1063 bp, Homo sapiens
ttagaaatgaaaatgtatgaactacagagaacaccagagaggctagaaaaataaaggaaacaggaaatgtatactaataaaagattgtaaatgcccattcagatggaagttaaaataccatagcattggaagtctgtggagcttctttatattgcaagactctgtttcttgaattgtaccttggcagttatcaccaaaagttgagttaaggtcacacagccaccaagaggcagaggccattcagggaccggtctgtgagccactctggtcaccccataatgcctccacagcgctttgttcaaagggaacaaggggtgctttccaaccaaggtgccagtcagctttatacatttttcctttcttttttttttttttttgccttttttttaaacaaaaaattttattcattcatatatcttattttttaaattgtggtaaagtatacatgaaaatttactattttttcaagtgtacaattcagtggcattgagtacattcatgttgtcatacaaccattcactgctatccgtttctagaactttttctcatcctaaactgaatctgtactcattaagcactaactcttcattccccctcctccaggccctgcaaccacccttctactttctctccccgtaagtgacttctgggcatctcataagtggaatcatgcaatagtcttccttctgtgtgcatgcagcttatttcacttagcataacgtttgcaaggttcatccctgttgtagcacgtgtcagaatttcattcctttttaaggagctttgtacattttaaaaaacagtttttctatacaactaggctttttctttttgccacttgacatgcttattaagaattaaaggtactatgctaagtcctatgaggcatataaagtgaatttagcatcatctcatccttcaagcagcttatggtttggtagaataaacgagacggacacagatggtaataatacattgtagactgtgctaagtgctgtaagacatatacatggaggcctctgcgatttagtcaagcatgaaattgcctccagccatggggctggag

SEQ ID NO: 113788 - DNA, 1064 bp, Homo sapiens
tttgcttaaaaagtgtatagggcattttaatgtttcataacaaattatgaaacatttcattttctcacacctaaaaggttaattttcagaaatgagtcactactcaacaattttaaatatctgaggttgcctttttatgagaaaaatcacaaactaattaaaaccatgatattttaatgtcttttcaactttttatttttattatttaaatattttattattgctatatacacactaaatttttccagtaactaaagctttaataagcagaatagattcattttaattaatcaaatgttaagtcatgtcttatatcgtgtaaaaaagactgaatgaatattctatactggtccagcatgtgtgtgcatgtgtggcatataaatgacttgaacaggagcatctttattacatcaatggggaacaggcttctctagaatgaaatggaatgttttaggaaagtatttttcctaagtgttataaaacaacattgctttttaaaataaagtttagtgataatgtacctattaggcttcacatatttgtggggcgaaaattcctccatatgttgagaggaaggaagatctcaaacaaacgtgcaaagtcctgatggtcaatatccttggtacagtattctctttctgtgccagattctttcttggcgatcaccattcccccaccctgcccccatgcacatccacacgtgctttaagtatccagggtaggggaaatacttgttcactgatttattagctgattacacatcactgtggaatttctgtcagtgtgtcatttcacattgacaaattttcacttagaattaatgacaattccatgttcataacctcctgagatacatgtatatttcttttatagtatccctacatctggtaatcaggttgtagaaaataaaatttgtcattggaatgatacttttggctaacagacatttctgatttatggtgtgcattcagtgaacaaatatgtaatggaaacatatatataaaacttcatgtattgtcagaaccagtaaacacagtgaagtgaactgagaccaatttaaaaat

SEQ ID NO: 113789 - DNA, 1002 bp, Homo sapiens
aaacatcagtgttaaattattcttttaactctccctggttttgttactactttcagaacttgttgaaagtaaaataattcccatgtgtgcctatgtgtttttagtttggcaaatattgttttttacagatcctccctgccctagccccgctctaatcccttcttcaaagtattcccagtggagataaattgtttcctggttttgcatcaacaaattccctgcagaataagtattcgtcaattgttaaagccagctctggcagtagatggagaggccgtggtgtttttctgatagaaactttaattccaaatttcattgttcctgctacttttcactaaatttaatccttttaaagatgttaattttaaaaatattgatcgtatattttaaattttatcatagaaaaggtttttttcaaattgccagtaatcagaaatggtgacaatactgtattattgtttgccatcttaatttctttatatttggaatcctgttgtgtttttaaaatttatttaactgacattgtgtctgactggctcgagagcacactgaagacttctgttctcttactgctgtcattttactttgaaagggccaagtattctagacagggacctcatagctgttctgacccattaagctctagaaacttaccagtttactcatctcagttgggatggactaattattctggaatctgatatacctgtctcaccagactactctggtatctaaagtatcttcctaatctgtgattgggaagagaagagtgaatagccgtggaactttctgttaagtagaaagatttttaaatggtaaagggagcacgtagttgaactgttcacaaatatatgtgccagtgtatcacatagtaatacatatgatacatatgaaagattatgtaaggtatatgtaagttatgaaacttgtttttttcctcacattatgtttctgattcatccctgttgtgagctgtggttcattcttactgaagtaaatact

SEQ ID NO: 113790 - DNA, 1073 bp, Homo sapiens
tggcttgtgtgttttcctctgtgcaccctataaaggttagacctttgatgcacccaaggtatcctgttagcttggggcagggattctctgtataatttatctttgtagcagcagtgatgaacactgcacataataagcacttgtcccaaatgtttcttgacttcacttatttaaagtgaatcccttgatggactttttttgtttttatataatttttaaaaattttttatggagacggagtctcaccatgttgcataggctggtttcaaactcctggcttcaagccatcctcccaccttggcttcccaaagtactggaattatgggtgtgaaccaccccccttcccccagccccttgaatggatattagactctagggcagtgctggcaaactcctaggtgggcgtgggtcactaaatgattgcaaagggggatgaatccagtgggacttcaaatatccattttagattgaatcatgtgtggcatgctaagatatcattttcaaatatttagaagtgctgtcatttatagcagtgaagattccataggttttatcatattttcctaatgttctcttgagagttgtgatatgcaagagatgctctttagcaccactgttctaaaatccttgaaattattgatcttgaaagagacttttctttgtcactaatgtttgcatttgctgtgttccccagttttatcactatgtattccatttaaaactatcagttaaaaatatgaatatattgtttttgtgatgttagcagtgaaggagagaaccagttgtaaaaggcccaaaatgtaaatgtccccaatgagccaaaaattgcttttttcataggctatttttgccaaggatttgaaatctcctttggatacatgtttgttttctcaagtcaggatatgggttttgtacatgtctatatctgtggttgagaaattctttaaatattcctggggtctcttttgctttccttgagtcagaaaaatttcattgtgttggtatggtacgttggtaaatttcaagaaagggaaagagaaatttattagtcctgctaacgtcattcattgggc

SEQ ID NO: 113791 - DNA, 1031 bp, Homo sapiens
tccttatacaccatccctcaaatatttggttagagatctcagaggagagtacattagttttgggggtttttggttttttttgtaagcgaataatctctgatagctttgaaatagtttcttttaggaggaaaaacctgaaaataaagtaatgactcctttattggaagtaaggtgttgtcatgggtgaatatatacctaactggagtttgttacgccaaataccagagccctttttaaatttctgtaatttttattaaatactttcttgaatacatcaagtattccttatattgattgaacagaaacgatttggcataaattaaccctctcctgatgatttagggttgccagtatgtatactcattattgcaccttgtcttaatacagactctggggttttctctgtcttctgtaaaggtcagttgttccttcttccactgttcttatgcttgcgtctatcagctcctcattgtaatttttttgtgagttgggaaatcagatagttaagcttactgtgaattctctgttatgtaagaaagggttattaaggagtttgagtctggtaactttttgggaagttgtatttggagggaggaatcatgattctttgcatattttagagagcaaagtctgttaagaagtctgactgctaaatactgtaaattatttattgaatatattgaaggtaccttgaatgaatcattgactcctaattacttaaagcaaaattttactcctggattacttttacttaacattttttattcttaaatgcttctttccattaatgaatcagttaattcatgtatttattgagtatgatgctacctagtttgcatacctgtatatgtatttcagcactagctttcaccagctataaaaaggcagtaatgctgctctaattcttaaattagtctttggctgtatctgcattttagattgagatggtggtgttcacttttggtccctggtctgcagctgcccttccctgtgagtgactgaatcttatccccaggctctcctggctccag

SEQ ID NO: 113792 - DNA, 1050 bp, Homo sapiens
tgtggccaatttttaaaaaagctactgacctaaagtcatttgctgctgttgtgtgcctttctgtatctccctttctaggggggtaaggaatggttaaatgagattagcatgggctttgatgatctcattaattacttagtttatgtattctgatctttcttgctcttttttttttttctttaaatcaggctccctcaaatttttcttcattataacattccatgtattttgcttttcactgctgtggaatggtagtgttatggtgaccaggaaaaccttgatatgtagacacgacaactgtgatgaaaagcagaatgcttttgatttatgaatttgcaactgaattataaatgtcaagtgactgtgaaagacaaaccaagtgggagtttaaattaatttcagaaacaaaatatactcttttatctatagcgtgatttgcattgtctggggggttcttcattcacttaccaaaggtacttatccacctacctctttcattcatattaagtgcactaaacaaaagagacaaactatgagtcacaacatttggttgttctgatgtcacgacattaagtagaataatggcattagtcagaatattgtttctcctagaagtggttatcagaagtgtgttgctatatatataatagctttattcattgtctcttctgttgtgtttaagggggctgtcagcaacatggcagccactgcttgatcatcttcccttatctgccagaggaacaggtgtctcttcctctttctaagggtaacatgtctctgctcatctcttctgttttcttgtcgttggtgggtcatatcatcctgcaacttcaatctctccactggattctgctctttaagctctgcaagttaactatttttacttttaagacacacacactcacccaacctaccctcaactctgctactccttcaagctaccatcacttttatcactttccttttataaccaatccttgaaaaatagtgtaggctcatccacatttcctcagactgactcacttcctttaacattgcagtcacctttct

SEQ ID NO: 113793 - DNA, 1051 bp, Homo sapiens
ggaaatctaaaaaacttttgggtatgggtgtggtatatgtctgtgagtctgtatgaaaaataaaatagaaagtgtactgatggatgattccatgctgcagtaggcagactaatgtgtcattccctttccctcccctcaagatgtttacatcctaatccccagagccgtgtgttattacatggcaaagagttaaggttgctaatcagctgacctggagaggagatgatgatcctgggttatttggatgagtccagtgtaatcactggggcttttagaagtggaatagcgaggcagaagacaaggtccgagtgatgttatgtgatgaggaactcaacctcctgttgaagatggaggaaggggccccaaggcaagtgatgcaggcagcctctggaagctggaaaaggcaagaaaacagatttttcccctagaacctccagaaaaaaaacacagcgctgccaacaccttgattttagctcagagagacccattttgtactctgacctccagaactgcaagataacaaatttgtgttatcttaagccatgaagtttgtgctaatttgttacagcagctgtgggaaacacatgtctactgaaatgtgtttagatggtctacttgtgtttgaagactatctgcctgtgtaggcaatattttctagtgcagatttttaattcttgcagaaggtatacatttagaatatgtacttaatatatattctattcaatgatggtctgctcactgttcctggaaacagctgaaaaagtagaatagggaggtaactacgtgaacaaaaatagtagttaaaaatgcgttatgttgcttttataggaaatgaaatccttaataaaattcagttcaggcatttgggattctgaatcacttcatgactgtgatttgtagagttcccttcattcgctcttgtgacattattttgaaaaatttctcttcctgaattgaaaaatgcaataaactctgttctcgtgtccagggatggtacatcttcctgtgggaaattccactgtctatcccgtagccctttgacattcctctt

SEQ ID NO: 113794 - DNA, 1005 bp, Homo sapiens
tagacagtcacaccctcaggcctgcctatctttttctactttctcctttaggcacgtagtgaattttttggccattaagcatgacctcttcagtgtctgtggagcagaacaaagtgacagaatacagatgagcggggttgcacatactcctagctcagtttgatacttcagtgataatatctatatagcacaccgaggtggaaatattaaaatatgctggggaaaatttgtgttctctagttaactcccccttttttgggtaatcttatttttggaaatctgagctctctttatgaaatacgtgtctcatgcttcaatttggaataaactgtagctgagtcttatttcaaatattctgaaataatttgatttcaaagtaaaacttgacgaagtaacaccttgcatagtaatatacaatttgcatgaatgactttgccaacttcagacacatggttcagaggggccagtgaaagtatcatctgggcttctgtagtagttttatacccatcacatcttcaattgctctgacttaaagtggatatgacacccctggcagactgtgttttcctgtttgacttaagcaattgatatttgaacaggtgaatgagcatagatgtttatgattgtcttgcctgcctttgattaaaaactaatgtgaccacttttcagtacatttggttttattggaagaatctattgaaggtggtcttgtacggatactcccctgttgcccttcctttggtttctggtaacattaaaaattacttacaaattacatttcactttatagaatatcctgcagttacaaggttacagtctttattactgacctaccaccgccatacggatttttctatcagctgaacttgctgtatttctggccatattatttgtagcagaaactgaggtttactatcattgctatatttataggtggattatccggttttctccaagtaggcaagaatgggatcttgaggacagttagttgatgatgttagacca

SEQ ID NO: 113795 - DNA, 1025 bp, Homo sapiens
cttcaactgaaaaatacacttagttggcacaaacacatgtatgatcaaaggtgatctgaataaaatatagttttgattgatgaatatgcaaggcttttctttaatgtttgaaggaagaatgatatcacagttttgttaataaaatagaggttaaagaatggaattgtttctagtaggctgcgcagccctaaatcagtcaaaagtaatgaagcagttttctgaaacagattgggtttccttacgaaggaagccacctttgttccatgtcactgatgcattccttataggtgaggtcactctgcattgctgatatcttcctcctttcataaaagggagatggggaccgctcccagtgcattccatttctcacaatccttaaaataaggcttaaatgtacctgtccattaaaagcttttgaaggacgaaagccaacctcagaggctttgtgaaccatgaattgacaatgaaagacagtatgcttctgtttttcggatagcctgtttaaggacaaaagaactattcagtcttacatgactttcatttagttataataaaagggatgaggatggtcatcttgttttgtgcacgattttaaggctgcttgactgagattatctgaaacaatactcttcagttattctgactaacaaagtcactgagaggaatgtgtgttacagcgtgtatacatgactttacgtgtatttgtttagatataatgaaatttaaaaagtagtttcctaccttccaccctccctgtaaaacctaaagggtgaaagcattttgaggatatcaggttaagctctatgtattgacatagtctcctaactaaccttctgtccacttgtgtctcccagagtagctcccttgaacctcagttagtgtgacatgtcactcttgctcaaaactatgttatataatggtccattagacttcagtcgcataactgagtcctgcccttttcctccaccttatctcctcagcttaagtattctgctccagccatacagactttcttgctgtttatc

SEQ ID NO: 113796 - DNA, 1034 bp, Homo sapiens
ctagaattatccacctctgttctgccagattattatcttcatctaaagttgttacactgcttgaaattccaacaattagagattgtctgcatattaaaatgtcctgcactttagaaccatatttagaattacctaaccatatttcttttctcagtttttactgatgtgagaacccctactttgatggacagggcatttattatgctgaaagagcggggaggcaggtaactgagctgctttgaggtcaggcaagcctggatgggggaagctgtagtgaggggtttagacagagcgaccatgtcgtttatcctctaccctgggacatttttgagagtgaaaaggatgttgttgataattttgcagagtcaacaggagtaagtcaggactgtctgaggcgaacagggccataagtttaccctagctgagagcagtgtgaatgagcacaggatatagaaaacaggattcattaagcataggggagatgccagagagtacagaacttttcaaaagtgttcaggggaaatgcagaggaattaatttcttcctctgaatgttccttttttgtgtgctctgtgattcctgctggacagaaagtgtctggtaataggaaaagcaggagatttattatcaggcagaacttcctctgttccttgttatctgtgtggctcttgggcaagttacttccttacctaatttcttcatttgtagaatgatgaagagctgctttccaagtttgtgaggattacatgagataaggaatctcaaatgcccaagacctagtacatgctcagtaaacattagtatcttcagttttccctctttctagaaattagaacttttaataccatatcacagttatattgtaaaataaactctggggcaagtggattggctcacatctgtaatcccagtgctttgggaggccaaggtgggaggatcagttgtggccaggagtttgagaccagcctgagcaacatagtcggatccccatcccccttctaaattttttttttaaattagctgggcatggtggc

SEQ ID NO: 113797 - DNA, 1038 bp, Homo sapiens
cttaaggattaaggaaattattattattattattttttgccagaaaaaactgcttatcaattcaggaatgaatgaacaggagtgaattttcattattttaatatgtaatgagtggtcctaggcaatcaacatttatacagaaagaaagctaaagttagctataggatgcttcatatctagttttaatttatgtgaagtaccccaaaataataccgtagcaatgtaagtaagagtgtcagtgtgggatacaaatatccctagcatttgtataaagttcctggaaatgtgagcagtaatgttgaaaagctgaacattagatatgttataaggagattcaattcttgtagagctaaaaaatattcttacattcctaattatataactgcttagtttttaaatatccttaaaaaactttaaaagtttttaaaaacaaacacatagaataaacattatataataaaactagatttcagaccttaagttttcatttgcccaccttatccagagtgacatttagtttactaatctctattatttcagtttttttcaaaatctttgaacagttttttccccattattgaacttgtgttttatgcacagtgatgattatttttcagcatttcatatgctttttttctgccacagttgaagtctgaggctaaatatttttgccatctttggtagatcgtattattttcattcctgtcttaactgtactatagtagcacttttatttttcttttttctactcatttttgtaaaacaagtctgaaatattaagaagacactggaagtgttaacactgttgtacaaagcctgtgatgttgctgaagctgaagtgttggttaaaggccccaaagtgtgacagcttgaaatgtttacatagcagctgttccaagaaagttcaaatctggcagcagaaaagtactgggtctccatatatgaagcatgaaaatatatgatgtgtggaagctgagaatcacctatatggtggaaagaatgaggagacctgctttctagtcctggctatgtgatttg

SEQ ID NO: 113798 - DNA, 1093 bp, Homo sapiens
gctggataggtaatggtagacaaaccattcttagcttttgaatgtgtagtccatcttgtgggagagacacattaggttttgaatgtatagtccatcttgtgggagagacacattaagaaaataataacaatgcaggcatgtaattaagtaagttctaagacacaaagctaggggagaggatagaagaaagacctgcatttagcgtgagggtgaattgtgtgtgtgatcttcaaaagcttcctgaggaagaggcatctgagctgagatcttaagggtgaaatgatattaattagggaatgggggctgggcagggaaggggcagaggcgaagaatatttcaaaggggctgacctaaacaggaagggatgtgcctcctaggaagaactgacagaaggtaagtgtgaactaggcaagccacagggatggtgtaagatgaggcctcaaatttgataatgtagaaggcatcaagaactgccccaagggccacgtagggtgaagggtcagatgggtaggatagataggaagtgctctgcatttgggataagaaagagggaccattgggactgagacgattagcagggcttcagaacagatacgggattggagcttgtgtcaaagaatggagagatcgggaaagaaaggtagggaattctagatatgagggaacacacatgaaatttattttcccctgtaaatgctgtgtctgctttcatttctccatagcacagtcatacctcctttctccctctttccctgttgctgactgttaggggctgaattatgtcccccaacattgctacgttgaagttctaactcctagtacctcacaatgtggccatatttggggataggacctttaaagagggggttaaggtaaaatgaggtcacatgcatgggccctaatccagtaagaccagtgttcttataagaagaggagatgaggatgcagacacatagggaagaccatgtgaagacacatggagaagatgccacttaccaaccaaggagagttgccttcaaaggaagccaaccccactgacaccttgatcttggacttccagcctccagaactgtgaggaaatacatttttgttg

SEQ ID NO: 113799 - DNA, 1032 bp, Homo sapiens
agccttataactgggataaaatagttgaggtggatggaacaggaaatatgtctgttactttgctgggggaggatggaggacaaaaacaaacctattcagtagtctgagttgatgcaattgatgcaatacttagaaaaagaacagccttttttctagtttaaaatagtttttcgagccaggtactgtggcactcgcctctagcccctagctacttgcatcttcagtcctagctactccagaggctggggccggaggatcacttgagcccaggagttcaagtctagcctagacaacatagcaagacccctccccctgctacccctcccccatcccctgccccccaccccccttttttaaaaaaaagctttctcagtaagttactagtaccttttgctttcaaatattcagaacagtcagggccatacatatagttcaaacacctgaaaggtcaatacatttctagaaaagactccttttaagagtgagaattctgtaacatgaagccacatggatattgtaaggcacttctttggacgcttcccttaggtgagtgactgtaataaatcccaaatgtgcatcctcctcccttaagtgttctgacacaaccaagtggtgcagtgagcctgtttccatatgttgtgcaaagctgaaagtgataacgtggaatgttgcttcagtttattagttatgttctgtgtttggttaggctgtgaccatgtggcctcctcatgcgtttagccaaagtatattgaatgttatcaacagatttgaacatttccaatgtgtgacgcacatcttgttcccaaaattttagtgtttcctgcctaatttgaaggagaaaaggagagtgtgggattggaatcaccatgggaatccatcagttttttacctctaagtaaagaattcctgttggttttaggccaaagtcaagcagtggaatgagccatagggagagggacactgctgatacctgtctatggcctaagaaatgtagctgcagaagttaaaatgcatatatataaattagataag

SEQ ID NO: 113800 - DNA, 1012 bp, Homo sapiens
ttgcaaaaataaaaagtagtcaagagcatcagtaattaaaacaacttcatttttgtaagaagaaggaattctaaattattggccaaactggtaaaatctgcttttaaagaacaattaatctagatgagaatatttttttcaaatgtcttcagtaagcactcaaaagtgatgtctttcatttaatacaggaactgcccattgggatagcattagttcccataattcgcagatgtggataccaggcagttttaacagaatagttttcctactactttctcaggctcatcttttgtaaatgataggaagtatttaagtatatagaccattttaatcactggaaaacctgatcagaaaacagtttcatcattaaggctgtcaggtttcttttgacatatttatttatttaaagatagtgagaactctgggatagggaggttttcttttccttatttggagcccacatgttgtgaaactgatctgcttacagtgcttttcttagatttcctttattttatggagtttacttatttggactcgaatattttaatcccagaaccagtgatcaagttgataatttctgagacacctgatgtaggtctgtttagcttaataaaggtgtagatttgcatctttggaaaggttttgtttccctgttaattagactagggaaggcatggcttcctggaatactgtatcttagttgttgacactgccttacctgttgtgaggaatgcattgaatgtttgttcactgataaagaggaatttaaggagaggctcaaacactcaacttaatgtcttttgaattttaagttttcttgctaacatggaaattgactatgtaattctcatttatctgaactgctaagctcccaaaattgaacttcataggtaaattatttggagattttgatcatgttagtattatttttctggtttatatgcttttcctaatttacttcatgtttcttctttagcatgagaaaaattacttgccaagaaactcaactaaa

SEQ ID NO: 113801 - DNA, 1008 bp, Homo sapiens
tgtgtttcagagtttatcaactactgccctgaagggcgcttttctgttttagctgctttcaagcaaatctgtgtcttttagaattgtcaaccttcagctctttttggttgggcaaaattaaacagttctatttttaataacagcgaagaaacatatgtatttaatattgggatcatttaccacgagcgattacatgaggcatggtttcttaaacgctaaagtggcttaaaaaagggaatttagttggatataaaagtaaatttcaggtagaggaaactttcaatggcctctgtcagcttctcctatgagttgaagactttattaaggcagctgataccactttcagagcttaagaaattatgttccttattgcacttcataaatccttctgcgggaattatgtaatactctgtgccttgtgtttgcccagtgaatccctagatatctttaggggttaattttgcgttgtttagaaagcctgttttgttttcagttgttgactttggagtttaggaacccacattccaaagcaaagctacactattcagacagggaatagtgtacttttgggtactttttgattcttggctcctttgaactttttccctagataacaacactcatgttctcttttcccccttttccccatgactctagagcaaagtctgaaatggatgttacatgagtcattttaagggatgcacacaactatgaacatttctgaagattttttctcagtaaagtagataaagatggatgaatcagccttgttggatcttttggagtgtccggtgtgtctagagcgccttgatgcttctgcgaaggtcttgccttgccagcatacgttttgcaagcgatgtttgctggggatcgtaggttctcgaaatgaactcagatgtcccgagtgcaggactcttgttggctcgggtgtcgaggagcttcccagtaacatcttgctggtcagacttctggatggcatcaaacagaggccttggaaacctggtcctg

SEQ ID NO: 113802 - DNA, 1051 bp, Homo sapiens
aagtccttttacaatcagtgtgtctcctgaactagcacacaggctgtagaaacagtcttagaaatcattgaaagatttgattatgaaagaatagcaaaattatatttcttgacatataaaaagttggtttaatgcctttatttctctttaaggaccagaaccaggaatactatatcgaaaaattagtctgtggatttaacactgacttagcatatagcttaaagttgctcttttggtttttaacttcctccatacataagcttcaaggacaataagatgttaaaaaggaggaaataattatttttattttgacactgtgacagttttggtaactaggatcctagggagggaaatgtttgcctgttgaacttctttctgttatgagaggatttagttaggtcattaagatgttgatcacacagcttcaatcacaatatgccaagtataacctggtttcgttagaggtgtctacagtccagatgttcttcgtaataaaagcaaagtttttgaacctctgagtccaaagcaggctggttggcataatatgtaatttgaaaaataaaatcttatcttgcagcactatcagtatgttgaatttattatgtatattatttctaatatccgaaactaaatacttgattttttaatatgtgtgtttattttatgatattgctattaaatttttattatctacctgaagtatatcaattgtcttttatttattattttacttttctcaatagaaggcttttacatcaagctgataatacttttgttggttttgtacctgatgatttctttcttcataatggaagaaaatgaattcaatattttaattctttacaatcctgaaagatgggcatgattttggggaggttgtgtattaattcttaaactattacaactattagaaaagggtataatatggtagaaaaaaattgttttagccatatttcaaaagatgttatatatgtgcaggaataaggatgatcaataagatttgtgccatctccagtcgattagcagtgtgtgactctggagtgttgttatg

SEQ ID NO: 113803 - DNA, 1040 bp, Homo sapiens
cttattcacaaggtagaattgacaccctcttttgacaactgagtggcttcaaaaggatataagcctacacagaaggccatttcccctgcaaaggaccaagaatcaggctaggttaatacaccactcaggaagcaatatcagattttctctagtacacaaatggaaagggaaagagaaccccagagttctgtatcataaagcctgacagtaattccttcaccctagaaaaaatgtaaagcaattgaagatgcctaccctggcaatcttttctaaaactcttagtacataccattacagcaggtgtagcttaaaaaaaaattgagtacagcccataaaatattgtaacttgctactatagctactaaagaaactggttataaaatggatattgaattatgtggatgacttgctgttttgtattgttaatcatgagagttaaatgaaatgactagatatagatttcatattcattgattcagaataaccgttttgcactccttcttattggaagtcagtagagcccatatatagctgttctttttgatttggggagttttttgttgggatttttttttttctatggagacagggccttgctctgtcacccaggttggagtgcagtggcatgatctcaactcactgcaacctccgcctcctgggctcaagcagtcctcccacttcagcctcctgagtaactggtactactggcgtgagctaccatgcctgactcatttttgtatttttttggcagagatggcatttcgccatgttgatctcaaactcctggcctgaagctgtcctcccacctcagcttcccaaagtgttaggattacaggtgtgacccaccgcacccagcctacctgtcttagagatagttgtccagacagctatcttttaggccacatctaggagatggtaaagccatgtcatctacatatggtacttacacacttttattttctgtgttggggaaaagggagagtaaagaagggaaggggtaagcaaaattttatctcgctcacccgaaagtgacatcaagt

SEQ ID NO: 113804 - DNA, 1045 bp, Homo sapiens
tgtattcttctctaaagaacaactgtttctttaaaagtacaaactggttaagcctgtttggttgtcctcacaagtggatacaggatgaatttgtggagttgcccacaaattctcactctgagtcaagctattgtaaggcagattcatttagtcaacaaatatttattaaatatctgctatgtgccaggtaccactctaaatgctagagttaacagtagtgaggaaaacagacaaaaatcctctgctcatggagccattctaattggagaatataaatgataaaatacatgatcataaataattggaaaaattgaagcaaggctagtgaagaaagtttgtgtacatgagccccatttctcctccttatctggagcctgctagtcaggtatgaaggtattcctcagaggttactcctggctgggatacatgccttcataatgcagtgaatggtctgtaggccaacataggtttgtaaagattcaaatcaaaactttgcatttgttgtgattttataaagggaaattatcaatatatttttccaatggaatttttaaaaatagtaacattttcaagatttgattaatttataatcccatgaaatctgaagtaggttgagatagagaattacctgctaactccacttcatttgcagccagttaaaatgacataaaagtcagtcatggcggtgtgcagtgactcacgcctgtaatctcagcactgtgggaggccgaggcaggtggaacacctgaggtcaggagtttgagaccagcctggccaacatggtgaaaccccatctctactaaaaatacaaaattagccaggtgtggcggcacatgcctgtaatcccagctactctggaggctgaggcccgaaagtcgcttgaacccaggaggcagaggctgcagtgagccgagattgcatcattgcactccagcctgggcagcaagagcgagacaccatctcaaaaataaaatataagtcagtcagtcatgaccactgagactaaaaaaaaaaaaaaaatagagtcagataaagatcataatat

SEQ ID NO: 113805 - DNA, 1031 bp, Homo sapiens
aatgagtaatgttattgatttgtatacatttatgtttctgtgttttacaaatgagattgggcatttttttttattttagcctgtaaaagaatcaactgcctgaattctttagtccttaactattttttaaatatgtcattttggccaggcatgctggctcatacctagaatcccagcactttgggaagctggggtgggcggatcatttgagctcaggagctcgagaccagcctggccaacatggcaaaaccccatctctactaaaaatacaaaaattagctgggcgtggtcgtgtgggcctgtaatcccagctatttgggaggctgaggcaagagaatcacttgaacccgggaggtggaggttgcagtgagccaagattgcaatattgcactccagcctgggtgacagagtgagtctctgtctcaaataaataataaatagtcactttgattttcaatttaattttccaactgggtatactttcattttgtggagtattttcttatgcttatcttaaatttagagattattaaatttcctcatgtatctaatatcagtcttttgaaaggtgtgaactaccaaaaccaatttatgatcttcagagttagagagaaaggcctatagataaggactatcatacaattcatgtacttttcttgtagtaaagatgtatagccatctttagctcagagcttcttaatacctattgccatctataaagttaatattctttgcataatacatttgattgtttgattttcttttatgaccttaagagttctatagaagaacttactctggaagtaaccacagcaaattagaagcagcaatgcagatttcatgtagaggagtatgaggaaaagaggcaagaaaaaacactagaaaatcaaagcagtctgtagccatttaggaaaagaacacaaaaccatccctgcccgttctataaatatttatataatctgtttactaaggtgggataatttaaccttttataagcatgtttaaaactcttttttgcaaatgttaagtta

SEQ ID NO: 113806 - DNA, 1144 bp, Homo sapiens
gcagtaatgcagctttttgaactttgcccccaatgccattacagataaaatgcatcattttgagaactagcatgattttttattttttgttttcacagagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaaggtatgttctaatgagtcaaaatgagctatatttgatttagtaaaaacttaaatttcacaagctttataaacagattatcaaaatttgtatatgtttgggtaattatctcaaattaggttcagtatttttatatttttagctattggtcttttttttatgactgcctaacaagtcaccccaaaacttagtgttgaaacaccaaccgtttcataccatgattttatgtgccaggaattgagtcaagacttgtctaatgtgatttttcctaattcgtgtgcctttatctcagagatcagtaagtgttggtcagccggcagctaggctggtctgaagggtcccaaaaagcttcactgctatcttggcaagtacagcttagctgggcccctctccctctttatgtggtttcagggctattctatgtactctttctggcaggatagtctgacttcttatgtgatggcccggggctcacagatgctaaggtgaaagcagcttgtactcttaaaagctgatctcagaactagcacagtatcacttctgccgtattctattagtcaaagcagtcacagcccaacctggattcaaagggagggcaaacagaacccacctctcaatgggaagggcgtcaaagaatttgcatctgtcctaaatctgccatagtctgccctctgaccaaaaattatcttcattcctcccatatgcaaaatacactcacaccttctgaaagcctcatctcattatgacattagctcagagtttaatatgataacaaagtcaggccgtgcagatgggttttctcatctacaggtctttgagtacagttattctcaatctgaagacctatgagtaaaaaaaaaaattagttattt

SEQ ID NO: 113807 - DNA, 1050 bp, Homo sapiens
cttaaaaaacaaacaaatgaatttcatgtttagactttggtcccatcaacaagattctcgttatgtatatgcacatatttcaaagtctgaaaaaaattcaaaatccaaaacacttctggccccaagcatttcagataagagatactcagtctgtattaatttatggttttttcctatttttatattccccaaaactagaatttaattcatattctacaaggcaattgtagatatatttttattgctagtttcatttgcttctgttcttgccattattcatcattctttccctgaaagtctttgtgatataacctttttttctcatgaaccactcaattggataaaagactcaaaatctgccttaccatgcagtattattatactgttattgaaaattgtttctttgtatatttttcttataggacatacagtgggagaagttattaaattaggtcctaatggatctccaagaagagcctgggggaaaagtccgacagattctgttctaaagatacttggagaagctgaactacaacttcagacagaactattagaaaatacaactattagaagtggtaaggagaaactggtagtttttctatactagaagtaatattattaaaaatctaattatgtattttaagatgtttccattttaagtgaattatttttaattatctttctcttataataattttttaattagattgagaatgattgtgttttctagggggattgtccaaatggtagtcttgagttttgacctgatagacctggatgggatctaaaaggaaaatgaagtgtgtatgggtggagttggaaaagtcagaatgatgttttacatgaaaacagatataggagaaatgcactgagatgaattgtgtctgttttgatatggattcaagaatgagattgactaaaaggtattttagtaggtatgacagacattattaattctaggactggggaaggagagttgtcatgaggcaggaggaaatattcctgatccataagttttgtggcctttggtattacagctatgcatcaaga

SEQ ID NO: 113808 - DNA, 1048 bp, Homo sapiens
tttttgtatttctataaatattcttgacctttattcttggacacaatttagttacctgtgcatagcttggctctttcaagtcttgcttttaagctttgttagttggaacaaagcagcaatctatattattagtatttattagtattactgtgcattagcgtactgctaatcttttaccttttctgcatcaacaacctttctgaataatctgccttgtgccttgtgaattataaatcagtcttttttggctgatgggaataggaactctttctggcactgtgtgaactcgaagtattgttacctctgcttcttttgagtggtcttttctctaaactttctctaaaatttctttatacattatgtactgatatgctgatcagtactcaagtaaagactcaaaggggctttttacaattttcctgagttctctctctgtgaaacgtattacttcagtactcctatcttgcaaacactagccactttggcctccctagactcccatttccacctcctcagctcagagagaccattgactccacctctgttttccctccctgcattgaaggggttaaattccagtggtgggggggacaggagggtttctcttatgaacatttagttatcccagttttgtttgttagaactttttccccttttgaatttctttggcatatttgtcaaacatcaaatgactgtaagttatgggtctatttctgggttctctactctattttaaccatcctttaagaaattcctcttggtaatcattttggctgtatgaaactaattattatctgctaatttgcatgtactttcatggaactggtacattaactgtatcaatatgtattaggttaccattgaatgtctatataccttatgcctcataatacataatattatatcctgtatgttactactaggtacctgtatacttcatatattattaccaaatattctaaagactcaaacttcagtatataatttttatatattgctttgataaatgttattaaaatggtttaccccaaattattattgtcaataa

SEQ ID NO: 113809 - DNA, 1026 bp, Homo sapiens
ttaactgatacccgggaaacttcagaagagatgcaaaagaccaacaatgctatttcagtaagtaaaattttcaaagtttatcaatcattttacttaatgatatacatattaaaatatataatgtcgtgactttcagagtaagcgagaaatacttcgtagattaaatgaaaatcttaaagctcaagaagatgaaaaaggaaagcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagtatgtatagtagtatattaatatcctatttaggtctagtacatatgtaaacttatagactaaccactctgaaaaaaatgaacacttagaagaattgagagaagctgaaagaattctatatattttccttttgggcgaatagaagtgcctccctctcacagtgaaatgtgaagagcagagaaaactaatcaaactaatcagccttaatagcaaggatttttattacaaaagtgtatagtgtgagagagggaactaatgatacatatttaaattgcattactttaactctgtataccatgttaaattaatctgttactatgaataattcttgatgagaaccagggtagtgtctcagaaacatctcttaggcatttagcgagagtattgagaaaatctgacttaatgatttatatattcggtgataattactgagaatctatatttcttacattgttctaggaattggagatataggaacaaaacagaaacatatgtgctcttgtggagcttacattctagaagggcaagtctgaccatcaacaaatctgattttaagtaatttttttcacagactgtttttgtagaattttttcttgcattggaaaaaagcccaaagacttgatagcatttattttgcttatttattcaacagttctttatt

SEQ ID NO: 113810 - DNA, 1051 bp, Homo sapiens
gactgtgctttgtttgttttgttttgttttgaaacagggtcttgctctgtcactcaggctggagtgccgtggtgtgaacatggctctctgcaatttcgacctgctgggctcaagggatcctcctgcctcagcctgtctatagctgggacccttagcacacgtcaccatacataagctaatgttcttatttgttgtacaaatggagtctcactggtctggtgagactccatttctacaagaaaaaagaaaattaactgggtctcaaactcctgggctcaagtgctcctcctgcctcagcctcctgagtgctgggattataggtgtgagccattgcacccagtgaaaaagtatgtttagaatgaaatatatattatagatttagctgggtgatcaattgtataataaaattgggtcattctttgttccaaatttttatatttttctcttatatgaaactttatattgttttcctggcttagttaatttttgtgatatgtcatatttgctcaactttccgtataaaaggcttagtgtaatggtttatctttcaataattagaagtacattatcatcttttatctcaagatgtagttaatattgaaaagctttaaggttctgattataaataatacaccatgatatttatacagaaggcccaattcaactgtactaataagttacttaagtgtatgacattagcttataatgatgttgccacatttcagtagtcatcctgaaccacccataaattttcagtaacttagttgtcttcttaagttattgtaagagttagtaatctgtctttgttcatttatttagattccatgtctgaatttgtctgtttaggttcttctaatctgtttggtttagttgactcagaggagagatcagtatgcatttgattatagaacataagcatttactgaaggctgctgaagatcattattataaaagtgccaataaatttgtctctcacaatgctcaaattttaatttctgatcatggttaagataggaggtttttgtttttagtctgcattctaaagatgaga

SEQ ID NO: 113811 - DNA, 1018 bp, Homo sapiens
atgcagagaaggaaatttggaagacagtaccctcaaattttaagtttctcagatggcagaattataaatgattcacattttctttattttttaataaattttctataatgagtatgtattatgttatgacagaaaaaaatgcatatataaattaagtggattcagtcaaaactaatttccagtggaaatgttaaatgcaaaaatcactcagaagggctcatttcagttgtgaagtagaaagtcattggtgaccttagaaaattttcagtcataatgggatcagaaactagattgtagtgagctaaaaaatgactgggaagcaggaaaattgagatgatgaataaaaaaaatacacattcaataagccaataaaaagacatttgacaggaaagtgggactaaagagttttttttaagggagtaagtcgaagcatgctcgtatgctgaaggaagagaaatatataaactatgttcaaaaatgagtccatttttgattgggtttgaacatttgctgtatagtaactgaacatgcctgagtgcacagagtttgattgagatctcttaattaatatacaacccatttgttgaattcagaaaaagtgatctcaaatatcttattttgtatgtgtttagtatatatatagacatatgtcgaaatggattggctgtttgtagaggaaaatttggtttggggtttaacctccaaagcagtgatttaaaacaaacaaacaaacaagcaaacaaaaaaaacccctcttaagtgactaacacaaagatagctggtctctgttttgaataattatgtttggggcttaattgcttccttctgttctcactaaatatatatttcaagttgacataggaaaacgccagggtttgttatcacagtttatcatcaataaatggtcagtatttgccaaaagaaataaagtagcacctggatattccttggtaagataataatgtagccttagtcattctttaaacttagtacattaaatgataaacagggaatcctg

SEQ ID NO: 113812 - DNA, 1024 bp, Homo sapiens
tcttccgtaattaagtgtatctaaaataattgtatatgtttaaataagtagaatagatcaaataaatataaaagaaactatcttgtgaagacttagagtagaattatagattttacttgtattgaaaataataaagaatgtgatttaggtagtagatgtcaatatatatatagtgatttcttcattacagagatagtgtttcatcagccttcatattctgaaatgaaaaaaaaatttaggataaatgtaatttttaactttttagaatattttctgttcaggatggctgactttgtgatttgtccaaattaggcaaaaagggcagctagctgtagaaagagctaaacaagtagaagagttcctgcagcgaaaacgggaagctatgcagaataaagctcgagccgaaggacatatggtatgaattttgtttgtttctgagattttgaatgtattagtattccaagtgaaggtctggaataaggtaagtgtaagtaaaaagaatgacagtctaacaatctaggcataataagaggcagtaaagatactcagaagtcatttgcagagtataaaattgtgatatcttaactcatttaccttctcttttgctatcttttataccaggggtggaattctattgttgctttggttaattgggagtaagttcatacctgtatccttcctttaaaagagtagaaatgggtatagcaacccagataaagaaataagttcttggattgctgcatgttttttttccccaatatgcttttggttttacatacttttaagtggcaaagaattttagaagaaaaatgggaaataagtatttgggtaagtatatatgtaaactatgcatttgctcaaaagcaaattagaagtagaattttagtaaagtctccagttatgccatttaactaaattaagttatgtatccaagaaaatattaagtttttaggtaatcatttcaatcattaaaactctgttttctctttggtatttaacaggatttgaggtagttaaaactctt

SEQ ID NO: 113813 - DNA, 1203 bp, Homo sapiens
aagtatactgctttttggttgttaatagttataataggaaaacattttgctttaggctttatgtttgttagtatgttcatattaagtaattactttttaaaagtgaagcattgaaatttactttttcttttgagactagtacaggcctgttaggccttataagataaacatgtgagagctctttgtttaatccctaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggtatggctatgttctgcagaagttgcttatgctttgcttctgagatagtaatgaaagtcactgtgcatatttatctacagaggaattctgcctggagttcgtccaggatttccttatggggctgcaggtcatcaccattttcctgatgctgatgatattagaaaaactttgaaaagattgaaggcggtgtctaaacaagccaatgcaaacaggttggactgtgatgatccatgaattcatccatgtgtgtaattttgtcgtttgtcatacatagcttagtacctacactttgtggatgttttctccattgttcacatatgatgttttttgcctcttgggtacaataattttctgaggtgcaaatttggcccttgattactctgaaagcatgtagctttccagttcagcctgatttttgtgtcttgtttgtgggtttagactgaatatactatttaaaggaacatgtgataacattctgccaacataattataacattttatcacccacttcctttaaataaatcaggatataaatctaaattgaatcacactttatgcagaaccccagtgcatttttcgcccttttcttcatcacttcaaagcctacttttctctttgttgtcttagcatgctttctcttcaccttcatctctgatttataactctttgtgatcctgttcatcatattatttcttttcttccattgaattaataatggtaactgattaatatgtacttgagcagagataaatgattgaggtaaatataaattaacgtttatatacacattataaattatatacagaagcctgatatatgaagcatctattttttgagaaagg

SEQ ID NO: 113814 - DNA, 1498 bp, Homo sapiens
gctttcttcggtggagctccgagggtagctaggttctaggtttgaaacagatgcagaatccaaaggcagcgcaaaaaacagccaccgattttgctatgtctctgagctgcgaggtgagttgcattgtatgagcgaagagttgtcagctctcctgttcacagattttgggtcaactgtgaggccacagcgctcatcttggtttctcttacaatgtacctacataatgttgaaaggtacatcgtgaattgggatgctaacccatcctgattaggtatataccctcagacattctttaaaatttcacacatctgcttcaggaaccgtcgaaggacctctgaataaaatggaagtgggttccaggagaagattaactttaaacttagaggagtgggttttactttcgctaaattttccccaatttaaaaataatattcagtttttctatctttagatatatatgtatgtaaaatattttttgtgtatatatatttgtggtttgatcttaaacttgaccagaaactgccttagaatctcagaaattgactttgcatgtggtatgctttgtttgtatggcattttaaaactgcggagcatatagaagataattacatatgcattgtgcatattagaaactgagatttctgtttcctttagaaagaaattcctgttcatggaattgaatcaacagcgaccataccttttacacagatatataattcaaaagttcagttctacaaacgtaaacttttggagctatgcagttcagttactgcagcatcattgtggcttgtataattgttgaatctttccagaaatgcttttactttcatctttaaagagttaatttagaagatttttttttatgaggtcggtatggaaataactgcgtccctttgtgagtcactacaaaataatatttgttcagttcaggagtacatatgggagttaaagtgcttgtgtataaattgttgactttcatcttaaaaggtgctgctgctattcagtgtcttgttctataatatggctttaaaaaccatgtgtgtgacctacagatattttctcaacttgaatatgcgtatatggcctctggttaatacagacagccactgttggcagaattcatcacagattgcatacccttcccaccccttactcccctcagcacctcgaaaactttgctgctttacttgaatgatgagtcacattattttaagaagtcaatatgaatgtatagtacctacatttttacttggaaattgtacttcagtatgtgttatcagtcatacatagctcattaagaatgtaaatatttaaactacttttggatagatgtggttcaggggaacagatttgttgatgttgtgggtttgtgttagtaaattggctattttccaggtcatgttagtggtaggctttccatttcctgttgtgacatgttggtcataattttcagacggctcaggaagccagatttgatctctgtggtgggtcttatatc

SEQ ID NO: 113815 - DNA, 1248 bp, Homo sapiens
tcttactactctaataaacattttaattttttaaatatgcacattcacatctgtacataaacattgtagctgtgattcattttggttcttaaagataaatcttcagtgaagtttaatatggagattgaaccccactgcctcactttcattgttgaaatccagagagatttgatctgcaactttgactggaaccaagttaaataaatatatttcttgctatttcttgtgagaaataatcgaacagtttctgtcttttaaaatcatgaagactatttagttttcaaagtttctgtcttccacagcaactttttattggtttattgttttatctttcttccttgttataatctgagtgttatatttgtatgtgtgtttattccgttgtcctcttgaaagcctctagcatttatacccgctgcccctgaggaatttgggtttttttgtctgtttttatttatttttaattgacagataatcattgtgtatatttatggggttcaatgtgatgttttgataaatgtatattttgtagaaaggttaaatcaagcaaattaacacgtccatcatatcacctacttgccatttgtttgtggtgagaacgtttaaaattaacttttagcaattttgaggtatatagtacattattattaattatagtcaccgtggcatgcaatagatctctaaaacttactcctctaactgaaacttggtattctttgactaacctctctcctttcctttttcccccttctccctagcctttgtagaccaccattctgctctctgcctccctgagtttgacttttttttttagattttacacatatgtgagatcatgcagtatttgtttttttgtgtcttatttatttcacttagcattatgtcctccgggttaatctacgtttttgaaaatgacataattttcttccttttaaaggctgtatggtattccattctgtatatatattacattttctttatccattcatcatagatccttttagatatctctaatatcgaccttaaatgcagaagatgaatcactgtattggaagaaagaaaagtaatcctataaaatcagtttaaaattaggtcagtatagcaaggattagatatgttgattttactttgggtactctgagaacttgatttaaactgaaccttgcccagtgctaatgtaatcagtagaccacactaattcctatggtatagtagtgactttttttttgagatagactcttgttctgt

SEQ ID NO: 113816 - DNA, 1102 bp, Homo sapiens
ctatagttttgcgagatgttcccattaatggaaactgggtaaaagatatacaggatttttttctgtattatttattgtaactacatgtggaaccacaattatctcaaaataaaaatttaattaaaaaaattgaacatctactgtgacacattttttttttttgaggcagatcttgctcagttgcccaggctggagtgcagtgagtggtgtgatctcagctcactgcaacctctgcctcctgggctcaagtgattcttctgcctcggcctcctgagtagctgggattacaggcactcaccactatgcccggctaatttttgtatttttagtagagacggggtttcaccatgttggccatgctggtcttgaactcctgacctcaggtgatctgccctcctgggcctcttaaagtgccgagattacagctgtgagccactgcgcctggtctaatgtgacatattttgctaaccattgagtatacagtgttgagcaaaaattgagtgtcagacctcatgacacgttctacaatggcagacagatattaaataatcacagaaataaatttaatattcaactgtggtaagtgctgtaaaagagagctataagaactaataatgagaaaatttgatccagatagtaagtgggtcagcgaagctttgcttactaactgcatgactttgggcgagttatttacatgctttgtgcctcagttcctcatttttagtggggacaataatagcacctattctttaaggttgtcatatatttaatatgaatattaaatgaatgaatttgtaaagggcttaagatattgcctagcatatagtaagctctggttaagagtttgttaaataaagggatacttgatgtaagaccttgtaagaaaaatgagtaggagagttaattcttttttatttttacaatttcaacttttattttagatgtgcaggtttattccatgggtatacagcatgatgctgcggtttggggtacagttgtacccattacccaggaagtgggtatagtgctcaacagtttttcagcccttgcttccttccctacattgcccgcgctggtagtcctcagtgactattgttgccat

SEQ ID NO: 113817 - DNA, 1859 bp, Homo sapiens
atacatttctctttttgacctcattaattgaatagtttgacatttgttgttcttacactgtgccagtcattatgccagatgtggagagcagaggcatgctctcaaggagctctcaaaacttcacctttttcaaagtgatctttaagttaggaaatttatataatctgtttaaaagatatttattgtcagtaatagtctagttttctaaaacttcataaatacctttttgttattaaagctctttgaggttatctttccatttgcagaaggaaaatttactgagtagaagagattgtcttaaaacactccacgtcttcagtgttagaattcactgctagaattcatcactggaattgaactgtgcttactttagtcttcatctgtcattttctgtgtgtacttactaggccatatctgctaagtcttgttttacaaggcttactggtttgactgcttttatgactgcatctttcaagtcccacccatgcagcttaaaagtctattactaatgtccccatacttatgttgaactcttattttggtgttgagtaagtaagtggaggtatttaaaaatcaaactagttaggagtaatacagatttaagaatatggagagtaagaacaatgaaaacatacccttttttgatttgttgcctgttaccattttatcagtggctaatgtttgaccataggctctgaagatttaaattttaaaaggatgaaaggagaatgaaataaatattttaaaattttttaattgtagtatttatttttaaaatcaggttgtacttacacctcttacacctgataaaatattcaaaaggggcagtctgtctttcaaaccttgtacttcagccatcttgttccctaccctttgggcaacttacttggaactctctcctgagacaaatctatacatacacaagcaaaaatgtaaatatacgttacatttttcaacttaacaattggagatctacctggagaaattcttcattcttttttacaactgtataatgagaataaaattattacctcaccccaaaatacttaataaaggtaactattgttacagtgaatacgcttaattttttttagcacatagatcataactttccttttgtgatgttaaactagatgatttttattgtatgtttgaaaaatgttaaaactactttttcccccccacagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggtaagttcagcatgacagcctaatgtttgtattcatgaatatccactaataaatatgtacactattttattgaggttgaatttttcagtaactttaaaaatttgagatcaaatttacataacataaacttaaccattgtaaagtgtggaactgagtggcatttagcaggttcacagtgttgtgcaactaccgtttctatctcgttccaaacattctcaccaccccaaaagaaactactacatttaagggtaagcttttaaatataatgtaatacagagaggtgtgcaatcatcacatcttagtgtggaaattgatgaattcctacaaagtgaacatttattatataactactcctcaatcaagaagtaaaacattaccagtagtttcagaatccttccttgttccaccttcagtttcaatattattttgatttctatctagattaattttgcaagtatttaaactttatgtatgtggaattcatactgtgtactct

SEQ ID NO: 113818 - DNA, 1051 bp, Homo sapiens
tcaccaatatgtttggtttcagaccatcctctatttgttttctgtttgtcacatctgttctttcctctccccttatttctgttaccttcaaaaccttgttatatgttctcttactttttgttcagtaggctaccctagagattattacatgtatccttgatttattagttctaggcattggtacttttaccacttcatggaaaatgcagggacttcagaatactttacctctttttacccctttctgcttccttaccattttctcaccaggaaataggtcaagaatgaaaatggttgagactattgggttttacctttctttgtttcacttcttttcagaatattgacacttcaagttctggctcccttggatatttactggtttaaaatacaatattttgctgttatttgtcatttgctgtctttatcacagattttttttctaattttaatgacaaaattataaacaagaaaaatacatatattcataatttgaaacaggtgaaattaatagcatacccattttttctgtgtttaaatagctctttagccctttatgtgaggcagaaaattaactccaggaagtagaaagatataggaagagctgactccttccaccttcccacgttgccgtcaagtgctggtgatgtctttactcatggtcttcaacaggagagagtgccaagcagtaaggatggggcaagggcataaaaaggatctatttgtgttgctcttttatcagggaggataatttttctagaaccttatcattagacttccttatgtgtcactggccataattgggtcacatgcccaccccaagactgataactggcaaaggggaatgaaattactgattggttaggacaattatgattccttctctgaaattaggcactttaacatgcaaacaagaggaaggcccaattagcaagtataaagttggaatgactatagcgtaggcaaccattggtgttttcttttctttttttggagacagagtctcgctcttttgcctagtctggagtgcggtggtacaatgatggctaac

SEQ ID NO: 113819 - DNA, 1428 bp, Homo sapiens
taaactcctaaataataaagtctttaaatgattgctctgagaattaaatgcatatagagatcttaacaaataatgcatatagaatccttagcagtgtgactggcttatggtaaggtaaggactcactaaatagtagctgtttctgttttcttctagattactttccctttggatatgttagactctgtacccccaacgtaagcagttttcttttatgttcatgttcaaatgagatgtcagtaacatctctactagtattaatgaaaagctgtagctctagaactcaaatatgacatctggattaggatttagcttgtcagagataaactgctttggaatctactgacttcagtagatatctgttgcatagcccttgctttgaaagtaactatgtgtacttaataatctcaaaaatgtaatcaatctgctcagagtgagtgctaaacaatctagagtacactgattaaaaaatagaagttattctgtataatgatgactagtagtatcagtcagaaatgtcagctagcaaaaagctgaaaaagtaggcctgaaatgtgtttatattaggtatatctaatttgaatgagtcattttggtcaataattcagattccatggaaaatgcaaaatttttttattgcaagtaacaggaagggagagccaagattttgttgccagagttgtattcattaaagagaaccatatggctcttgactcattgaaaatgaagcacatgactgttcatgagtgcagctttagaattattcttataatagatagtactatcttcacttgaagtaagagaagttattgagattgactgatggggtaaaaactgtgatcagccatgtttaagcaaattaactttcagtagttaatttatgttgataacgtgattatgctagtaagtttaaaatttaggcgcctatatccttttttatcacacctgaaatgtttacttgacaacatcaagggtctcccaggtttctgattatgtatagactgagagggaaatgtgagaggagtaagagttgagagggctcactcctaagtgtttgatttcctatctatacataactttaaaaaataaaaataaaaacagccttggaagctgggtgcctgtagtcccagctgcttgggaggctgaggcaagaggattgcttgagcccaggtattcaaggctgtggggtgctatgatcgcacctgtgaatagcccctgcactctggcctaggcaacagtgaaacccagtctctaaataaaaataaaaaacctttggaaatactaaaatgcaaatgtgaggttttctgatttattgggaatcttggggcatgtgataactgggaatggaatccagagaaattacatagattattatattctacttcccatatatgtaacattctgagcttcagaactcagaaaccacat

SEQ ID NO: 113820 - DNA, 1072 bp, Homo sapiens
ttagcttatgttcatgcctgaatatttgagaaactccttcaaaaggaattgtttaggcattaaaacaggtttgccggttttggttctgattttgaaaaattgatcatcgtgtgatgttttttgtttttgtttctaagatggggtcttgctctattgcccaggccaaagtgcagtagtgcaatcatgactcattgcagccttgacctccagggcccaagtgatcctcctacttcagcctcctgcgtagctaggaccgcaggcatgtgccactatgtccagctcatttttataaattttttgtagagacgggaatctgggaatctccctatgttacccagtctggtcttgaactcctggcttcaagtgatcctcctgcctcagcctccagagtgcagggattataggcatgagccgccatgcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagtttattgattgtcccccagaaaagctttgctgtatcttttttttttttctctgatgcattttgattcggagaatgactgacaatgcaagttaaggtttagtgccatatagtgtgtccaaatgtaaacttaaagcagcctgtattagtcccttctcatgatgctataaagaaatacgtgagactgggtaatttataaagaaaagagatgtaattggctcacagttctgcacgctgtacgcgaagcatagcgtcttctggggaggcctcaggaaacttacattcatggcggaagatgaaggagaagctagcatgtcttacatggccagagcaaaagcaaggagggcagtgagggaggtgctacacacttttaaagaaccagatctcatgagtactctataatgagatagcaccaagtggatg

SEQ ID NO: 113821 - DNA, 1062 bp, Homo sapiens
tttctattaaagagacaatttctgaattttataacaatttctagaacagttgagtacctcactttgagacacatttttgctaaaagttaaaaacacaaaacccttatgagataaaataggaagctagtagagataggaaagccctctgcttagtaaacctcttttttgcgtagtttagacacatacaatagtaaagttacttagtacgttgatagttttctttctcctcaaaagctacaatgtcttactagctagttccttcaagaaaggaaacaagaagccgctggaggagattggtgagtgggataaaacactattcaactcttcagttattcggtttttaaatcctcaatgaaaggctgctgtattatagagtattttttttttatttttaatagacttagaaccaagtttcttgagaaacctttggcatattgtagtttttttatggctatgactcacatgacattactgtataaaactagtacattctctcgtaaaaccacacaaacttactagagtgctgctctcatttttctacattagaaatgaaaaagggcattgtctgcattcaaaatttcctttttacatctctgtattactttttcccctttatatttatcttaaaaccaaaagaaataatgtttctattgttttactgtagttaccactgatgctaccgaagctgtattgtgagtgtttcaaaattctcaaaccagttttgtgtgttgtacttggagcttagtcattgtcatacgtagcaggacctgattaagaaggctgtgccgcctctaagccttgctagattgtagccactagcaaccaggctgcaataatttccctttgatgacatcatccactgtggaagaacccagttgcttcagcgagtcgaactacagttttaacctcatcaaatatggcatctcccttgcttgctgcagcagggatggaagaaatgtcactttctttttaagctagcaagctttttctttttctttttcttcttctatttaaaaattctaatcatggatgcttcttccgacccttatttgccttatgacg

SEQ ID NO: 113822 - DNA, 1088 bp, Homo sapiens
aacaaattttataaatttatgaaatatgaaatttagcaaattttataaacctttttattcatgtattgtacagctcatcatatttgcagacataataattgaatgtggaacttgtttccaattacacagatgtcttaatatccaccttatcatctctaactaaggatgtggctttttattttgaggtggcaacagaacagaaaagaaaacagtgaattgagtaatgggcttagtattgctgctgcctggttgtgtatctttggtaaacttctttgagatttggcattaacttgcaagtctttgcagtttagacagttaaatatgactgaatggctgaacaaattttaatagcgtatgcttcttttttgctatttatttacccagtagacatttaattgaccacctgctaaatgtgaggcactattcttgccattacctttttaatctttgatttggagtctgctaacattctggaacttccactatcaacttagaacgtttactttcccatcccttaccaggatggccatttcttatcagtagggtcacagagagagaaaaaaaaaaaccatctggggctagacttcctgctcttaacatacagaagcaaataggttgtgaaggaatacatagtattttggatttctgcctcttccttccataatttttttaaaaaggttcatatgttttatgtgtgtcttatgtaacagtaatctgcattatgaacttaaatgacgaggatcaccatttcacatctttggagattgatcacagaggtaataagtaactctttttaaataactatatgcatcatttttcatgtaaaactattatttggataaacccctttgagaaaaggcttaggctcctgccagtgtcactgtgatatttactaataagctcagtttaaggcgcagcaattaaggttgtgttgtttttttttttttaagttcagttcagcaaatatatgtggaaagcttgtgggtaaaattatatttgtatttttgggaaagcagacaattttattaatgcctatatttttctagttcagtgtttgtcaaacttcaagttttaacatgttgatcatg

SEQ ID NO: 113823 - DNA, 1042 bp, Homo sapiens
catggaatttctctactaggccacctggaagaaaagtgatcttttttccagtcttttttgttactgtttttcagccaggagatagtagagttaggtagtagaatagtagtcactggcatccggtagtcagccctccaaaaaagtttttgatttttttttttttttgtcttaaacttggaagctactaactttcaggtcatactttcttatcatccaagagctggatatttaggtagcagaaactatggaattatcctaagtcctcttgaagcttcagctgttaaaattaattggttctgattaacactgtgctcaagatttacatttctaggagccacagtttgattggtctaacttggatctatgtgttttctttagctggggaggagaaggtatcttgattgataccttcaccaggactgcatgcagtgagggacagaagtttccttaaaataattgggttctgttataggaagaaggggaaggagataccaagtgggcaaaacaatcaggttctattacataaataataaacctaatgtgacgataataaatggataatatgattattttaagtttggaaatatacctggttattagtattggatatctggtagtggggttggagaaaaagtcgagaataagaaaagacttaaaatcgtaaaaattaactggaaaagaggatggctgagcagatacatatatgttagataatgttcataatggcaaaccaacctgaagatttgtttaaattgtagtatgtagccaggtgtggtggtgcttgcctgcagtcccaactacttgggaggctgaggcaggatgattgcttgagcctaggtttgaggctacagtgagctatgtttccaccactgctttccagcctaggtggcagagcaagaccccatctctaaaaaaataaagtaaaatgaataaattataatatgttatgacaaatatagttatctgaagtcacagaaaatgtgcatgtgcatttaatgatgtgaaataatttttaggaagtatgaataaaaaaatcaacttt

SEQ ID NO: 113824 - DNA, 1053 bp, Homo sapiens
aacccgttttagattatgagcactttggcattattatgtttttgttttctttctatagcacacagtaagatgttctgcccacattgtgcataatttatgggtttattcaaggatttatgcaagtgtagctgcaagaaaaaaacctagaagtgaacttgctaggttgaagagcatctgtgtatgttaaattttgttagctttcgccttcccaaagggattattccatttcatacttaaactactaattttgtgataggacttctttctccatagctttgctaaattaatgcattcacacacttcatctttactaatctgatagagggaaatgatattgtggatttgatttccatttctttttatgtgttagcttgagcttattttcatatttaaaagccaattgtatttctttttcttgagctatcttttaatgtccttcctgatacatttctgaagtctgtgatactcatataagatatatggtgaacatgtgtcaaagatttatttgactctaatgagggaacccgcctgatgacaaggctgattgagaagaggatgtgtgagatgaagtgtatatcatcagtgaaagaaagcaaattcttacagggcaaaaacaaaaccacaactctaagggttattgtttctactggacagaattcatttgcattttaccagataaaaattactattttcaatttatcttttacaaatcattttctaattttacagagtctattccctaatcagtagtaaatagtcttcaaaattctccgcagcgtcaggtgactattatgcaggctaattgttgacactcgggcttgactttaagagaacatgccataatcttttggccttacttccaagttttggataatttttcttaacacatttttctctaattgcaatgatttcaagtgatattatttcttttttttaaatttttttactatttattgatcactcttgggtgtttctcggagagggggatttggcagggtcataggacaatagtggagggaaggtcagcagataaacatgtgaacaaaggtctct

SEQ ID NO: 113825 - DNA, 1130 bp, Homo sapiens
cgccactgcactccagcctgggcaacattgagcactgagtgagcgagactccgtctgcaatcccggcaccttgggaggccgaggcgggcagatcactcgaggtcaggagctggagaccagcccggccaacacggcaaaaccccatctccaccaaaaaatacaaaaatcagtcaggcgtggcggcgcgtgcctgcaatcccaggcactcggcaggctgaggcaggagaatcaggcagggaggttgcagtgagctgagatcgcggcagtacagtccagccttggcaacagagggagaccgtggaaggcgggagtcggagacgagggagagggggagaccgtggaaagcgggaggtggagacgagggagagggagagggattatttctgtatgacttaataatgaatttctaagaaggtcacttagctcactgttgtctcttctaaaacatactcatctttccttttctcttctgtaggaactcattatacaatgacaaatggaggcagcattaacagttctacacatttactggatcttttggatgaaccaattccaggtgttggtacatatgatgatttccatactattgattgggtgcgagaaaaatgtaaagacagagaaaggcatagacgggtaagtgtttttagtaaaaatttttaaaaacatagtgcataattagatcttttaataatatatttctgccaatgatctcaggctgccaaatgtttacatttaatataagtaaatgtctacatttcatatgtggtacatgtttttttctttttctatgtttaatttttttagtttacttataccctgtaactttccagaaaggatttcaggtagctaaaaaacaaagaaatacaataagaagacaaaataagaaggaaagggaaaaatacagcacaggagttggggggaagaacaagccaagttccagatatggaggtcagcatgattttgggctttgagcagcccaccagctaaggcaaaaaaggaaactcattgcatagctcttacctatggaaaaagaagaaatctactgggggcagatggtcttgtgggattttgctgttttcttttatctcctttcccagcatttgattctgagatatttctcaatttggctc

SEQ ID NO: 113826 - DNA, 2421 bp, Homo sapiens
gttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagtagtaacactaacaggattggcatcaggtaaagaaaatttttcaagcaatccttttttagttaacagaagtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaattaagttatcgattgaaaattagatttgtgaacctcctgccaagtagctgtcttttgaagatattttagtatcttttaaacattgtttttcagatcacaattaatttgaatgatgtaactttttaaaattccaaacaaaaatagcacttttattgtaaaaaataactctttacagtttataactaaaatttgaaaatcttaaatttatatgtagttcataaatgaccctttatttaggagtctcctgctttctacttgccttttaactagattgttctcgactcccaaaaaattgacttaatttttttaccatctccaacatgtttttataggggcactggccggattaatagacattgctgccgattggatgactgacctaaaggagggcatttgccttagtgcgttgtggtacaaccacgaacagtgctgttggggatctaatgaaacaacatttgaagagagggataaatgtccacagtggaaaacatgggcagaattaatcataggtcaagcagaggtaagtcttgctttgtctcaagatgaattaataattgatatagcaaaatgtttccaattcatttaattatagaactaatcacatattagatgattacatacacatcaaatggatccaccctcaacacattgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagta

SEQ ID NO: 113827 - DNA, 1408 bp, Homo sapiens
agtatataacagttgttactcattcttgatacataaaaaactattgcacataattacagtactcagagaaaacataatattcttatttctaacataatgtccaaaatatatttaaaatattatgcttatttttacaacagaaatattcaaatttgccctttttttggttatgtaattataatccttataattaaggtctgtattcattttaacatggcctgatattttgattttgttcctgagatagtgttgccctctctcctttcttgggtagagaattagattataatatcaatttattatatgtagcataataggcaaagttttcgaaaaattaactgtaaatttttctgtagactgctaaaatttgcaaggttgtttttgtgcataaaacaagaaaataacttggattcgttacattctcatgtttcttaaaggacattaagctgccttaatctttgccttgtagattaaaactattttaagtggattcatcatcagaggttacttgggaaaatggactttaatgattaaaaccatcacattagtcctggctgtggcatcaggtttgagtttaggaaaagaaggtcccctggtacatgttgcctgttgctgcggaaatatcttttcctacctctttccaaagtatagcacaaacgaagctaaaaaaagggaggtaagtgtcttttgtagttaatttgactgaaaaatatatattatatagtatttatttaagtaaagaatttcttagtgtaaaaataataaattctgtattcagataaaaaattttgagatttgtgcttctgtttttcctgaataatctataacatctttctagaatccattcccagtgctgctcagttcgtcttacattttagagaagctttagatagacagctggtgtccattgggtttcagctgcatttcacgaagatcttcctgttatcactttaccttacatctttcctcttctgaagtgttttctaagcttagctttgtttttcactcttactttcaacattaagaggttgggaaatcttaatagctatgttttcctcctggaggcagtgtctggtgccagtgtaagtggtgtgtgatatgaaaaatgctatccagtgctatggggaagttctgagggcctttagaagctcttgaagtttaaatcagaaattcacattaaagagattacaggaaatccttttcatttgattgtttaaggcaatttcctttaccatttctttaggccagcctgagatcttctacaagaccttgaaaccttatatatattatggatttcctctgatgtttccatattgctctgggcattttcctgaatcctttatattagctctagactttgggagcccagtcccttcctattttccaaatctaaatctacagccctaga

SEQ ID NO: 113828 - DNA, 1511 bp, Homo sapiens
ccaacatggtgaaaccccgtctctactaaaaatacaaaaattagccgggcgtggtggcaggcgcctgtaatcccagctactcgggaggctgaggcaggagaatcacttgaacccaggaggtggaggttgcagtgagctgagacgacgccattgcactccagcctgagaaacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttggatttttcttttcctttaatttttttgtagaggtgttggttggtgagactgtaacttgaggagctgttgtgtgtgctttcagaatgaggctctctagattgatagtattttagcagtatttcagaatgcatagggtagtgaaaatatagggaatcttacaaggtcttcggttccctgcatatcttgctacgatttggaatagagtatttatggtggagcagttagctctaaaatttgaagaaatgatatcctatttaaaaatagctccccatcccagttactgccctcccctcttacctacacaaacatacgtcttgaaaattgtctatattcattgcctcctcctctttacaccctattcacattagtatatctggcaaaaattttttttaactgaatggtaaatgcatgactgacctttcaattaaagccaggagaaagaaacaaatcttaatagaagaaatgaatagttaccctttgcttagggagcaaggaaacatgcaagttaaattcagaaaatccatttggaaaattcaagtaacatgaagaatttttatttggtatgtttgaatttctatgaaattatgaaataagccatatcctctttctaggtgctatcagctgcctcagctgcaggggtttctgtagcttttggtgcaccaattggaggagttctttttagcctggaagaggtaggtgaaaagaatacaacaattaaaattatatataattaccattacaaatatatttcacacatttcagttttgtaggtgatgtaataggtagagactttgttttcaaatttatttttctaaagttgttttccactcattcttaataaaaagtaaatgttattcatgctccatacctggaggaaactttttaaaaatttattaatgtatgaatgttagtaattatttaaaatctaactttgttgacatatttaaaagtaagaagatgtgaatttgacttaatagaggacatgtgaaacaatctatttccattggctaaattctgtatttttagtagagatggaatttcaccatgttggccaggctgtttttttgtggggtttttttgttttgttttgttttgtttttgtttttgagacggagtttcactcttgttgcccaggctggagtgcaatggcgcgatcttgg

SEQ ID NO: 113829 - DNA, 1035 bp, Homo sapiens
tttttttttttaatgtagaagaggcaaattaaatgcattataagttaacaggagttggtgatggtacatttatttttaactaccatgattgaattgaatgtgaaactcattttgaatataaaacagcactaggtattctattagtatttattagacatttatgatcaattgatactgtcaatttgtaatgatgatcaccatctccaaaaataataataacatcaatttttcttattacagtaaaatccattacatgtaaattctaactacagcaaaatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtt

SEQ ID NO: 113830 - DNA, 1024 bp, Homo sapiens
aaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattccttggctcctggctgtctatttgcatcttcaaagccagcagtagctggtcaagtctttctcttgtctcatcaccctgacccaaactctgctaaatctcccttccacatttgaaaaacctttgtgattactttaggcccacgcagataaatcagaaaataatctcctttttcaaggtcagttgcttcgaaactttctttctgccaccttgattcctccttgccatgcaacgtaatgtaatcacaggttctgggaattaagttatggacatctttgatgagccattattctgcctcataccagtatagggtattagcttgaaaggacactgcagactcagttaaattactagatctataaatacatgcctttttccatcaagaaattaaggcagctgggtcttatgccctgggacattgcttcttttggatttataaaataacaaaatttgttg

SEQ ID NO: 113831 - DNA, 2575 bp, Homo sapiens
taaaaatatatattttttaatttcaatagcttttgggttacaagtggttttggttacgtggatgaattctataatggtgaagtctaagattttactgcaactgtcacccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgcatagaatgtaagtttcaggcatgtgagtagaggatctctgctccataaagagttctgttgttgttataggttccatcaggcttgttcatccccagcatggccattggagcgatcgcaggaaggattgtggggattgcggtggagcagcttgcctactatcaccacgactggtttatctttaaggagtggtgtgaggtcggggctgattgcattacacctggcctttatgccatggttggtgctgctgcatgcttaggtaatatggctgtgtctgcctgtgtgtggatgtttgcaagtctgagagagccaagagaaagtgggacacattcttgcttaattggtgggcggattggttgagtaaaggagggtgccaggaggagatgttttaacagataagaaacagtagtactattagggtattatacagtaccggttttctgtcttacaacatttgttaatacaagaatttaatggcattagcatattgtaatataacttaatacactatggcagaagccatctaagtacaacataagcttaatttgaatcctgaccaaagatgtctttgattctttcatcgttaaggatcttggcttacctataacaactatagcataatacctaagattagcattgcaacagagtttcagagtaggtttactttggttctgaaatgatttattgttagccttagtaaaagatgtatttacccatgctccatcatctaaggtatatttgtaacaaaatgagaaaaggtaacttcattttaatgagaagaaaagcaaaatacctacattaagtacttgagtctatttaatgtctgttagggcaggaaaaaatggttattgcttttcatatttaaaatatcagctacactctggtgataatattaatggttgccattttgaccagttttgtttagtgaataaaaattatgtgattattgatctttaaaaatgtaatatcaattaaaaggaaaggacagactcattttcaccaaagtagcaagtatttattaaatgtccactttctttttagcattgtgctagatacagtgcataatacaaaaagaacatggacccaatctcgactctaatcaagttgaggagacaagatgaacactgagaatacaatagtgaggaatactaacaaatatatacaaggttaaaagagtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagttggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccctggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggactggattgataacagtgagaataccgagaaagggaccataggcagtgtgaacg

SEQ ID NO: 113832 - DNA, 1301 bp, Homo sapiens
aatgtaaatcaaaggcatcaaagtattttactctttttgaaaaaaatttagaggagaaatttattatattaatattctacccatatatgagtttaatttgtaaattgtagcaaagcatgatgtgctttactaaattcctttataattagaataagcttttataagggtgaaattatgtctttgctacagcactaaaccaaaatggcaaaattgttttagtcggtaagctttgcttttttaaaatatgaaataaacaggtttttaaaatgttattttaatagtcttctctgttataaacaaagaaaattggtgtttctctagagcttattaaaagtagtgattattgtcctaaaagaggagtagcagttttagatgctaatgcttttccctgactgagttctatttgccatttagttttaactgcctagtgcaaaaattctaataaaatgtaatgatgaggatcctgtccttcctgaccagtgggtgcttacttttttcaggtggtgtgacaagaatgactgtctccctggtggttattgtttttgagcttactggaggcttggaatatattgttccccttatggctgcagtcatgaccagtaaatgggttggagatgcctttggcagggaaggcatttatgaagcacacatccgattaaatggataccctttcttggatgcaaaagaagaattcactcataccaccctggctgctgacgttatgagacctcgaaggaatgatcctcccttagctgtcctgacacaggacaatatgacagtggatgatatagaaaacatgattaatgaaaccagctacaatggatttcctgtcataatgtcaaaagaatctcagagattagtgggatttgccctcagaagagacctgacaattgcaataggtaccctttcaaaaatatatatatgtatatatgagatggatttctggaagaaaggaaagcaataagcagtaacatttaatgggttggatttgtgggggcaagggacattattttatgtcccttaaaatcttctgttctttaggaaaggaaggtatgcttcagtggatgattttctgctatttagcagaaaatctgtatttcagttttgtcttttgatctggcattgtaccagaaattggagtcagattattttcccactcagataagcctagataagttgatcttggttattcaaaacagcatgtaatataagaccttagctaaatgcattcagtcaaatacattcttgtatttaataaagttggcttattggaatacaagttattgaaaatctcatcttca

SEQ ID NO: 113833 - DNA, 1033 bp, Homo sapiens
gcacaagaccagacagtgtatgtgggggagtgtttctcaaatcaaactggaaactctttaatttgtaagaaccattaagcagagagagaaaaaagaaaggaaaagaaaaaagatcctacagagaacaccctgttcagtttgggaacaggctacagctttggatttttcaaggcctagcattcccatcattctaaattttacttagctaatacaatagtagttgccagagctgatgacatagtattttgtcatgcttggctccgttcaagcattttagttttttagccattaccatggctagacccagtcaaaagaatttcattgtttaagattcccattctctagtttttactagtagccagccaaagaaaagaaaaaggaggtcagaatttcggtatttacatagaaatttaaggggaaaaggccaggcatgtttttaaagtgtggaaattaagaactattcattatcccactgattgtgtggatgtgttttttaaagttttgttactgtcttgagagagagaatattgagataggacataatgttggtttaagggaatgagggtactttctgtaggtgaggtgccaagccatgtcatcagaaatgttagtcacatgactttctaagcacaccttaaatgttttaccgtgtatgtttttgtaaagttttaaatttttaactgggaaaaacagacctgtatattaagttttatatatatatataaatttaaaattacatatatatgtttatatatgtaacttttatatgggagagatatatatttctatatcctctataaaaaaacatatctatatatgaaaattatgtacgtaaatgttaatttataattaattatataaatattaacataattacattatatatatagaaaacctagtgtacagatctgtatataaattaaaaatgtatgtgttatatatagttacatcatataatacatataattgatatatataatgataaatactttattgaaggatgaaaaaatttccatgctgtctcataaaataa

SEQ ID NO: 113834 - DNA, 1052 bp, Homo sapiens
gggatcagaagtcataggatacattaattttttttatctctgaataaacaggttgcctacttaaaaatctatcagtttaaaagtgttggtctcttctctctcttttcagaaagtgccaggaaaaaacaagaaggtatcgttggcagttctcgggtgtgttttgcacagcacaccccatctcttccagcagaaagtcctcggccattgaagcttcgaagcattcttgacatgagcccttttacagtgacagaccacaccccaatggagatcgtggtggatattttccgaaagctgggactgaggcagtgccttgtaactcacaatgggtaagtctggtaccacaggaatcagttcacttgctagaatataggatcctttttagtggaatctatatagttattaggggagcatgtgagtcagctcccaggtgggaaagtctgtcctatggtatagtcacaaatataggatcagtcaatcaaatttcacatttactaaggaataagaaagatgtcatctgcctgctctttgccaaacagtgacatttgtaaataatacctcaaagttggaaaagaggtgctgaaagatctccagcatgaaagcatgttgagcttagagtgcttcttttcctagggaagagtggacctaacctgcatggagcactgcaaaaacctgttttatttttgtaaatgtttcatttttagtatataaatttctagtacaataataagtttctagatattttgctatttactctttcagccaatatttgatttatcatgtaatgaaggaaagaatatatacttaaatgaaatttgtaaatgagctaaaaatctcctttaacaaatgctttgtttccttttgtctacctttctctatacacaaatcttttatatttatataactgctaaggacaaataaatactcatgtatttaaaatgtatacattgataatttatttttccaccttttacacatgaactgccagtgtttctccattgacaggaatataggaaagaaacagatgtcacgggggttgtggagaccttaatgca

SEQ ID NO: 113835 - DNA, 1925 bp, Homo sapiens
aaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccaccaatattgaagattagtattgtgtcacttttgaaagtcagtagaatttatgcaaaaggaacctggaactttaaatcattttgtttttattttctaaagttcatgagactcattcttatggttcatgtttttattttttctctcattctttatcattatgattggaaactcttttaatttaatttctcacacagttattagcataataatctgtttcaggattgtcttggggatcatcacaaagaagaacatattagagcatctcgagcaactaaagcagcacgtcgaacccttggtgattagatatatcagatctcctcattagacaccttagaagtcaggaagcatgaaacttgtgaactgttgagttctgtctttcccagatatctgctgaacaaaaatatcctactatgctgccaattacatttgtatctgataaaatgtgtctgtaagataaatttagatatgtgtaaaatcccatttatagaaagtaagcaaaagttaacatctctcatcaaatcattcattacaatttcagaactgtaaacagtttggtagtggaataagtgaatattattggacattcttaaagtgaatatggcaaatctgtctacctcagtggatacaccggtctcagaagacacctgactggttaaaaatgtctgacccatccccgcaagcccttttttttttttttaaatgtttcccgatcttgtggtagtcttatggtaaatctaagctcctaaaggattttaaaggagcttagcaattagaactgcttacagttaaatggattttttaatgggcacactaactagagtgtaatgtgtatattatttgtgatcatagcattagttctttttctgctataccctgcatatcttcaaagtcacagtgtgtgtcctgccatctcattagtgaattgtacctagattatgtgtgtgccccttttgtatgatgtttctggaacgctataagcagcttttagagtcaaatgcattcattttaactggctttatgtcctagtggtttcatgactacaaatttgaattatcttactgcataacataaaaaatgtctggctttagcaattaatgcccgaaattattttgccctgcaattgtcatacctgtatgaaacctgtcccagtttgcttaagtgcacaactgattatgtattcctgtgtgtatgctaatatttcacaagtgtttcatgcatccttttttaaaaaactactaaccagaatattatcgtagctactcattcattctgctttctgcttcacctataataatcttttaggactgccttctgatttttcacctatcttttaatgtaagcattaacaactaagactttcataaaagcactgtatcttaactttcctggcctaaatcaaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggcc

SEQ ID NO: 113836 - DNA, 1742 bp, Homo sapiens
tttcccttttatttcataggagtcttctgtttattcctttcaggcgcctccttggcattataacaaaaaaagatatcctccggcatatggcccagacggcaaaccaagaccccgcttcaataatgttcaactgaatctcacagatgaggagagagaagaaacggaagaggaagtttatttgttgaatagcacaactctttaacctgagggagtcatctacttttttttcctcctttacaaaaaaagaaaggaaatataaaagccgggtttttgcaacatggtttgcaaataatgctggtggaatggaggagttgtttggggagggaaaggagagagaaggaaaggagtgaggtatttcccgtctaacagaaagcagcgtatcaactcctattgttctgcactggatgcattcagctgaggatgtgcctgatagtgcaggcttgcgcctcaacagagatgacagcagagtcctcgagcacctggcctgttgctccaacattgcaaagacacattatcagtccctatttctagagggattactttgaattgagccatctataaaactgcaaggtcttgcccttttttttaatcaaaactgttctgtttaattcatgaattgtatagttaagcattacctttctacattccagaagagcctttatttctctctctctctctctctctctctctctctctactgagctgtaacaaagcctctttaaatcggtgtatccttttgaagcagtcctttctcatattgagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaactactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaata

SEQ ID NO: 113837 - DNA, 1916 bp, Homo sapiens
tgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgacaatgtgtggtttggcctttaattatatctgtaacagtcctccctcttcactgctgccctacgcagtgtaggccgatatgcctggcacagggagccccaaaaaggtaataattataatgcttctctcaggttacaaagcatttctacactttgcaagcaaggagcaatagaagagtagatagatgctggattgacagcaggatgttcataccaccagcaatggtttagcgcccccatttgtcagtgaaagctgcaggtccacagaaaactgatttcatttcagctcactttcaaaagtgatttttttttttttcgcaagaaaaattacgctatttgcatgaaaagaggtaaaacgatttatttacatgtctttaaaaaatcaccttggacatttgctaatagaa

SEQ ID NO: 113838 - DNA, 1125 bp, Homo sapiens
ggtagctggagaaaaaacacaaccatggcagcttgtcttattttaacctcaagttggccacactggatgcccatcgatcctactttctcatctctcaacccccaacccccaccctcatcctcagtttatttcactgagaaaatagaagccaccaaaataactttaacagaatcccactgccctaccaactacccaaggaaggttgaatgtgtgcccaagaccccatcctcccttgcctactcgaggtcctctcctctatttttcctctcaaacattcctatcattaacaaaaaggctataatttcctgcatcttaaaacccgaatgttctgattaattttccctgtcaaaccatcaacaggaaaagaagctataatatcctgcatcttaaaactatcacgtattactttcctggaaacctgataggaagaattggaatcgttgtcttcaattcttcaaatctctgttggacccactcctttcaggctttggcttgccaccatcgcgctgaacctactctgggggaagttatcagttctctctttattggtccattttgagccctcatttacttcacctatcagcaacacgggacagttaatcatcgctccttgaaactattattcatttggtttaggggactacccttgctttttgagacagggtcttgctctgtcacccaggctggagtgcagtagcaccatcttagctcactgcagcctccaactcctgggctcaagtgatcctcctgccttagcctcctaagtagccaggactacaggcatgtgctaccatgcccagttcatatttttatttcttaattttttgtagaggagacctagtctctttcccacgctagtcatgagctcctgggctcagatgctgctgccccgccttggcatcttgaagtgctacaggcctgagctaccacacgcagcttattttttaatatatccaccagtggaatacccttctttgaaggtcactactcctaacccaaccatactggcagctccctcatttgctggctcctcacctccccaaatctaaacataagcatgtgtcagtgctcggtccttgtacctcttctctgtctgcattcaatgcacggtactctcctgtctca

SEQ ID NO: 113839 - DNA, 1468 bp, Homo sapiens
accatcctggccaacatggtgaaatcccgtctctactaaaaatacaaatattagctgggcgtggtggcatgtgcctgtagtgccagctacttgggaggctggggcaggagaattgcttgaacctgggaggcagaggttgcagtgagctgagatcgcaccactgctttccagcctggtgacagagcaagactccgtctaaaaaaaaaaaaaaaaaaaaaaatcgtgactgtaactaaatcctgtgaaatagtcgttaataaagaaatacttgttaacctgtttttaagcttgaatcctaagtagaaaagttaccaaattgccattctaaattagagtgctgaagactactacccaaggtggcacaagttgtattagtacaaagtcttaggaggaaaaaccctctttataatcttcttacttttgaagactgattcattttctaactatgtagataatcttttatattattgatttctttcagctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacatgtgagtaaaaaaaccctccaccttctacccactgccacacctccctcctctccccgcgacatacatccacacatgaatacgtgcacatttatacccccaaattccagcagaggtaagacagggattcagcttgtatttcaaaatgaagtttttgaagtgattttttttaacgtagatgtcctaaaaatgttttaaactcatcttatattctggcaaaggtgaatatttgcattcactcaaaggtgaagattatttgcattcaggcttacattaaagtgaatttactcattagacacattatagggacatgccttcttgccgtgtgtgtacgtttggggctaggtatgggggtgtgtgcacacaccttaggctccatttcgtttccattgtggtgggggtatttgttattgtgcttaaattcttagatgaaaaatgcactttaaattatttaagctttataagagatgctgttttaccgttaactaattgctcattaaataagaaaattttacttaatagctaaaccagtgcttactcgaccatagttgcctgaagatcaaagaggcaataaggtgtagcggatatgacctgtttctggggccaaactggttgtaaatcacatcttcccagtgtgtaagatcgggcaagctttccaacacctttgcatctgtttctttacctgtaagatatgtgtgcacatgtgcacgagtgcatacccacacgcagatcatttaattctcatttaacctactttgtaaccaagtcacagagaggcaaagcatcttgcccaggttcacacaagcagtctggctcc

SEQ ID NO: 113840 - DNA, 1372 bp, Homo sapiens
ccaagatcctgaactacgtcatctgtaagtataaaaacactttgaaaatggaccactgcgcataatctagttattgctacgttaaacatcgagaattaaaatcgcttctcaattcttttccccttgtctccattcccttatcgtgaacagccctgctggtattcctttattgatcatcctcttctggggggataaaacttaaagggaaatcaaacttagcatcttctcaaagaaccacatattcctgcccaatgcacgtatttggccgtctgcttttcagaacagaactaactagccttggtagttaccagtctctgggggttgtgacctggacatctgcatttaaaccaattctctaaagcagttcttctcaaattttactgtgcagagtctccagccagtaggtagagatgtcttagatggcagctactcatacggacctgtttttgctgtacccctgccacttagaggagtgccatagggaagacgaatgtggctgagctgtccagtgtgatggccactgagtgcctcacaggtggctcctgcaacaaaatttgtaactcgtatttattttttacttctttttttttttttttttgtgacagggtctcactctgtcacccaggacggagcgcagtggtgcaattaacctgtctcggcctcccgagtagctgggactacaggtgtgcaccaccatgcctggctaattggtgggttttgtttttgtttttgtttttgtcctgtagagacggggtctcactctgttgccgatgctggtctcgaactcctgggctcacgtgatcaacccacctcggcttcccaaagttttgggattataggcatgagccaccgaacctggcctgtaattttctataattttaattagtttaagtttgtaaattaaaacaggattaaatgtttcttacattgattatatgttgacataatactattttggaaatatgggttaaataaaatatcttaatttcacctgttttttgttgttggtttttttttttttttttagctccttctcctgccccacctgtttcttttttcatgtggatactggaaaaaatgtaacccacactgtatttctcttagacaggctgatctgtcctatatctcctctttgaagccagagtcaattagtctctgatgggaccattgtgggccctagctactggtcagtcttctgcttctacactaagtcatcttctcttcatgtctctgctcacagagagagctttaaaaagcatgattactatctcgtttgggaaaggttgcgcacatttgttgtagagatgggcagtctctaaagcttttggggtgatggatgttaaattgtagtgccctggagtaaagcctgtta

SEQ ID NO: 113841 - DNA, 1079 bp, Homo sapiens
cgtagcaataactagattatgcgcagtggtccattttcaaagtgtttttatacttacagatgacgtagttcaggatcttgggcttctgaaagctaaatcattttataggcagatgaaaaaatgttcacaaagaaccataaaaacacaatttcaataattactactttgcaagttgactgtaatgtcaaaggttcggaaatagttcccaagaagcaggcaatgggttaaaattctgaaaccccgtctctactgaaaatacaaaaattagctgggcatggtggtgggtgcctataatcccagctacttgggaggctgaggcaggagaatcgcttgaacctgggaggcggaggttgcagtgagctgagattgcgccactgcactccagcctgggcgacagagcaacactccgtctcaaaaaaaaaaaaaaaaaacaaacaaaaaaagaaactactgaattttgaacactgaggcaagcattttgttaagtattttaatacttgtttacaccacaaattcctttatgaagtgcatatgattagctccattttacagatgaaaaagacaagatttcacagggttaaataatttgttcaaggccacacagctatgaactcggttttaattcaggaatgactgactctaaaacctcagcttactctttattactaaggtctagcgactgtgtcagaaaaggtatatagacatacctacttcccaatataagcaaaacctttattcatgtgcattaacatatatgcacatgtttactatgaaatacattaccatctgtttcagggagctctcggtacccaacatcatttttatctactggaacaaccaagcctgcaccatgaaaggtctttgtcacaacctacattaaagaaaagaataaaatgtaatcatggtaagcagacatcaaaaaaaaaaatccccaaatacataaaccctcaacatttctgccaaaatgtaacatttaatcacattttatttcagtaaatttggactccagggtaaaaatttaacactatttttttcttgaaaatcagctaaaagttaaacagttgaagtaatcacagaac

SEQ ID NO: 113842 - DNA, 1111 bp, Homo sapiens
actgccctacttttgggaagtttgcagagaagcctaaatattccaggtaaaaataggggagtctcaatttggcaggatggatgagaggagttctgtcctaccatatcttcttgctgacaagaactatttcttactctttttcttttagaaccaggttcctctgtgctttctaccagaaggtactttgaccttagaggaaaccaatattttgacttgccttctaggatgtattgggttcttccttaacaaatcagggtgcagacttccaagtgactggcacaattaagaaaagccaattatttcactgttctgtgattacttcaactgtttaacttttagctgattttcaagaaaaaaatagtgttaaatttttaccctggagtccaaatttactgaaataaaatgtgattaaatgttacattttggcagaaatgttgagggtttatgtatttggggatttttttttttgatgtctgcttaccatgattacattttattcttttctttaatgtaggttgtgacaaagacctttcatggtgcaggcttggttgttccagtagataaaaatgatgttgggtaccgagagctccctgaaacagatggtaatgtatttcatagtaaacatgtgcatatatgttaatgcacatgaataaaggttttgcttatattgggaagtaggtatgtctatataccttttctgacacagtcgctagaccttagtaataaagagtaagctgaggttttagagtcagtcattcctgaattaaaaccgagttcatagctgtgtggccttgaacaaattatttaaccctgtgaaatcttgtctttttcatctgtaaaatggagctaatcatatgcacttcataaaggaatttgtggtgtaaacaagtattaaaatacttaacaaaatgcttgcctcagtgttcaaaattcagtagtttctttttttgtttgttttttttttttttttttgagacggagtgttgctctgtcgcccaggctggagtgcagtggcgcaatctcagctcactgcaacctccgcctcccaggttcaagcgattctcctgcctcagcctcccaagtagctgggattataggcacccaccaccat

SEQ ID NO: 113843 - DNA, 1742 bp, Homo sapiens
ataagaaagtatgatttcaacctgttggtctctgttttgctatagcatatttttttcccctcttgattccttcccatctctactttacccttctcttccctagtcctatcttaagaactggatgctgtcccttagggatgttaggaggatggcactgaaagaggatggcactgaaacaggggtcagatggctcctttgggttggtacactgattgaattgcgcaactggtgatatcactgctgtggttgaataactcatgccagtatttaccactcttttaatcttgtttaccatttaatcacttcataaagttaagtgaaagctgctttgtacataatgaaatttacatacatacattttctccagtaaacgtgtatataagcagtgctcctttctttttccttattaatcctatcatttccttttgcatctctcctaatgtctgcaatatgaggggagtattttgtaaaggagcaaatacttgttaatgttggattcttttggtttttcagctatagatttcagagtaagttaatgacaagctggaagatttctggtttggagtaaatgagaattctataggagtttgttcttatggcctctggggaaaaaacaaaaacaaaaaaaaaatttgtcactggaatgagggctccccagtctcctccagcctctcaccatttgtctgcccatgctggttcatctgaatgttctaagctaaatggagaacttgctattccttaataaactagcactggtaatgaagtaccttagtgtacttaggcattaaatcctacttcagttccttctctgatcttgattcagctgcaggggtgacatttgtatcaagttctaggcactctttagtcctatagactggaaagtttcttaaaacatacattttaatgaaacccattacaatatggcattttaaatattaagattttatattgccatttacctttctggttatcacaggaagcttcttccactttgtgactaggaggaagggtagcatttgtaacctagttaatgtatttctaatttgttttgactaaagtctgagcatccgtacacataatagctgttagcaaattatttaatcagtctttttttatttttctaccacaagctatgatttatttcagaggagattttcttaattcttccccataaagaagatatgattgaggtttaaatttcatagatatttttgtcctagacccctcccctatgaagtttcattttagtatttgttttttatacaaaaacagctggtaaaaacaaagacaaaaaagaactttcaagacaatcatgtttttaatcctcccctgttaatgactatactttcaaacccttttctgttaaatgcaaggttgttcttttattgtttttgtgagatcttcattgaattcatatttttctactgaagaattcaattccactagtatatgtgagttagtggctttgtccttgtgtgtgagcgtaagcatatttccactctagtatgatagagcactgtgcagcacactagaaatcagtgtttttatactgatagtaacttagcatactttggaatgcagagtctttatgagttatatcatttgactccctacaacaaatctgcaaagttggaattatcctattttatagatgagtaaattgagggttatagaggttttgtgtcttgtccaaaatcttaaatgacacatgtaaaacccaacttcatattttccatatttag

SEQ ID NO: 113844 - DNA, 1053 bp, Homo sapiens
catttcccaagtttaccaatcagttaagttcctccagttcccctagggtggagggagtagcggtggggagaggcttgggaaaaatccctccccatggaaaccaggagggagcaagacatttctcctcagtattgctgactaagtgtgtgtaagagggattcgactgcttaaaaatttgctatgaaaaattctcgacttgagtaatttacacccagattacctggctggaattgctgctgctggccgcgcagccgcctcatcataagaggcacttgcggaggttgatggtgaggggctcttccgggtaccactctgtctccctggcaacgtggctccacttccacagctcagaagaacacaagttttccagtccatcgtccgcgtgaggagaaattacatgcaatttacagaataccttgacgtgatactcttcatcctcacagggttacgtttttaaaggaatttacagtaggattcagggggctgatttaaaaaacacaaaaaggtaaagtctgtccatcttgagacattatcctttaagttgatgctaattgagatgaatccattgcttttaaaaacgtagcacttaaaaatccattcttattcactttcctaaaatcttaattttttttctgacgattgttggcttttacctctttaagtcacaaacctatgaccattttgcactgcttttcattgcccggatgctttaggtcattcataaactccagtcttttctcctctccgattctttcccacccttctaatatagtgactcatctcattatgttcctaaaagcctgacaaagatagtgtgtatcgattaagaatcctttaagacatgcttttctcataaatgcacctttgtgtagctgctctgggtctgaaattttgggctctcatttcactcgaactgggatgaacatttctggggacaaaacagctcaatggcgtttgtcaggaccccgtggttatacccaggaatgcagaacacagctttgagtcacacaatcaggacccccagtcatgcctcagtagtaaacaccgagttgt

SEQ ID NO: 113845 - DNA, 1193 bp, Homo sapiens
aggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaa

SEQ ID NO: 113846 - DNA, 1104 bp, Homo sapiens
agccacttcctccaggacaagtcagaaggcagtgatgtcacacttgtgaatggagggcaatagccatggtaacaaagacactgcaggccaggtaccttagcaggtctttctgcagggctgagctatcgctagggaacccacggtgactgaatcaaagggaagaaagacccaagacctggatctcccttttacatggaccctaaagcaaaggttatccctgggtattaaaaagctgggttggggcactgaactcctcagtcctagagaggaagagaactgtgggaatagcatagcactggggcctgaatttcagttccaacatttcgaggattatcccaaagtgtagtatcttactgcgtctgagatacatatgtggtatcttagcgaaaaggtccttgtaactgctgactcagcgttggcaagctgactctgcaccgtccctccttcatctgtgtattgagggcattgaactagttggtagttatatttggctccattttcttttgtttgtgggtgctaagatggactatagtagtagcctgtcagtagaccccaagctagtggccgccagtcaaaagcctttgccacagagaactgctccatcagaattcagcactctggtttgtagccagcagccttgctgataaatcagttagctattttaaatctctttaaaactttcaagttttaaaaagaactcgtgatactagtacttgatgttccagctcagcttttgtaattacaatgcatgatggtaatttcagagcataagcaacatgggataatatacaaagcagtgtacctaacaaccaagcaatacacagaaaacaacagaaacgagagattcttgctcaaaaaatatcagaatctgagagctggaatggcctattggtaaacccacagtctttaacttttcatttttgaagggggaaatgtccatattataatatggacatagatttccattttcaaaccaataggctagaagtttatatggagcggtgttttttgtgttttgttttttgtttttttttttaaataaagaggtgattgaatatagtatgaaaaatactaggccaagcgcgtggctcatgcctgtaatcc

SEQ ID NO: 113847 - DNA, 1090 bp, Homo sapiens
tctgtgtcaggctctacagaagtgcagagggcccacctgctgtggcctttggaatactgtgcccttagctattcccaatattttttttattgctctttctccgagagcttgtactctgctttccctgggttctaacccgggtctcttgtcttgcttgtggccctctgtgttctttccgggtgacttatttttcctcatgactgcatcagtcacccatgcaccagtgtccagcctttctcaagcccatattccatccattcattaattcattcaacaggtagtgacaacctgagattttaatctaatgaagggtcaaatgtgcaaaaagataattatagcgaaaataggaagttatgagtaaagggtggtgagaaaaggagtgtctggggctaccttgggagtcttggagggcttttgaaccaagacctcaaagctaggggtttgccagatgtgcaaggtaaggaagggaacgtggctggaggtggtgccgtggggaactactgggagttgaggaaagagaacttgctggggttggggagatgggaggaggaggctccagagatgcagtcagggaggggaatgggaggagggaggggggagggggaggctccagagatgcagtcagggaggtggatgggagtcagactgtgaagaatcacctaggtcctgcgtaggacttgagtttcacactgttgacacaacgaagacatggaatatgttttagatctttcagagtcagctgactctagtaatgacatggtatgtggattggaggcaggcaagactagaggcaggtcggcaaggaaggagtccagtagagatgatgagcacataacccaggggaaacccaggatgtggcagcccaatattgaggagtgagaatcattagaactcagtgattgatatgtttctcagggcagggaaggaaaggggacattttaaacaatgtctttatagtgaaccagattctgtctcaggtacagcagaaatgtggaaggcccacctgtctcgaggatagtggggtctgagcatctctcaggggtcttcctaccaaaggcaagactttgcagcaccagagagactaacttcc

SEQ ID NO: 113848 - DNA, 1031 bp, Homo sapiens
atctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttcctgacacttgaaggggttgagccagttcctctcagttctgtctcctaacccgctccaccccgacccagccctcccacactaaggaggtgggg

SEQ ID NO: 113849 - DNA, 1032 bp, Homo sapiens
actggggaaggatctgttccaagcctctcttagcttctccaagctgcatgcattccttggcttgtggaagcatcgctctggtgtactcccgtgccttcacatcctctcccttctgtatgtgtatgagatgcaacctgagaaagaagagttacaacacaggacaaaggcatgcaagatattcgccatccacctacatgcactcttcggagcgcaaaacacagacaggagaggaagagaggcagggttcagatccacaaggatgtcagcagagagcgtgtctgcctgttcctggctggaacttcacacagtgactcctcatggtacctactatttgttggatgaaggaaagagtttggagtcagtattggtagggatactctgggctatatctttctttctacccatcctttggcacctcattgcttcaggttctggaatctgatatccatgtttgagcagcacaatgaaagaagaaggtaaaatatttactagaaagtaaatggggatgcagggcatgggatctgtagtaggaagattcctcttgcctctagaaggagaaaatacaccaaagaacttcaaatgcgtatttagacacaagtgaattggaataacctaaattgcaagtatttattcaccataattgaacattttgcaactcactgtcttttctgaaaacaaaatgcagtagacatagcctttaagtaatagatttctaacttcctgatgtacttccaacctttgcttcttggtatctaaaagtttaactaggcacatcctgcaaactacttcttggctcctgagacataaaattcatcttggtctgatgaatactttcttccagttttatttgagaaattccctagaagatatggataattttaaaagtctgagaaacgaaatcaaaggaaatctaattccacaaagaatgctgagtctaaaaaataaattataattctggaagattgaaataactctttgaaagacaatatccccataagtatacatatatctagaatgtgtattcaaataaat

SEQ ID NO: 113850 - DNA, 1031 bp, Homo sapiens
tagttttccttttaatagaaacatcagccaggtgtggtggctcatgcttataattctagcattttgggagcctgagcctggaggattgcttgaggctagaagcctgggcaatatagcaagaccttgtcgcttataaaacaaacaaaccaaacctgataagatattctttaatgtgagcaaggtttgcaagtagctttttcaactgtgcaaatgcccaactccttctacaagtggaacccttgatttaaaaccaacccattgattctagttattaaagtaaaacaatagtttcaattcctaatgtagtatgaagagacccctttgaaccatttcacagaattttaagaattaatacttgtagagaagtgatatcatgacaacatcaatgtagtatctttatgcatctgtgagaatttggtttttaaaaaatatattccttagaaagcctaaatagaaaacaaaacaaaacaaaagaacagtaaggtacagttgtacattgcaaaaaagaagtccttaagtcatgatgcgtgaagttctctagaagttcttgtcagtacttactgctgtacttcaaattttttattctgtagatatgaagtaaatattttatatactttttattaacatttattatcgcaaaaatagttcccttacaaccctagcataaattaaaactatcagtatacttaagtgagtcatgcaagtgtcattttgccaggatatataaaagatatctgagtaatgatatttagaaatggaaaatgtgaaaatagcatcattataggaagattccaaatctgtttagatttataggttatggtcatttatataaacattttaaaaatgacaggaacagtctaattacgttaagtcaattaagttttttttttgcttgattgtttaatgctcttatgaaaaacacatatttgtaaaagaaattatttgcctagaaaaatttaccatgcaatatatttcatcatattggagttccttttttttttttttttttgagatggagttacactgttgtc

SEQ ID NO: 113851 - DNA, 1034 bp, Homo sapiens
ttctgacctcaggtgatccgcctgccttggtttcccaaagtgctgggattacaggcgtgagccactgcacctgcccagttctttgttaatgaaagcctgtgtacctggaagtcaaaggtatactttgcatagccatttcaaaacttgtcttaggtattttctaaaatgtttgtctcattggatataggttttgattgtgcttacttgagaagacttaaatctttacccttctcctggtagttttcttctggcagttcagtattttgccatgcaatttttattagacaatttgatcattgtgtttcttattgcctaatccaacagatttaatcttttaatctcaaatacagcaaggtgtgctgtgcctttacagtctgtttgcagagttttacatcttcgtttgaaaggaagtgtttaaacacccctgttcaaaaatctgctagttcttgccaggatgatttaaaatgaattttaaaaatccattagatttttggcaaataagctctcaattatggtacagaataaatgactacaaagtgctttttagagtaatggaatagaaatgactgaaattttattactttacacatgcagatttttctactgtggtagatgttcttaaactaaaagattactgtcaagattggaaatttttatcacttaaaatatataattatatttgaacatttaagcagaagattgctggaatggggatatacaggcctgcagtttcgttaactgttgctccctgtgtgatggcctcagaggaaattctaagtccagtgttcgtcaaagaggctggagaatgtttcccttttagtgatcagtgaaaataaatttgcttacagtccagggagatcatggtagtagagaaaaaaatactttagtaaataattttctaaaattctctattctaaaaatatactaagaaaggatgatttttaaataccttggtattttaaagaaatacattttctgtatgaaattaagataactctattcctcttcttatagctaacatttagactctaaat

SEQ ID NO: 113852 - DNA, 1091 bp, Homo sapiens
cggccgggcagaggctgcaatctcggcactttgggaggccaaggcaggcggctgggaggtggaggttgtagcgagccgagatcacgccactgcactccagcctgggcaacattgagcactgagtgagcgagactccgtctgcaatccctgcacctagggaggctgaggctggcagatcactcgcggtcaggagctggagaccagcccgaccaacacggcgaaaccccgtctccaccaagaaatatgaaaaccagtcaggcatggtggcgcccgcctgcaatcccaggcactcggcaggctgaggcaggagaatcaggcagggagattgcagtgggtcgagatggcggcagtacagtccagcctcggctcggcatcagagggagaccagggagagggagctcggcatcagagggagaccagggagagggagagggagggggagggggagggggagaagtgggcttaatttaaaattgccttatatatgcagtgatgaaaatcaaatcaaatttaaattactatatggaacaacttcctgataatgtaaaaaaaaaactgatttaggagagggttttcggtactttgaaatattaatattatgaaagttgaacactgatgtttcaatctgcttcactccatccccattacttcttgtcagctgtctatgagcattgggccacttgccacagttttacatgataaccatatttaagtggtaaaaaagatcagaacatatacagtgccttcttaagtcaggttcctgatttatttctggtactatccatttagatacatattaatttacctaatttcttaaatccatggaccagtactgatattcctgtttgtctttatttaggattttacatgtgtacgttaaaaaatacattggtaacagctgactgacaaccaaaaaagtaaaaaagcaaaacaaaaatcaccgtgctttgacaggtttgtcatgaagcaaaatgcatgagaaatttgatctgtttcagtttgcttgttatcagtcagaaatcacctttgctttgcccagagaagactcaggttcactgaattctcttcaccactccgtgaaagtgtgtagc

SEQ ID NO: 113853 - DNA, 1047 bp, Homo sapiens
ttcaagagtgctttaaaaatgaaaatacttaagttctgcaaacttattatgaattcattattttgaattgtaagtgaaggagggctgaatattgtcttttctcctggacttttagacttttgccttaaaagttatatccttaaatgaacagtgttctcaaatggggaaagaggaaaatattattgtttacttacttttttttttttgagatggagtcttgctctgtcaccaggctggagtgctgtggtgcaatcttggctcactgcaacctccaactccctgggtctcctgccttactctcacgagtagctggcattacaggtgcataccaccatgcccagctaattttttaatatttttagtagagacggatgttggccaggatggtctcgatctcctgacctcgtgatccacccgcctcggccgcccaaagtgctggaattacaggtgtgagccaccgcacccggcctacttacttttaaaatacatttacattaagaaaaaaagaatgtatgttcattgtagaaaatattacaaagttaaagcaagtaagaaacaaaattatctacaacccatcctatccaaagataattatcattagctattggtgtatttcttgcctaaatatatgtactatacatagacatagtccacagtataaataaactctgtggattgcttttttaatttcactgtagaaatattttaattgttgttaggatatgtatagatttgtaattttttttaaccatctggtcattttagtattgagatggtttgaggaaagaggacattagaaaaaaaaaaaaaacctgtgtactgggaattacagatctgaaattgtcatatacaccacatttgcaaaattttttcacctgcccttgaaaaaaaccaaggcatgattttgaattttataagatggtctattaagattgctgaaacttggagtgctttctggcaaaaccagcaattaaatgaagagaaacagaagccatcactagaagagcaactattttgtggcagttacttgtttcactatctcttccc

SEQ ID NO: 113854 - DNA, 1007 bp, Homo sapiens
gcatcaaatactaataagtaacttatactgaactcttaggtatgtttacattcttaatttaatcttctgacattttacagttgaggaaatttgtggcttagagaagttaaattaccttgcccaaggtcacttggtcttctaggtaacaactagagttcaaacctaggctgactgcagagcctaccttttcaggtgggattcagtaccaccaagtagcactttctgaactgtgttctatgaaccaaggtgtattatcaggcattactttaaacaggggttttgggccagtaaggttgataagtgttgcatattgtatcaccccctcagagatttcacggcatacattggtacgttaaaagctttgaaaagtactatagaaaagaaacttcagcattttagcatatctttcacaaactgacctggtcactgatccagtttttaaagaacatccagttttctttaaagaactttagtgtcctgagagaagagaaagcgctgtggacagatggacctgtcttcaggggaggaatctggctgcctctgctcgctgaattctgccttgaggccttcctttcatgttcatgtgcagcatggtatcatccagctgtgtaaatcttaccatccttcaagatcagttcaggatctacctgttctctgaagattttcctgaccacttgagtccataccgatatatctgacctcagcaaagttcctgattatgattgatggtaatgctctttagcacgtggctgtttccccagttggttcctaaactcctcaaaagcagacacaccctactttatattattcccctgtccgctgctgagtagcccctggccttactgccctcgagggagaggttaaagtgttccagtggtttttgtttggtttacaaatactcttcgtctccctggtcttgaaccccggttgagacctgcagttcattctcaatcctcaaacttgaggtgctcatgtgatcatcttacactcatatcagcacttatgct

SEQ ID NO: 113855 - DNA, 1034 bp, Homo sapiens
caaagtgttgggattacaggcctgagccaacactcctggcctccttcttttttataaggatgtgtgcctcttcacatagagtgctgtgtaggacttgaacttctatctcatgaatgtctcatgttggcggaggtcatgcagcatgattctcattgcttttaagtgatggataattgagtgattaataattgatttcactgcattctgtgttttttgcaccttttaaaaaaaatcgcttaagctagggtttttgtttctgttttttaaatgctaccccaagtttggttgtgttctcaagtgaaaaacattgctagctatgccgtgtgtgaactttcagcctagtcattttgtggccataaatattgtttctatgagcctcttttcagctgtgctagtcatgtgttttctgtttgttccttaaattatgtaaaatgacccctttggcagccaacaaattttatagcttactatgataaagagcttccttatggaaaaaatattcaagttatataaaatgttttctagcaggtcaatttttttctgaataaatagttttaaaaacaaatttaacaggaagcttaacaattttttgaaaatttgtacaagcagtgctcaatgtagggaataaggaaaaccaagagatgagaaaaattaacacccaaaagctcatcaccagagaaaactgcttttactctctcttcttctagtcatttctatgccccattattatttttgcatatttgaggtgatgtggtgtaaacagtatgtatattcaatgtgtatattctacttcttcaaactaatattatatataaagattttctacaaaaattattttttgaacgttttataattatatactattcagttgtgttaagttcagttagcataatttttctaactgttctcattaagggcattttgtttgtttctagtagattggctagtatacaggctgcagtgagcatttctgcataatgtctcttctgtaattagaattgtgtccctagaatatattcacaggtctgaaattt

SEQ ID NO: 113856 - DNA, 1163 bp, Homo sapiens
tgccaatgttgagaaacagtgtcttgtgcgaagaatggtactggcttaggaaaaaacttaacaaataatacctcagaagcaaaagcactcaggatatctgactggaagatctgcataggtgatgaagacggcccaaacagaaaagagaggcaccctttactgtgaatgaatatccttgtacaaagaatctgttttgacccatgctgcttctggaatggggcaaactagatatgggggagtggtttaaaagcccgagctgacttagttacagatattagctttttttatacttctgatttcagataaactctcagtgagtaaaaaataccaaatcgggactctgcatatccccgccttgttcctctgccatttggggcactgagccagcctgctgacagtgacatccatctaataccactgccaccatatggttgtgctaccgacaaaaggttatatttatcacacacggtacaactgggaaaaccacatactgtacaaacatgacctattaagcatctgttttaatcaaagattctagaacttctttgctctaacccttaaaaatatgctttattaagaggtctttgatagagaagtagatttgtaaagggagaagtaaaaatgcatcctttcattaattttgaaatagtaaggcgaggagatagcctatttcttggtatttcttctctaccctgaaagatatctcctaatgggaagtcctgattaatggcccgcttgtattccaaactgttttattgttgcctcagcctttttcaaaacctgaaaattggtctcatgagctctactgtggtggtttgccttcatgtactcattgtatatcccctcccttttgtataggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctgg

SEQ ID NO: 113857 - DNA, 1038 bp, Homo sapiens
ttgtaaacaatgctgtgaggaacccgcttatggctcagtctttgtgcccatcattgattatttcaagaggacaaattcctagtggaatcactaaatcaaaggattaataactggttccttttacttggtagtgttttgtcaactctggagtctctcctctgctctccatccctgtccctcactgcttccacttcatacagaatatatttgttttgcccttttccatttttctctttttttgtctcctttggtaatggtctccccctgtatatggactatctgtagaccattagaaattgagggactctcaagagagaatgcaacaaactgatactatttcaagatgacagttgaccatagcttacatgcagtgttcacatgagttaagtcattgggttccctgccagattttaagtgaactaaaatgttttctaaaattttggtttgagattttctggcatctgcctctttcagagtgagaattaacataccatctcagttgttataattccatcccatctttgagccataaactatttgataactaacttcaactcactcttcgtgactcactcgcctcagaaagatttgattttctggaaaattacaatgaagcagagatgtaaaaagataagtaaagataactcaattgattccggaaatgaggtagactaccgcaataattttttgaaatagtattaccaaattttctcctttacaacgtttttaaacatctcatatgtatcaattatatgctaatgaactacttgtttcctaatatctttaacaagataaattactaagtgtagccaacatatattcttactaaccccagaaaatgtctgttctgtgagttaataaatgttaactgttgtatattacatactcttttccatatttgttttacagtggagagggtcttcaaaaaacgatctagtacatctcttcattttgctatagggccattactatcaatgtttaagacttctgtaagtaaatattacaacctgtcttgcaaccaatcctgtaatatctaac

SEQ ID NO: 113858 - DNA, 1027 bp, Homo sapiens
tctagtttcatcctgaaaggcagacccatccattaattccatgagcattgattttgactttcagccttaaatagagcaacaagtaaacattttttattccccttttcattaatatttaattcattaatgaggacagtgggtaatgttctgtgatatagtactcgtgtgacaaaggagtagtcccaggaaaatttttggaatcaaatcaacaagtatgtattgagttttgacataatacatgaaaatgctgttttggctaagagcagaacttctgatgattagttttgctgacattttaatcttggagatgataaggtagaattataggcttaattttgaccttcacagggattgattgataataacattggaaaaaggtaactaggttatcttagagtctctattagccaaggaaaagaagagaaagtcttcaaggaattgaggcattgtttgagaaaatgattaaataaaaaactataaccacagttttattttgtctagttaaaataaagaatatatagtattatcaagaaaagaatagtctacatgggggttagaataagggaacctaagaaaagatgtgattattgtaccactagctatccatcagagagggagcttgagtcagtcagtataaatttagtctgttcagcacaccctattgtggaggaggaagcagggagcttcaaaactgtaaggcatcagccattaaaacagattctgtgtttgccaagcaaccttctcattgtgaccagagtttgcaggcagagtttccagtgatgactaggttgcatgaaaattttttttttctcatttcaaacagtattttatgtatcagcttcttgtttggtgagcatgtgtaattctcttaagtttaattaattttgcatatttataacaatttttaggaccttccaagtagtaccatctctgtctctagcttaccttcctgtaacttcaacaatgaccatagaggaagatctccaataatctcaaatttaaagagacgatagatagattgattgat

SEQ ID NO: 113859 - DNA, 1813 bp, Homo sapiens
gagtaaaccagttgttgctctcaaggaacttgataagaagatattagaattatacttaaattcataatacaagaaggcagaatggcattcagttggtgtgcttaaaaaaccgtcggccaggcgctcatgcctataaacccatcactttgggaggccaacatgggcggatcatgaggtcaagagatcgagaccatcctagccaacatggtgaaaccccatctctactaaaatacaaaaaattagccgggtgtggtggtacacacctgtagtcccagatactcgggaggctgaggcaggggaattgcttgaatctgggaggcggagattgtagtgagccgagatcgcaccactgcactccagcctgggggacagagcgagactccgtctcaaaaaaaaaaaaagaaagagcgagcgttatgctagatgcagaatttgcggcagaagtaggaagatgggtatgatgttagtaagcacagataagggatgggagggggacttctaagcaagtagcatggggaaaagtacaaagaagagaacacaaggaacattcagagaacagcaaggagcaaactttggcagaatcaagcaacatgaataaggaagacatctaagaagataaaatgggaaggtgtattagggccatattgaagagagcctttaaagctgagttaagagatttttatttaatttgataagcagtggagaacgatcaaagatattaagcaagggaataacatgacccaaagctgcccttcacctataataatctcttgctataaataaggatagttgagtagagagaagccgaaggtgaagaagccagttaggagtttattataataatcacccaagtaggaaatatattagcaatggaaatgattaatgagttaggaataaagaatccacatgactttgcaaggttatattgggagaaagttgctaggggctatgagtacacagtaagaggccccttagtagcagtttattattaatactgtattccctgttgccttcttggttgttacatgagcttttaaaagcaaattattttaggatttgtttagtttaagaattctgtgtggacactgtatataatttagattttagatttacacttacaagataaattttcagttatggtttatgtttgtatttgaaacaactttcacaacgtgtttttccttcatagatatggcagtgtggtggcaaattattatttgttccttgttctcgtgttggacatatctaccgtcttgagggctggcaaggaaatcctccgcccatttatgttgggtcttctccaactctgaaggtgagttttttggataaaaggggaggacagggaactaacatttatgtaccacatgctatagtagttacttaacaattgtcagcttattgagtgggctcttcagcagtcatgttgattctcacctttaacttagctagacttattcacgaaatatcttattgttctttaagattattcagctgaagcaggaggattccttgagcccaggagttcaaggctgcagtgagctatgattgcaccactgcactccccgctggatgacagaacgagaccccatctcttaaaaaaaaaaaagattgcaccctatttttttaattgacaagtaaatattgtatgtatcttgtacaatatgatgttttgatatatgtatacattgtggggatggctaaatctggctatttggacatgtattacgtcacctacttgtttttgtgctgagaacacttaaaatttgttctcagcaattttcatatatgtaatatattataaattgtagtcacc

SEQ ID NO: 113860 - DNA, 1604 bp, Homo sapiens
ctactcgggaagctgaggtgagaggatcacttaaacccaggaagttgaagctgcaatgagccaagattgcaccactgcaccctagcctgaatgacagagcaagaccccatcacaaaaaaaaaaaaaaaagaaaagaaaagaaagagattattatagggaaagaagtacagtgtccagccaagctctcataaactctctctgagattcaatttattcttctgttagcagaatagaatacattatctcagcatatatgatcttccagctcagggatatcaggttttgtacaatactttttacttaaatacacatgatattttaatccttggcagatgacatattagagtcattaacttgcatttgttgtttaattaaatgccaggtcctgttgaaatgaatttgttatgtgtaggccattttcatgtgtctaatataggctgtttatgatatgacatttgtatttttataacgatatatatatatatattttttttttacagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaagtaagtagtcacatctcaaaatgtatgtgtttgtagactgagtttgggagaaggcagagagaggtggaaatatgtaagagggaagtattcttggggaaaagttggggtaaaaactgtctgataggatctaccacctttccactaaacagctatagctgccagaccagctggccaccatgctgtctcctggcagcctttgctcattggccccctagcctgcaagacatccactcttcactccagctcctggcgcctccatgcctcttactccaactcccttccttaactaatttcaatttatcttactgctctcaacttagagatcaccaatactgaaaagcccttcttactattccccacttcatcaaaaagatgcagttctatgttctttccaggggttctcacaacacccaaaatcacctatctcccaaccagtctgagtgcttcaggaccttgatcacttgtgtccaggtggactgatgcagggacccatatacagtagatactccaacaatgcttttcaaatgaattaaaaataattaaaatcagacaaaagcactttgacaatcagacattgtcatttctttgtttattcaaacttgtcttcagactcacttctgattgctccctgcagccccgctgtatgcctcacaggtacactaaacctgccatgaacgttcaagtctacatccctctgcttaattatgttcagcaaatattggttgagggcctactatgtgccagtcactcttctagacagaaaaccagagaagcaaagtcgtttttctcagggaactggcatgctacctggggagagagaccaaaaaagtctgagaaaacaaaaatgataatgacagatggtgataaatgataatgacacataat

SEQ ID NO: 113861 - DNA, 3064 bp, Homo sapiens
cagataatgaatttaggtttgtatacattgagtgtgagataccagcagtatattgtgacttaacaatgaaagatcttaggacttagaaaactgacaatcaagagaaatccagaaaactgacaatcaagagaaatccaaagtctgaggtgtggttgagaagcttttccatttccttaaactgtctcctcatgaaagtcaagtgatgatttctgatgtcagtgatatcaagggtccaaatttgaaacttttttcttactgtgttttccagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattcatgggtttttttggtgcttgtaatcatttcaaatctaaacactgcacatttgaaagaattacttgattttactatttacaagacacacaatacctaaaatattatagaccatagttattagttgagtatgtgcttgactgttgcttagcattctgttacacatgcttagaatactcagagcttatgtatctgttggaaggaaacaaaggtttatttttacctgtttgcctatgtataccaattttttaagtttatactttttttaattataaaaaattaccccagcaacatatatccttcttggctgtatatagaattgccttcttggctgtactatagaattgcctattagaagcaaacatgccttcaaatcaaatttgtttacaacctgacagatcaggttaagtgg

SEQ ID NO: 113862 - DNA, 1058 bp, Homo sapiens
ttatatatgccttacagctaaccattgtttttataggtcagaaacccttcttgccctgattggaaactcaacttaccctgcagcaaaggtaaataaaaatgtttcaattgaacttcattgtgctcctgggcctttattcttcaagagttaacagtgcagacttctggtgatcctcatcctaggtgttaccacatctatagaatagtaactcaggagtgcaatagactgtcgcattaaaaggaaagaaaaataacttttcagcattatgtagcactaaattttggaactggaaatggcctttatatcatctagtctttcattagaaaagcaggacaatcaacttggacattgtcctcgggcagataagagatagtaaaataccataatccattcatatttgtgtaattctttgattctccaaattttttccaaaaaatattaatggcttatacaaagaaaaacaagaacaaaatatacaaagaaaaaaacaaggttatgaaagaaattaaaagcaaggtagtgaatcacggatttgaatagggctctgtttttcttactggttttgtaacatcagacaactcatgtaacatttcggtttcctcatctgtaaaatttgaatgtttttgaggattaagtaaagtaatacatttaagacacttatcctggtggcaagaaatagtaaatgctcgataaatattagctaaaagtatatatgccgatatacatgggttaatacagatactacgatggagtattagataaagttctagctcactgcagccttcaccttccagactcaagcgattcttctgcctcagcctctcaagcagctgggaccacagatgtgtgccaccacacatggctatgttgcccaggcaggtcttaaactcctggactcaagcagtcctctccccttggcctcccaaagtgctgcgattacaggtgtgagccactgttccagccctgaggttcttgatagtctaggtagagaggaaaattaaagaagttatgtggaaaacatacattctttaggagagtttttcctggcaccaaataaa

SEQ ID NO: 113863 - DNA, 1974 bp, Homo sapiens
tacaaaaattagccgggcatggtggtgcatgcctgtggtcctggctatttaggaggctgaggtggatcacttgagcctgggatgtctaggctataatgagctgtgatcatgccatcgcactccagcctgggcaacagaccaagacttggtctgaaaaaaacgaaaccatttgatgtcacatgtgaaaaaagacctacaagtgaagtaggtgggccaaaagacatgcacatttaaaaatgtgctaactatactagctaaaacctgtgcttaatatatgccagaaactgctctggtgctgttaatggagcctgctaaacaaaactgcttctcaacaatagaagttgtactacgctatggagtggacactccatagcaatgaaatgttttggagtgcctgtttcctcatctcagcaacataatagttctcaaacttcttagtctttgttattctgatatagataaaatgttttctattatgagtttcattttttttttatgtttaacagccatttgtggggctgagtgcagtggctcatgcctgtaatcccagcactttaggaggccgaagcaggcggatcacttgaggtcaggagttcaaaaccagcctggccaacatggtgaaaccctgtctctactaaaaatacaaaaacattagccgggtgtggtgatgggcacctgtaatcccagccacttgggaggctgaggcaggagaatcgcttgaacccgggaggcagaggtttgcagtgagtagagatcacgccactacactccagcctgggtgacaagagcaagactctgtctcaaaaaaaaaaaaaaaaaaaaaaaagccatttgtattctttcctgtggtcttttctcactggtctttttattaatagtttttgggaatactatatattaaggaaaatgacccttttgactttatgatgcttttttcatgcagagatttctttatgtaggcaaatttagcaattctttcactaaaacttttctagtgaggtccttcccactcaaagatcataaaagactataaaaataattatcctttggtttctttttttaaatttttgattacatctttgatccttctggaattaattttggtgcaaggactgaggtaggggctcacgtttccttcccgatgtcagccactacttttggtcttttaatctataaaagcagggcactgggttagaatttcctaaattctcttatatatcaaacaaagcactcactgcaaacttgatcaatagaggaaagtatgctttttttgtattttaccttttaccagtttcacttactgtaaatcataaggttgtcttacatagtagaaaaatagcattatcttaaacctggctttttattactaaatatatcactaaaaatgctttacaaagcagtaatgattttatttcttggggaataaaatcaagaaagctaaaggagctgctatgccactgtgtaagatctagtcctttaaaaatgaaatttcatacctcaccatgtttggattagttcttcatgagattcctgttggagactgacagttttagagaaaggcagagtatttattgacattaggaaatgccaagacctatagagactagccagggaaaaggactggatgtggtgaagtgaagaacattttgaaagtaagctctgtgagggcagtaaaattttcacttttgtatactgctttgtctctaatgcaagaaacagtgttctaagcatgtttgtaaatatacaaatacccaggttaaaggggatagccactgtttagctcagtcctgttgctagatggaaatgtgaatataggattcccagatctctcaaattttcaagtggaactagaactcgtgaattctgaattttaaatacagtattggcaatgaattccaattttggggtcaaaacatgtctataggtaagattctgcccaaaggtcaccagtttgccacttctataaattaaata

SEQ ID NO: 113864 - DNA, 2584 bp, Homo sapiens
cccgggagccacttgctgggctgagccgcggccgctcgggccgggaggaggaggaggaggagggtgtgcgccggggcgcgggcgggggcgcgggcggccgcccttgggaggacgccctcgggaggaggggggcgcgggcagggcgggagcggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttcttcgtgcagacctgccgggaagagcacaagaagaaacacccggactcttccgtcaatttcgcggaattctccaagaagtgttcggagagatggaaggtgaggcaggagagggacggagctcagggggtgcaggtgtggttttcggctaggagggccttaggcaggtagtaggcaactcatgagcttcaactttgccaccccagtgactcacctgaatatcttaagagttccaggcagacgattttaggtttttacttatataagacttcgaaagcaaaatgctgttaaggaaaatgtggtccttaaagatgatcttgtcgtctttggatgtttataggtaacaattttgctgtatttttggctcttattttatgtccacagaccatgtctgcaaaggagaagtcgaagtttgaagatatggcaaaaagtgacaaagctcgctatgacagggagatgaaaaattacgttcctcccaaaggtgataagaaggggaagaaaaaggaccccaatgctcctaaaaggccaccgtaagtttaaaataacccaaattgctccttggatttttccttcagtttattaaactctgttgcttcctttcagatctgccttcttcctgttttgctctgaacatcgcccaaagatcaaaagtgaacaccctggcctatccattggggatactgcaaagaaattgggtgaaatgtggtctgagcagtcagccaaagataaacaaccatatgaacagaaagcagctaagctaaaggagaaatatgaaaaggtacagtgtcatcttttttaaagccgtggataagactaggtataggtaataactgtagaaaacctgggaaatttagttaatcttgtattaatggttgtcagctatgttttgaaaaggcctaatgaaaattgtacacttcaacacaaggtaattgaaaccttccttttgactgaaaccagtgtttgtagcactagtatattcctgcagacagacttgtagttacttgtagttattgtatagtctgtatagtctgttatttttttttttaagcagagagtcaaagaaattgttttatgtagatatatataaaatgtgaaggtacaggagggactatggcactgtgtgtgatgtaaaagggtattggtagtgaaagtactgatactgctgtatcgcaacccttgtcattttacgtcattaacttgttaaagcctagtgggataagtgctctaaaaacttagactggttacctttttagacagttattagggttattggtcaatcatcttagattgtttacaactaagtggtttttcacagttgagtaatgataccggatgctttatttttttgacaatatttcaggatattgctgcatatcgtgccaagggcaaaagtgaagcaggaaagaagggccctggcaggccaacaggctcaaagaagaagaacgaaccagaagatgaggaggaggaggaggaagaagaagatgaagatgaggaggaagaggatgaagatgaagaataaatggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgtatattatttctattgtctttgtcttaatatgctaagttaattttcactttaaaaaagccatttgaagaccagagctatgttgatttttttcggtatttctgcctagtagttcttagacacagttgacctagtaaaatgtttgagaattaaaaccaaacatgctcatatttgcaaaatgttctttaaaagttacatgttgaactcagtgaactttataagaatttatgcagttttacagaacgttaagttttgtacttgacgtttctgtttattagctaaattgttcctcaggtgtgtgtatatatatatacatatatatatatatatatatgtatatatatacacatatatacgtatatatacatatatat

SEQ ID NO: 113865 - DNA, 1523 bp, Homo sapiens
atgtaaaaacatgatatgcacctcctgccttcaagaaactcctaaacaataatttttggtattacattttatattttataacactctctcataggcgttctttcttttgaaatttataactccatgcattaggcagataaaatttttacctgatgaagaagttgagacagaccctgctcttgtctctctggccattaccacttcaacattgatttcttgacctgagggctttctccaaagctgtggaaggcagctctgtccctatgtgatcagggcaatttggaaatgcctgggaattaacaaactcccactctagcagccttcaccaagtgactggaaagatttgttatatagataccccagctcacttggccttcagatgggataactttgaggcctgtgttttcccagagttttctcatgggattatgctccagtcattataagtggtatctggcttgataccgcaccctttattgactgttttcccttctttgtctcgcttccccacctcctactggtgtttcctgcatctcttagataaactatttgcaacaaaatccttgtctcaggtttctattgagcatttccactaggttatttcccctaatacctgccctgaaagtgcctggcttaatgaggggggcacacgattcaaatcaagccagttggaatccttcacagggaaattttgtccagtctgaaatactgagaaaggaactctcttccttcatccttgtttcattttggttttgcatcattctatttcgagtagtgtccggcacaacgtagaaacttaatctttctggaatatttaatgaatccaattcctacaatttctttcctgccaacttgcattcatcatcagccattaattttaaaatgtatgaaataatgttgctatagcatatcatagtgtcactgcatactgtagtagttaagtgcatggactcaggagctagactgcttgagatataaactctgccacttgccagttgtttgactgtgctggttatatttctgttgtctgtcagttccattctcattcttttactctctctatattacagagtactggaattctaaatatcatttcccagattcacttgccaatttctttccggttcagttctgttaatgggagattcaaggccaagaggatggaaggcatttttgcttttcttctggctccggcctctgcaatgctgtgctctactaccctgactccaggagtggcccgaatagggtgaaggatgcataatcctcaattatgcgtaagtgcattttttcagtctaattagaattccaggctttaaaattagatgtatattttgaaaagtatatctgaaaatttcatagtttgtgaatatatttttaaatacagtcaaaatactaagcacagtaacaacacgatttagaggacaaagttgtaaatatgccacctttatatttataagagtatttacacaagaatttgcagttttaagtcgttatcaatcattgagttgatataaggtcaatat

SEQ ID NO: 113866 - DNA, 1049 bp, Homo sapiens
gcgcggggtcagggcggagctcaggttgactctgcagcagagaactacaattcccatggggccgcgcggcagaaagaaaggggcgggacgggagggggcgcgtcgcgcttgcgcaggtcccggggccggagggaggcggaggcgtagcggtccaactgctgaagtccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgtaagtaaaccgcgggaccgccctgccctcccgcccctcggtggggccccaggagccgggcaaaggcacgggttgtcggcggggtcccccagacaaccgcactggctgcagtgcggtctcgtggagtctgtgtttggaagcaaataacaaagtcgctgcaactcctaccgccaccccaacacacacaccacacacaggctgtcgttcccctcttctttcccaccctggcccccaacctcccgctgcctgcgtctctcccgcgcagtcttccctcttccttctcctctgcgaccgggacacgaaacaaaggggaccggcgcactgagggc

SEQ ID NO: 113867 - DNA, 1044 bp, Homo sapiens
gcctatctaatttttgtattttttttggtagagatggggtttcgtcatgttgctcaggctggtctcaaactcctgggctcaagtgatccacccacctctgcctcccaaagtgctgggattacaggcatgagccaccacgcctggcccaattataaaatttaaaataaataaaaggaaaatatattttctaatcaatgtatattaaattgagtgggtcaaagggtcctttgaaatcacactatctcttgttcgtaacattttattcttgaatgctttctgtcttgttgatattttgttaaatataatttttaaaggaaatagcccttatcacatagcactttttcttttgatgaaaccgtattttttacgtagtttatgaaacctgttatatctaaaatttaatttccttaatttttcttttctttgtagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattatagttgcttcagtgtatttattttgtgaaacttgatttttcttttaaactgactaagagatcagtattgagattttaatgtaaagtccttcattttgtaatccttttttttttttttttttaaacttccaagaaattaacagggtaaggagaagtaacaaatgtagcacatttgcattctctgggacaatctgacttggaagtgaagataatctaaatagcattattttttaaagtgctttatagggctagcaaatttgaaaaataaacttctcttggaatgcaact

SEQ ID NO: 113868 - DNA, 1036 bp, Homo sapiens
gatctcactatgttgcccaggctggtctcaaactcctggactcaagtgatcttcccgccttggcctcccaaaatgctaggattacaggcattagtcaccagtcccagcctgaaatgtacttaaagttattagcatacataatataccctcaaatattgttcccttttccttttttttttttttttttttttttcgagacagggtcttgctctgtcacccaggctagagtgcagtagtgcaatcatagctcactgcagactcgaaattctagattcaaatgaccctcttgagtaactagaactacagatgtgggcacccacaacctgctaattttttaatttttttgtaaagagggggtctcactatgttgcccaggctggtccctttttccttcttactagaaaatttctagctcccttccaagaatctcagcttatacctggttctttcaatatgtggttaataactgtcaactaaggactgaaagtattttcaatccttgagccatgcctatggctcttcatctgggggacagaactctttaactgagtataatgaacacctcatagattacattttctaggcaaaatttttaaccaatgccaacaatgtccacagagaaaaattagattgaattaacttttattactacttgtttaacacagatttacttgtcttagacaagtaagaatttatagaatctatgctctattgcactatatagaaactagaaatgcagttatactgatgtagtgcagtttgtgggaaatcaggaatggtgttctccagaatacatgaagattctcattgattgttgcaaggaatcacgaaagagatctttggtccaaagaaaacgtctctgaaagaaaatagagcatcaattaaattcaccttaaggctaagatattagttagtctattctaggttaaaaatagacagtgatttccaggatttcagttatgattattctttttaggtgactaaaatgtaaagagatgagtgggaggacttgccacagaagcaacaaagaccgaga

SEQ ID NO: 113869 - DNA, 1029 bp, Homo sapiens
tggaaacaattagactacaccgtgcttatggtgggcagaaaatagaagacacttctggcacatttaagaaaacttactatccccacgcaccccgcttcttcccctgcaggaggtttattgtaagtctctactttgctacaaatgacaccctcctaaaagctgttgggagtttgggcagatccaccactcatagaattagggacatcgcgaagatgtaacttaagctgcttatcagaggctgagtggcaagtgcttaaagcaattcagagtcaggcacatctgggttgggtcttggcttctggactgactttgtggtctccagcatgttgacttcctcctttatacctttgcaaaacaaggatatttgtcacatatcctcattgctgtgtgtttgtgtcttcggaaattctattttcttcctaaaaacttgaaaagccatctcccctcaacactcaccatgcatggcgaggtgtagcttcctaggccagctgtttacccttgcaacactcccctccccaccccaagaccctggactctgggaacttcacgtccttctctctggtcttacaagtgagtttttgaatagctttgatctgcaatctctgactttggtggacaaggtctgaaccttgagttctggcttctgctcttcagccagttctattatcatccagctgggaagtccacgtccaaccctccccacaagtgatggtccctgaagctggccggatcccaagcaaaaactccaagatgtagctggaacaccaccttctcctgcccacctgctgccagtcctcatgtatatgactgggggcttgggagtgggaacgacacagggtcaagctggcctaaaccgagaggtggacacctgctctagctgtgccagagccctgggacgtacccagggacctggtcggtagggaaccacctgagcttgaattccactgcccctccctgagctgagaagggtttgaggtccacgggtgctaggtgctctcagagcacactccttcttcgtgagtcccactg

SEQ ID NO: 113870 - DNA, 1036 bp, Homo sapiens
attcttccatgcatgtattttacttttttgtataatttttcttcttccagtttcatcccagtagcccaccccactcctgcccaaatcctattggttatcacaagctagtgcagttaaaagaattgcactgtagaactttcagttatctgacattaagtgcctgttcctctacctcataaccaatggtcatttgtatctttctaaagggagaaaaacgggtgttttagcaaaactgaggaaaaagtctgacatgttcaatggatggccaagctcaatttctatctttcacctcttgttcaggaaagaaatattgagtgcattgagggaccagtttagccttcaaacaaaatgcaaaaatgtcacagagcttgtttgcaaagtttctattgaaagcagtaagtgggctgttgccagtgtaatgaaccctgatccaaaagtattcaagaaggtttaaaaaatgagcttcactttcaaagacaataaaagtaggatagatggaggttgcacggtgagggaggaaatgggcgagaaaggaaaatatttcaacttttatgccttttgatcctttgctttaccttacccatcattgtatcagtatttggaagtgagagaaagctgtcactcagatttttgtcatggtttctccttttgttttactaggaatgttctgctgttacacactggaaatatttatagtagaaaaacattccgacatgtaatttgaagtataaatagaattaaaataaaagagtaaaatctaacatatgtcctggttgaacacagatttacttttcacttgcttttcatcctaccattttttgggttcactttatcttttttatattgtcttttaatgttataaaggccctgtccttcacacccacctttccagtttattctgtaacaaactgataatattccattaaaattagttattataagaaaatgactttcataggctttaaattttagtttttttttcccgtccagagagagaaaaaactaacaaactattcattaatggaattctaatttg

SEQ ID NO: 113871 - DNA, 1385 bp, Homo sapiens
ttagtcaaaagtggttgtcaatattacaactggaatgttgtactacagatttttcaaggacaagacatacgataatcaaattttgaatgtctaagggacttttagactgatagtaaataatttctaagattctgaagcaaatatccaaatcatttttgcatgtgcacaattttgaattccatgacaattctaatttttaacttcaaaactgctttattacatttcaaaagacaaagggtggtgataactattatttactatcatgcctagttttcagtgattaacactttgccctctccctctgtctacctccttctgtctttccttctttgtttttcttcatacctgtctcttaccatccagttctctctgcttctgttttagcttatatcttttcctttttttgtatcctcaatttcctaactttttttctttttcctattttatttttctaccctgacttgattataaatgtggattggcaatatttccttttccaacattttcttaggaatatttcaaacacatagaaaagtggggccaggcacagtggctcatgcctgtaatcccagcactttgggaggccaaggtgggaggtttgcttgaacccaggagtttcagaccagcctgggcaacatggcaagaccacgtttctacttaaaactaaaaaattagccaggcgtggtggtacatacctgtccgtagtcctagctactcaggaggctgaggcaggaggatggcctgagcccaggagttcgagattgcagtgagctgtgattgccactgcactccagcctaggcaacagtgagaccctgtgtcaataaaatttaaaaataaaataaattttaaaatagaaaagtggaattattttgcagagaatgcctactcaccacctagattctacaattaaaattttactgtattcactaaatcatgtttatctattcctctatccatcaattattttgatacagctaaaaataagtttgagacgtaacttccttcctaaagacttaattaaacttgcaaatcattagctagagatcatttttttagcttttttttttttttttttttttgagacagagtctccctctgctgcccaggctggagtccagtggtgcgatcttggctcactgcaacttccgcctcccaggttcaagcgattctcctgcctcagcctcccaagcagctgggactgcaggcacgtgccaccacgcccagctaattttttgtattattaatagagatggggtttcaccgtgttaaccaggccaggcacagtggctcaagcctgtaattccagcactttgggaggccaaggtgggagaactgcttgagcccaggagtttcagaccagcctgggcaacatagtaagaccaca

SEQ ID NO: 113872 - DNA, 1047 bp, Homo sapiens
tttttacttcagactaaagctacccaaggacttagcagatatgggggttacatcagtgctggtcattgtagcctgagtatacaatcaagcttcagtgtgcaacctttttttcttttgccattttctattttagtaatttccttggggaactaaataattttgcagaatttttcctaattttgtttatcacgttttgcacaaagcagagccactgtctaacacagctgttaacgaatgataaactgacattatactctaaaagatggtgtatttgtgcattagatttgcctgaaaaactttatccatttccattctttatacaaataccatgtaatgtgtacatatttaactaaagagatttatagtcataattattttattgtaaagattttaactaaagtttttccttttctctcaaactgagttctgaaatttatttgattctgatctgaaactattgtcttcgtaaaagttagatctgacttcagacagaaaccaataccagcttccttttcctttaaactttgaagagtgttgatttgttactatattactatgcaaaactggcagttatttttataatataaatttataatttgattttttattttaaaaactgggttaatcaagtctcggtaagtcctttaaaccatttaggatttttaaaacatcaaaatttatgatttacattcataggaataaaataaaatattattagaactctggtaaatgtttgcttgcttatatgtggtgtgattatgcaaactttactatttttgtaatcttgatgatccccgttcagagtccattgagaaagacatattgtgaagaacagtaaacactctttactcattggttcagtgaatgtctatccagggctttacatgtgttaacattgtgcgaggtactagacatgggccctgctctcacagataatacataactgggtactgagaagaaaaaatctgctgaatggagagcaactatatgaagtatatcttaattaacaattatttaatagttaaaatatgcagcattagaatgata

SEQ ID NO: 113873 - DNA, 1173 bp, Homo sapiens
agggggttgtttttgtatttttcccttggttgaattatataatccttggaagtttacagcatgtcttgaaagtcagctggaagctttgtacacgtagattcaaacattcattcaacaaatatttattaagtatctctaccacttacaatttatgtaatgttggctctgagcaagttatttaacctctgtgcttcagtttccccatctgtaaaatggggacagtaataatacttataacagtgttcttgtgaagattaaatgaaataagacatgttaaacatgcctctaagtgttcaccaaactgtaactctatgtttatactaaaggtacaactacaacaacttaaaataccaagaaccaggcactgttctaggccttgacgttcttcctcttcttgaacttttggattctagtagataactatatgacacctgacgaatggtccttcatgaagtatgtattggtcacatcaatatctcctagctttaaatgataccctttgtctttaattgtattttctgacatgtatatgcaatcttttgcatatacagtaacattttgtttcagtagtgctgctgagtttaatctttttgacatttaagcaataattaggggtccagagttatgttaaaattaaaatatgtgtcttggctacaatgttggcaggatgaacagatacttacgttacatgattaagtatatacatgtgctagcagtgaaactaccatgtaaatcccaacttgcttgtctactagtagactttttttaaaaatgttgtttactttaaaactgtttcagagctgttaaaatatatttataaatgtacatattaagatctaggtaatatgataaaactagtatttatgggttagtcatttaaacagttgtatatatgcacattgcaaatccagtatttgtatgtgattcttataaagcaagaattctaaattagctagcatcattgttaaatgtgtcactttctcattagtttcaattattaatcataacctaatagagatttatctccatattttgattagaatgctttctttttctaatatagagacaggttagagatagagggggcttttccaagaagcgtgactcaactagcagcaacttttttgataataattacaataatgattgttacatttaattgatagtagtaat

SEQ ID NO: 113874 - DNA, 1095 bp, Homo sapiens
ggttagtgggcaggtgagtatgtgtatactgagaaggtgggttaggatatgctaccatgactacagctgattacagccactttaagtaaatagtgatacaattaagtaagaaccatataattaaaaataatgctagtgagaagtatgatacatttattttaaagtttcaaatagttggacaatggagcatttcttgaaaaacaaaccacagaaattgaataagcctaaaattcttagatttttggttgcatttaaataacacatcttaatttttacatttatttagttgccattttggtaacactttttatagaataaaattaacaggaaaaaaaccttcagggaacaaagtaatattgtaaatctttttgaattaaaaaaaaccaaaacctgcaaatggtatgccttttagtaacaaaaactgctcttgcaggaccagatctttaaatttaatgagtaggggctttttatgtgttcaatgtaccttgtgacctcttagtacttagctatttcccttttctccttagaaagacctccttgtggacttacccttcctttatttctctacatttgttgcctttaaattttagggatgtgattggttatcagggtttttttcttttttaaaaaatttctctacgcagtctgttctaaacttctttggtggtctattcttttggaagtgaagaaataaatgctaggctcctgatttgattcaaaatgtctcagaaaatattttctcatagactctcccatgttcttatgctattgaataatatcacatgatatcccttaaagatttttaaaacctgaagtaaccaaaaatagagttgctactttttacttaaaagcactgaaaatttataaaaacatataagtggatttccttatcgttagaatttgtattttagagataactattgtagcacacattttaaacctttatctgagacaggacatttacttataaattccactatttagacaactaagaaatactgaagaaaaatgaccatttataatgtgtatttaaatgaggctattcatatgtcagtcattacataccaatgatttaacaccgtttgctcagtaaaa

SEQ ID NO: 113875 - DNA, 1049 bp, Homo sapiens
aaggtgaacagggaaaagagacaagagatctaaaatatctaggttgactcctgtacctgagcgacctgcgatctccaccgccgccgcgacgaattggcctctgggcggggacttttagccaaaaggaaaatggctcagccgggaactggtgcccaggccatggagaagctgattcaaactttacttgtccacaccggtagaggtgaccgcgatgagaataccagaaacagcactacgaccctcagaactcagggtacctccagctgcaggggccagaactgccgactatcccaattttgacgtttcctattgttgccggaagtgacgttaggctccgactcttaacggagacgcatttttatttctgttgtttacgattcgctatagattccttgtttctcacttcgtagcacgagccactctgaccatcaagatcagaaaaacttctcagctgcaagttagaagtggactggccattgaggaggctctcagcggagtcgctcttcacaggagtcttgaacgcggtgtggaatcggcagcgaggaatcctggagcacagagaagctcccagctttgaaggtcttgcggtggtgcgtggcgggcaggaacccacaattccaaatacaaacggtcggcgcgagaagcgcttctgggcgcaggcgcctggctgtagcgactggttgcgggaggctggactctggtgactgtgtatggttgcatatgctccgttttcctctccctgtcgtgctgggcctttgaaaccggcttctttgctggtggctgcttggtgagccccgaggagacggcaaggctgcgcctggtattgggcggaggtcgcctctctccgccgtccttacagagaccccgggcggagacgaatgaccagatccgccttttcattcttttaaatcaaatggcgggaggggagccttgcttatatacccaactagtatatgcttttagtcacaacgaagtgggaagtatcgtggtagctcatcctatcagaattaggttgtgacttagggttggaaagttataggcttactgat

SEQ ID NO: 113876 - DNA, 1044 bp, Homo sapiens
tttttaggaaaggtatctttttggcaactatgtgagatcagagccctgtgactctgattaaatctgcgctaaatttgtctccattttttattgattgtgttatgtagcttctataagcatccaaaagagtcactgatggatgttattccaagttgatgtgtcttctcaaacggtgctttatgcttaaaaaaaaactatttgggcaagtgttatataagatacattataataagatgaatataaggcaaacttatttttttgggaggaaaacatgtaggagggtaggggagacaccctatattcagaaacttatagtagttacaaagtagaacttgagtagtagagaagaagctcggggaaaaagagctagggtaagataaatatggtaagtgccaataggagatatgaccaaaatagaatcaagaagcttcaaaaatacagagacttaaccagtatttcatggatttctattttcaggtgaaaaattagacgatttcaagaattggagctgaatctgatgttaagtaatggcaacaggtgacttaaaaagaagcttacggaacctagaacaggtgctccgcttgctaaattatcctgaagaggtggactgtgtagggtaagctataatatcaaacttaattgtattcttcttgctagtgatttgagatgatatttaacatgggggactacctgagaaaaatcagattttacctggttcctatttaaatctgccttgaaatgattaaaatatttgagaaagcagggaattataggagtttatttctaagtatgaactaatgaagaattccaacttaaaagatttaaaactgtttagaagcacagtatttatctgtataagttataatctctgtacagcttttaaactcatagaggtataatagattttattatttgtataatctaccattctctcatattcagttggatgatatttcttacagttaaatatatccagaataagaagagattgttgccatttcttgtcagtcttttcttatcatttatttgtttattcttttatag

SEQ ID NO: 113877 - DNA, 2235 bp, Homo sapiens
gaagagttataaacaaatagaactatagtttctgactctggtatggtattctagtgaactaagaagtttttctaatatctctgaagatatttacactttttgatgattgactatatttttccatctctctggacagacatctgttctccagcatatcctttgctacctgttttccacctgatacctgtcttactggatcatgacttaacaccagccctatgaattactttagtactctttagttaatggcttggttttccttgtcctctcaaaggtggccattattcccctgaccaggtgggcattatcatttggaattttagaaataaattgctcccaattattacaagagtctgtttcctctgcagcttcttcgtgatcaatttaattataaaccaattttgacaaaaaagcagtttatccaatgtgggtttgcagaatggaaaatccaaattgtttgtgatattttgaattgtgtgatgaaaaagcacaaggaattaagcagtcttcagaaggtaattttatgaatagatattaatgctgatgtatgctattaatagatggctcagtattttaatgtataaaatcaaaaccctagacagcaaattatttcatagtgtaattactgtattattcaaagatttgagtaaccttataaagcttgttgtttattttaaatactactctcttgttttatacacctgtgactgggaactcctagtgttaaactaatagttcaaacataatacattttcattacttcttagtttttaaaagtcatgtagtctcattagagtctcattatttgtcagctatatttcatatatgaaaatttaaatgttaatggaattttaatatataattatgctttcacacaaaatttgttattttgactaatacctttttttttagattccatcacaacaaagaaagaaaatcagttctggtaagtcagaacctcctttgggcaatgagaaaatatctgcagaggctgttggcgttgatatcagtggcaggtttatgacctcaggaaaggtatgcaaccacaaagaaaatatcatattgtttaagagttatctaattaatccaatatacagttttcacttttctgattggcacctgatgaacattctagttagatattggagttcattgatttttaacagtgcatgccatatatttttgggcagtatgcctgaagttataacaataggatagaaatataaaattaaatacgtgttctctttatatttctaatttctaattctgccggatttcctaaacagaagagtagtgatttaggaagattatcttatgcagttatctacatttgctcttaattgtgttctggtcttcctaaaacatgggaacatatgaagagcctacattagcagtagtgataggttataatgattcatttatgtacattatatttctgtaaccaagtatgaattatccaataattggtagtccctacacgtagaatctggttttcagttaatattttgaatattttctctttcttgaaagataatttttctgccattatctgctttgagcagctgtggcaaattgaatctaatgcacttagagctacagtgtttctatcactaagggagacttaagctaaaatattatttattaatatattttcagctgtcttccagctggagaagactctgattgaatgatagaatatcagatgaattatcaatggtgtaattaagtaaaggatgtgaatactttctgactgaagtataatctagagtattatttctgccctaatccaaaatacatgagttatgtaaacagaatctattttaaaaatttattcttgggtctagcacagtagctcatgcctgtaatcccagcactttgggaggccaaggcaggtggatcacctaaagtcaggagtttgagaccagcctgaccagcatggcgaaaccccatttctactaaaaatacaaaaattagctaggcgtggtagctggtgcctgtaaccccagctacttgagagactgaggcaggagaatcgcttgaaccctggaggcagaggttccagtgagccgagattgtactactgcagtccaggctggctgacagagcgagactccatctcaaaaaaatatgtttattcctttataccttaaaaaagtgaaattttattataagaaaatgttcttatgccacttctttttaatgtacctgttttgctctaggtaatgaagacaatat

SEQ ID NO: 113878 - DNA, 1019 bp, Homo sapiens
aaacttcttccatgtgaatagttcactgataatgataaaatgggaaagatctgatattaggataggtcttttcctggtcactttactaggctactgatattttgcttagtgtgactgagcagcaagggtaagatttctgtttttcagtgacagctttgttttgattgttatgtatttttaaaagatctaaattttgtgccatatctatgattaaatcatagctatagaagagatgttttgtccaattgagaattcatcgttaagttaaatttttaatatctgtggattgttaacgttataaaatctttcagctctactatatgtgtaacaataaaataatatatattctagcactaacagtgtgcctggcacgattctaactactatattaactcatttaattcttgaagtaaccattgcaagataagtactatttttatattttacagttgaggaaactgaagtacagcaaaattaagtaactacagcaaaggtcacacagttattgaattgtagatcaaatttgaatccaggcaactgatctgaagttttttcttgactgctgcatatttggagcacatatcaatatcattgcacaaagaacaatttcagtgattagcttgttaagtataattatttgagatgctatttaaggcaactaaatttattataggctgcagatttcagatttggtaaaatgttgcctgttttatttatccattcatatatctattcaacaaatgttaatgcttgagtataagatccttgagagcaaaaactttatcttatggtctgcctgtctagcacacagaaagtatgtcggtgcttttatcaccagtatttgcatatagtagagtttaaatatttattcactgaaagaatattgaatgcttgtgatttgcaaaacattgcctttttcaagtttgattttgcatgctcaggcttatttttttttaatgacatgattatagaatatacctttaacctatttagaaaacacatggctaagtttttttttt

SEQ ID NO: 113879 - DNA, 1802 bp, Homo sapiens
tttctcagcctcctgagtagctgggactacaggtacgtgccaccacacctggataattttttatttatttacatactgtttttagtaaaacaaggtcttgctatgttgctcaggctggtcttgaactcctgggctcaagcaatcctcccatctctgcttctcaaagtactgggattacaggtgtgagttaacatgtccgggttcacatagctaaatttcaacaactgtgccaggactgaaagtaattaacaggcctctatctgaaatggattacagattatgattaggttgaatacctggtctcatagagtttatgatctgatctagattaattaaaagactcaagtttataaagacttacacattataccttatacatgctacttggaaatagggtttgatttcatttgaatgcagagagcaataatttactactctgggtttaggatcatattaaatcaggaatagtttttgtgaggttccagatttgttttgcctttatcaggaatacagtgttccatggggaattgtaaggcaccttaatgtcttggtaagagtgaattagcagaggcttttagggattggacttgtgttggataattttggagagggtttgaggaagcaagggctacgggtgctgtcagggagcaggagcaatttgatgattgatggtaagaatgaaatttttagcataaaataagtactcatgttaggcaaggggggctatatctgctcatttatgtggttacatggtgcccttgttttgtctatgttcggacatgaatggtggttttgggtgtgttgtttcattatgctaatgaagtgacctcatgtgatgttctttttcatgaaattatttatattcattagagggtacagtagtttaggtgttaattgccagacagggcaccaactgttagtgctccttttttatttgcttgtttgtttcgctttgttttgtgccttttttccctcagaggaaaaaaaaaaaaaaggtgtgctaccacagaagagtgtggtttgttcctgtgtgactagcaggaagggtacatgtgagcacctgaaggaagctgtagcagaagagtagaaagatcaagtcatggagtttatcccagagtcgtaggaagattttcagcaaggctaatattcttaggtttgtgtttcacaaaggttatcatcaaagcagaatagtgatttgttaggaaagtaagataggcaaggataatttgaagagaattttagtagtcattatttcagaataataatgagggtctctactaaggcaatgatagtgaggataaagagcaggtgatttatttgggagaaatttagatgttaaaattgatatgccttgatcctgatagatacaaaaagggtgaaggagagtaaggaaggtaacactgactacttgtgtttggctcatgtgattgggtaggtgattgttactctttaataaaataaaaaattcaggaagaggagaaggtttgggagaaataatgagttcacttttgaatataataaattatatatgaaatccttaagacagaatatctagaaatcagttggatacatacattggtccttgatttagaagtattggcttacaaattattaaatggtaaaggaccctactgattcccttcgtggaataaggtgataagcctccaaagatggcagtgaaagattagttgttacgtggtaagagttgggtagaagatttcatgtcccatacccccataatcttagaagtagaagagtccctttctttacagagacttcttagcagtcactactgaagtaca

SEQ ID NO: 113880 - DNA, 1050 bp, Homo sapiens
aaatacaaaaaattagccgggcgtggtagctggcgcctgtagtcccagctactcgggaggctgaggcaggagaatggcgtgaacccgggaggcggagcttgcagtgagccgagatcgcgccactgcactcctgcctgggcgacagagcgagactccgtctcaaaaaaaaaaaaaaaaaaagaaaagaatatacatgattgattcaataggttatattttaaaataaattattaacttacctgtttattcaaactgattgctatcatgataataatactgccttttgtaatttttattgggcaatttttaacatctagatctccatatgaaagctgttaccttaagagtactaaaaactctttgatctatgcggatagccatttttaattaaaatagtatgtttttcttccatctgtaaataatatttttagatatttgactcttctgtgaaaggaaaaggtaatctaaaacttaatttcttcacagacagaaaaagcgaagtagagaggccagcaagtattcctctgtcctctggctatagtacagcatcatcagattcaactcccagagcctctactgttaattactgtggtttgaatgagatttcagaggtaagaaaatgcttagattatttcctttctaaatgaggaaaacaagcaagcattagcttttgttgtaaatattgctagcaagaaaaatagcaaacgcgaatcttagtctctcaaaattctttcataagtaaacagtacttaatgcaatgtttcaaactgtgttttgtacattctcggtccatctttgatgatggtttactttgagaaatcatctaaatttgttgctttttaaattaaaggaaacaacaatccagaaaatggaaaggatgaaaaaaatgtaagtaacagaaaggggcaacagaaattcatttctctatagggaattgtattggattacagtatatatagaatgtgcatgtgtgtttcaaaccttaaaggtctctcaatcaggtgtggaatttccttcaggactccactggataataaatccacctacagt

SEQ ID NO: 113881 - DNA, 1647 bp, Homo sapiens
attttcagtgttgtgaaaatatcactggtgtttttcggcaagttattgatgagatactaaaaatgatgtttttgtctagtacaaatggtgtgatttttctaaagagcagttcaaaggaaatatgaaatgaaattgcatataagatgattatgcagcctactactatagaaaattataatattatttagaaatgcaaaaagtacttaacttacacttcaagaatatgactcataatcgactcctctttgtcttccctctggtcatacttaagtttattcatagtaactgtacttatagataagaaaaatattcaaatttattttaggctaaaaagcataatttcaacaactaaaatgctatgctttattatgaattattgatttacttaatatattatttattatatttcaggtttgaagaaactgcagagttactgaaatgtccaaatcactacttgtaggattttctacatgaacttttttctaggactttggttactatacatattgtatattttaagaattctttatacaattttaatatactgcaatactgcagtttttgacaatttggattccatttggtatatgaatttttgcattcattattgaataactcttttaatatttttgagcaatgattatactgctttaccttgtgtcactttttttttttttaggaaaaactcatgttccagtatatttctcttacagagtgaagtcattacagcactgtatttctgtgttgacatttgttggcagtgtgctaagtaatgttttttaaagcacaggcttgaggactatggtttacatcctgttggaaacattccaaatgggacttgtgtattatacccaggaggctctcatatataccatcttggcatctgtactgatgaataagttataatgaacagttaaaaatgctcattgaaaattaaataaaacaaaaaggcagttatttcatgcttggtcaaaaacatcaatacctttccaattaacactgagaaattaaggttaagattctccttttgtactgggaaacaggctggaggactatggtcctcaagtttagaccaagaggactatggtctcaaggttcaccatgagaaatgtgttgaacattttagtatgctctattgtataatttttttggagggggggatggagtttcgctgttgttgcccaggctggagtgcaatagcacgatcttggctcaccgcaacctctgcctaccgggttcaagtgattcttgtgcctcagcctcctgagtagctgggattataggcatgcaccaccatgcccagctaattttgtatttttattagagacagggtttctccgtgttggtcaggctggtctcaaactcctgacctcaggtgatctgcctgtcttggcctccggcgtaacactttttaagaccagtgtaacagaaagagaatgtagccattctagccaccgttaaaagatacacagtgaggtgttgtgttttgtttttttaatgatgaaaagttacacattttttggagagaaaagtcttagctgaaggtaaatcaatggaaaaatgaaatttatttttaatattactactatatgaattatctttttttaaacttgtagataaaagtgttccagtaatcagaaaatcctc

SEQ ID NO: 113882 - DNA, 1055 bp, Homo sapiens
attcaaagagactgagtaaattgtaaggcactttttaatcaaggggtctgaaaacttttgcaaatcttattccagtgctcctgttcttaaagggacatcaaatgtacatttattttaaaattttaaaatattctgtaagagaatgaaaatgaactgacgtgttagaaggaagtggtgtaccaacagttaagagaaattgtaaaggaaattacataactgaaatctgaaaatgctaataaagacctataacacagatgacaagcatgagcagaacagatttgtaaacacaatgcaagaggaacatattgtaccagaggacaattatgttgattgcacatgatattttggatcaaggatagagccaggtcagatctcaacattcatgctgatggcataaggaacagtataaacaatctgaaagccatttctgtctcaatttatatagtttcataaatgacatttaactacaattgtttttttcccagtatttaaaattaataccttggctataaactcattccttaaggataaatgattgtggaggaggaaaaatactcagacacataagtgacccgggaaggcatgttggtcatgagaaatccacatgttgtctggacatgagcatttgcttgcatctaaaggaaacatgacattgattcttccagtttcaggatttaatgttgcctataacttttaaaattgtttagacagtgtggaaattataaaaatatgagatgaaaagtttcttggagataatctaaacataacttattttccaaatgaacaaatcacagccaagagagtttaggtaagttacaaagagtaccatagcatataaatgtcagcaagaggtagactgtctgttgcttgagcctggaattcaatgggatgtcagaaaacaagatggtatactatacattggtaagggcagagtataaggaatacggtggagaacagaatgaggaaagaaaattaaagcggcaattagacatacatatttaacaccctcattttccaaaaggtgaaggttgtttctgtggagttatgaagagtta

SEQ ID NO: 113883 - DNA, 1060 bp, Homo sapiens
caccaacaactatttattgcgggctaggtaaaaagttctttttactgtaattccccattaatttataagttttaaagggcctggtgctcccagcaccagacaatgatcagtgtttttaaagataaattacacaggggaggagaaagagccctgtgttgggcctgcagattctgtccttgcattggcctcttccaatcctgagcctcgtgcctctggcctcagtctgtgccctcatccagtcactggggaggttggactagatgagtggatgaatcccgaggggactcttccaataacagggacatttattctctgattttacctgaaagtggcagtagtttacatttatacagtacagtttatgaagcactttcatacacaagcatctcttgctacttacatctaagctgttccaaaaagagtgctagcaggtttaacaattacaggatctatgttcctttattttgaatggaaaaaattgttatatgtctcagcatatccaagaactttaaccaatagctcaaaacatttaaaaatctctttaatatctaccaaggatttctgtataacaaagcctttaaaatatcagttacctaattatttaattctcaaatgaactcatttgtaggcatgtttatatacagaacacaacaatattatacaatattagataagcatatcttcactgaacttgttacaatgagtgatgaaataatgtttggagacataatgaaagcaattaacatttagcaaaatataataaagcctttgtttaattggtgaaataaaacagaaggatcatctacaattgtaccattttctgaagaaatataaattttcaagttggcttatgaaggattagaaaatgtaaaaaagccaaagattaagggagcccattttagctttcaataaataaattcttcaaatattattaaattaatggtttgtgaagaatatatagcatgctaggcactagtgagcgtgtaaactgctacagactttcagaacagcaaattagcaatataaatcatgaaccataaaatcttccacaccaataatt

SEQ ID NO: 113884 - DNA, 1043 bp, Homo sapiens
accaagtagagcaaaatgtgatgaataaagattcaacatctgtttatattctacctcttttgcatattataatctaaacagaaaaacaaaatagccaaaagtttcatactgcgtttcttggtgcattttcagttctctgcactgcccaccacatgccagccaggcctactgcagcgcccacttcgttgggcagtaaatattttctttctgaaatgactctgcaatacactcctcttttgtgccaagcccttatggatgatatttcaatttccattacttatttttggctggagaagtggtagtggaagtggggagtaatgttgcagtcttataagcttgtaatgcttgttatgaaaccatttagccaaggcaccacgtgtggacaagaaaaagagaaaacagctagataattttcccaggtaaaggcttgtatcgctagagcaagcttttcccacataggaaattttccagactaatgcctttaaaactgtaatatttcattccatttattgcaacattcttgtcctaagtctcatcgtgttaatgagcaggtttatattattagaaggcattctgtaaacatttttgcaataagtcttttcaagccttcaggattcataaaagagaaaaatgctcacttccggacacttattttataaaggaaagtataagtgtatgaaaaataaaaatctcttctgttttattaatctattttctctctagaaaccactgcagtttcacgtcctccttaaaaaataagaataatttgctaaataacaatgaccctctaactccaaaaccagttaaactaaaggcaagaagagtctttaacatttagaaaaaaaaatccagtagaaagaaagaaggttcattagcatgagatgagttatatctttattcttttttttctttttgagacggagtcttgctctatggtccaggctggagttcagaggcgtgatctcagctcattgcaacctccgcctcgcaggttcaagccattctcccgcctcagcctccggagtagctgggattacaggcgt

SEQ ID NO: 113885 - DNA, 1141 bp, Homo sapiens
cccatctacccagcgattttgaggatagttacttttataattgttttgagtttcctttgaattcttggcaaaatctctgtttttagtcactatttcttgaattgattttgtagaataatttagttttccttccgtctactattcctacctatattgtaactatagggtttttaagtgtttttgacagattcagtggaaactgttttttaaaaaaacctgggattccaggcaattttattgtatattcagacactcattatgttcttcattcattttttacatttgcaggtaggtgaaattcagccttcatttgaagacaacaaattccggttatgtttggtgggaatggaaatggatctgagtagctttttgtaaaggcagcagtaagagtgtaaactgtgattttgttgagtgaaaccaaaaaggtttcttttagtgtaaactatgcctccttttggaaaccttagtgctgtggcaatgtagataacacagatgtgagtagatcacaccctagtttatttcaagatgtgatctagattcaggcttaatggactgctaatatacactcaaagtgtctagaggcaagcattctccagagacctctagagatctgaggaaacttgtcctcctggtcaatgaatggggggaagaccaatacctttgtttagaatacagttttagccatttttacatgtcaccctatcagttagcaattgaatttagagacagatgttgaaagtggctttatggttctcaagggtagtggctttgaaaatacacttcaaatacaatcataatttgcacatctgtaacctaatgctacagagtggaacagtaaacatgcctctgaatcaacagtggtttcctaaactttgtggagattttattctttcattggctaccatttaaaaagtactttgaaggtgaatgatgccattcaagtattttatatggcccaactaatattttacaggaaagcaaaataggcaatgctctccagcattcacaattacttggaaacaggctgggcatggtggctcacgcctgtaatcccaacattttgggaggttgaggtgggcgggtcacttgaagtaaggagttcgagacgggcctggccaatatggtgaaacaccatctctag

SEQ ID NO: 113886 - DNA, 1026 bp, Homo sapiens
ttgctagcattggctgtaaagctaaattcctaaagttgcttttaaacctaggatggagtttattaatggagaaaaaaaagatattacatcaaattcttactgcttttcctatccaggttacagtattctccaaaatgccaagttcacctgccattcagcttaaggtcacacatttatagtatgtcctatttccaagtgtctaccacagacttgacaaaaaaaaaaaaaattgcatgagtaatggcaaccctaaaacaaaacttatgaaatcacaagcataaatattctatatgatgattctacatacattgtgtattctacataaaatctcaaccgtgaaaggagcgcctgaagagcttgagtgtcaccagattgtttctcaagcagcctcacagagacacgttatcttgatgaattttccacaatccaaaatttggtccatggccttgcaggctcagaaatctgtcagcaaagctggagtaaatttacatctcagaagtggacttacaactcaatgaacacaaaatactgttgattgatatcaagatgcaaatatattaatttgcaataagacctataaatgccagatggactaaaacagtcctgagggcaagctggcacattttctttctgtggtcagatcaagatgggagccaagtcacaatcagaagccttggtgtttaaaaatataaattggaatgaaaagaatacattaaataaatcaaatgcaagactagaattcagattctaactccattacttcctgatttactttgatatttcccagtagggataggtatgtaacctaccagactcaccaagctctaagggtccactttcaaggggtggccttggctggaggctgcctgcagacttgacctgtgtggctaatcagtcttctgattgacatgttaatatctaactctgggagaaaaagctatgttaaaatgaaaaaagtaatatgtgaaaatgttactctaaggtaacattttctctttctgccaatttaaaggctatttgaatgct

SEQ ID NO: 113887 - DNA, 1037 bp, Homo sapiens
tttgccctgtttgacattccctttacagttgttgcctttgcaccttcagaaggcagtaaacagttggagctgctttgaagttggccagagatgttgggcactgagagaattaagcatcttagccttctgatacagcgagatttttgttttgttgggtttctttatttctttttcttttgccaaccacttgaagaagtctgcgaaaacgccaaaaaatgcagttcgaaatgacagtgccatttcgctattgcctattttgtccttgattttattctctggcacttttgtctttaatcgtcgtatttttccatctcttgttctcatacccttctactctatttccgtcttacacaagttctttaaccttagtttatttctttgtcagaatcgccaagaagccagttatcaaatagcgagccttctccccccaccttttttttttttttttaaattactgtactgatgtttgttagatattgttcgaatagacctggggtggacatcagcactgccattgtcagccctgtgagggttagaagagcttggtgcatattaaacactgaacagatgttagctgttgttgtcttgagcaagttttcttaccattctgggccttaatttctttttgtttaagatggaagtaatacctaatttttaggttgtgagaattatttgaaatgtgaaaaatattgtcagtgggtctgagccgtagtaaacagtaaatagcagctggttacagtagtatccccttaatggggtaggtatacgttccaagacccccagtggatggctgaaaccacggatagcaccaaaccctatatatacttggttttttcctataccgtacatacatacctacctatgataaaacttacaagttaagcacaataagagattaacaataacataatagaactgtaacaatatactataataaaagttatgtgaatatgatctctttccccttctctcaaaataacttattttactggactcacctattttcacaccagattgaccgcggataattgaaaccg

SEQ ID NO: 113888 - DNA, 1001 bp, Homo sapiens
tagcctgatttcatctgcctttttaataccccgtgatttaaatggttgtggagattgaacgatctgaacttgtgtgaaagtacctgtctgaacagttaaagctgatcatatacttggggaatttatctaatttgcctttctatgaccatgaaatttacttttagcttaagttttggtaattattggatttagaaataggctaagaattagttctgtaggtacctttttaggaaatagagtgtaccatcggaagagtcttatgctgaatttcatgtgtatttttaagtctttgtgtaatttttaaaaatctgcttaagggaatttaggtctactgtgagggtagtaattttgtgtatccagagaattatagtgaaatttcctggtatctatggtatttatatattaccaatctcattatttgtagtttcttcagattttcttaatgctgctgctactactacttgaaattgttgctgttcttgtaaacagcagtcctagacttagttctaaaggagtgattcttagtggttacacataattaataatggaatgtaacaaatgtgttactaccagtgtggaaactcatatagtaaaatgagttaacttaacaattaacataatacttaaaaatccaaatattaactccgcttatttcttggtattggcaccagtcttgttaattctggtgaagttcttgtcctctttgggagactgaattgagccacattggtgtcatttgcatctttgagagacattttaatgtctacttgcatgtgaccaaaagtgacatgtacaatttattatacttggttaattattgagccttgtttatgtttgcatattgttaaatttaaatggtggtgattgtttatactttagagctccagtggaattgtatttgcttgaaatatcgagtcctcttttttttttttttaacttagttgatgttacagaaaaccaaattttggatttgttcttttcttactagtcaaagtatctca

SEQ ID NO: 113889 - DNA, 2927 bp, Homo sapiens
atggaacagggattggctcttgtctgttttcctggcaccatttaggatccatgctgagctggagggtcttagaaattttatagggaaaagtgatttaaaagaatacttcccttctagggatttaattcatctgttcctccaaaggcctcactttttggagatcttatagatcaaaaaccttgcattaagttatgaaggcactaagtaatacagttgagttagcagaaggaatgaactccttcagggaattgtcattcttctctctgagaaaagtttgccccttttttgtatctctctctttgctatcatttgtatgcattaagatttcagcaagctcctcaagttgaattcattaacatgtcaaactatttgcttactaatacttttaatttgaagtgataagatggtatttctgatgagttatctaattaattttcattttaatataggctctgaaccaagttgtcctatgggacaagattgttttgagaggtgataatccgaagctgctgctgaaagatatgaaaacaaaatattttttctttgacgatggaaatggtctcaagtgagcaattcttggtcatttttttacatttaataagaggtgaaaaagagagaaagatgtatttttattttaaagaaaaatacttgagagtaaaaggagaaaaattgggaaagaagtatttatgcatatctgaactgaaagattgggtggaaatgcaaagtgagatctaagataagcaattctcttgcagtttctgaaatgtcatagtcaaactaataaagcttctatcctaagcgtgtacaaggaatacgggcttgttcagatgcggtagggctgtggtggtcaaatcaaagggctcctttctgagcgtgagtcgggaaaccttagaagcagcatgttgggtctaggagttgataatagttaaaagaagtagtattggttctccaaacgtgacttctctaaagctcattttagtcagtgtgattgatctctcaggttatttttacctcttagactctagtggtaaacattggaaataattttagaagaaagctatttcgaccaagccaaacgtctgtatttgcaatgaaaatttcagaacatgagaattttgttaaggtttgtccatctagataattgacagagttaggcttcaaatcattgctctgattcttagctcgtctctttttacatttactgttttaatcatttaaacttttcggttgatggttctaactgcagctgtgagtttagatgggtcatcctgggatatcagtaaatgtagtgcccctgtcttctagcattgtccttggattttaagtgacatgagaaaatagttctttttgcagattaacatattaggatttctgttaggaatagatggttataaataaagtatttgacatctcagtgtttgtcttaaaattttttttgaactactagtgtctctgatgacttgtgtttattatatctttttataggggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctgccaacaacttatatcgaggtaatattttattctctgaataaattcatttcacttatattaaaagcataaggaaatctacatgtatgtaaaaata

SEQ ID NO: 113890 - DNA, 2066 bp, Homo sapiens
ttttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcatgatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaa

SEQ ID NO: 113891 - DNA, 1110 bp, Homo sapiens
agaatgcagtgttcctacatttttactaatattccaagttctgaaaacgtgtacttaagtagcagcttttcctgagtttattcaatttattgcattatcagtgtagtatgaatgggagtgtgtgatgatttccttcaaatataaaaggaaatttcttaatgctgtgttttcttaaggtaaaaaaaaacaaaaaaaagacttttcgttttgttaaaagagttccaggcacattttgtagcaaagccaccaattggcatgatgtaaattgtaaggacaatgtaccttaggtaatgttaaactcaagttttttatagatacttcatagaaatgcttttttaaaatgggactcaatgaaggggaggttatcagggcgtgtgaggaagccagctgttcattgaaaagtaaaagcatatgcactgtgcattccaaagtatactaatggataaaaactgcttcaaagttctccacacaagtatctaagtggctttgaaaagttaagtagattggatgtcttttcaacctctttcataaacatacactttgagtatattttcttatgagaagttgtatgtttaagagatataaccaaaaagtagaaaatgaattttgcagggggtaaattatttggtgatgaaagcagaagcagaagaaagtcatctgcttttgaggcacacatttggattaaaagttacttgaatgttagtatttaccttatatattttactaaatctaggaaagaataaagaaaaacagctcaatctctagagtcttcctgaaaatggtggggttaaatcaagctcaaggaactagaagttctttgctgtgttcattagtgccagactaaagaagccagtttagttaagaagctagcttgctatgagctaattctgatacatagaagcagcattattttaaattctacattgccatcttaaaaacaagcagctacttctttttcattattttataaagcaataatatgagcaatcaataatatgagcatgtatattaacaaagacatgctcgattatatttaagttggatgtttcataaaattttacaacaaaaaatatttaaacctaagtaaaatatgcaactatataatgaaat

SEQ ID NO: 113892 - DNA, 1051 bp, Homo sapiens
tccatctttctattgaagcaccagtattcatgcagtgttttaagaatattagtccatttttatccattatgtatattgcaaataatttcgtactttattgtcttttaatttgtttgcagtgttttctgccatacaaaaattttcattttattttatattcactttaaaaaggcctttttcagcctaagagtataaatataatagcttttctacttttttcattttttaatattgcattttctctattgtgaatgttatgcttatgtttttctccagctgatctattgaggaacagtgtttttttaataaatataaatattgttatagttatttctcatttcgaagttttacggtactaatttgtctgtcttaaaacttcaaataatacttaattgaaagtctctgtctaccatcatccctttcttaacagttcggtgaatatcttttattatattgtgtaaggatgttgtattgcagctcctcttgctaggctgaacatgcagacctgttctggaaatagatgtgatcagtttaggtcacaacctgtcttgaatcacagctgacttgtagtggagagttccaggaaccttccaatcacacacaggtccctattgctccttttcttctagggctattcaacaagcagagacaaacaaaaactgatctgtcacattttactgcaggtaacagtgaccacaaatacacctgtacactgttttttttccaacattattgaggtgtgactgacaaataaaaatggtatatatttaaggtatgtgatgcgatgttttgctgtacatgtacattgtgaaatgattatcataatcatgttaacatatccatcacctcacatattgttatttttataatcacttttataaattttcccttcagtagtaaccttttgagattctgaaacacttttgagttttgaatgttgtgtcataagtgagtttttttggcaaatattttataaacatctaattgggaaactgtgagaggatgttttgtaactttcatttaaactaagatctcctctccacctccaccc

SEQ ID NO: 113893 - DNA, 1051 bp, Homo sapiens
taaaaatattgggatggagatgccaaaatctcctctgctaaatgccatctttcatcctaaggctatacaggaacaggccttgcctactgaactttgtagctataggcctactacattgcctcccacttgaaccctcggttataaacggaatggagagttacttttccattcagaaaagaaccttgatatttcagaaggaaaagttagccctggacacttgagcatttctaagaaaataggttttttttttctttttaaattgtgtacctgctgccctgaattctctagatgttctgagcactctgtatattcttactcatagcttagtaataaattatgtttataaattggagactggtattgtataatttagttcattgaaataatttgatctggtgacttcatagccagacagagtcaatggattcatataaatgagaatccagggttaatcaccatcaaacattttcaacataaagtgacatttttttccttagaatgggatttttactacattcaaattttactaatgctgtaaacatgaaaattttgagtcaggtaatgaatttgagaatggatagctaatctttaaaaatctagtaacaaatgtttctgggaattgtggctattgttcccttttggaatgatgaccaacatttttggaaatgaaaatattgataaatttgtgtggacttaaatatggagtccacacaagattggggtcataggacagaaacaatatttgtttcacatttacattgctgaggtattatgaagaggttagaaaggtgatttttatttagcttgcagaataaatattttaaaatcacagaataacatatactattaaatgcctacatacatttatatccatatgaataaaacagtagaagctgaaatataaaataacatgccactgctgctggagagatttaagccaattatctgctatcctggagcatcagacatatatatctatatctatctataatattatatatttcataatttatatatttatatatcggtataatatattgttttatacaga

SEQ ID NO: 113894 - DNA, 1011 bp, Homo sapiens
actaatgttttcttcactgtccctggcctggtatctttcttggcatacctcacaaattacttgacttctgttttatgttgacttcactcctttacattacattattgggaagccctaggtcttagaaaactatttcttaaactgaattaaaattttgcccttgtacactggtactggctctgtcctctcagtaatagaaaagaagtcttccatatgtccacagccattatttgcaaaaagatatctctttcttcaggcttatgtttcccatgctacatctctcttgttctctgaaccacactttatacagcctgactttccatattctcactgttgctgtcatccccatctgatcattcccctctgtcttaaaatgtgacaattacaactggacataatactccatctgtgatcttctcaggacagacccaagcaggtcccagtatagtgttagcaggacatcacatttttggcttcagatgaacctgtaaatacctaaagtacctggacttttcccatgaattgttggtaggccaggatgtgtgccccattagttggggacactttctagtgacagttcctggaactctatctggctatttctctagtcaggcagtgaaggcagataaatcctcggttcctggcaggttcaggtggaacacgcagcacagtgtgcgctgttgaatgagtgttcccgagatctaatcacatggaatgcctgattgtcaaatgatgaacaaataattcaggagatggacctgggagttgaaaatttttttaacaaaaaagaaattacatatatgcatttttaacaaaagttttataatcattgatatagtgatggtagcaccagtagatattcaggcaagtaattatcaactggatgacttataaaggaattgataaagcctcccaagggattcaagaaaagggtaaagcttggaagtccctaaggataagtggctgagatgtttgattcaggacttcctgtccttgaaaccttggtcagtt

SEQ ID NO: 113895 - DNA, 1059 bp, Homo sapiens
acatttcacctgcaaagctgtaaaaaaaaatgcatttctaatgttttaagcaactaaacttgtagtactttacaccagcagcaatgagaaactaatgagctacctaataaacacagaggtaaagtcacctcaagtaaaaaaaaaaaaaacaagttaagacctatgttttaaaggtcatagcagtatttccactgtccgtatgtcactgcagtgataaatgctgtgttttgaccattgaaagaattcgaaattcgagtaagcaaaactaagttggaattctgcctaattactctctatttaacctcagataacttttaatttctctttgctttatgttcatcatctggaatatggttacagtaataatattctgacttccctcatgagttcattgtaagtattaatttgaataacctaggcgaaaggacgttgtagtctgcaacatagtacatgcaattttatttggctttgttagcaaataatagtgctaaaagaaatcagatatccaaaagacataaattaaaccacataatcctagtcaatttgtagatttctgagtatttctgtatcaaactggcaagtatatgctatatttatgatgagtaagtcataacagttaaaagattgactattaattgagagtaaaaattgtccttgttattgtcttatgcattttaatttgcattttctgtgccttaaatagaaatattttaaaacaattcatgtatgcaggaataaaagcactttagtggactattaaatggtaaacttctccacatcattcatgagggaggagttataaaactgttctaactctcaatttcctaaaactttggtaaaataatattctatctcatattctcccttctgtatgtctttatgtttgcaaagattctttggggcacagaaataaacaaatcatccctatgaaagggtcatcgtagctgccagtgaccaaaagagctgcctgctgagcagtttcatactgttactccagctgccatggactcatgcgtgaggaattcacacagctaatcaattccataaggtgcagttgct

SEQ ID NO: 113896 - DNA, 1013 bp, Homo sapiens
ctgtgcctctcttaagtgtcttacacgttactcacagagaaagaaatacaaaaatggaaaacataagctcacaaaaatgcatttagtgcatttatgatgttaatggaaaccttggatacagtcctctgttatttccttactactcttgatattttacaatattgctttattattcaaattcataatcatatatgtgttaaacaattttttttggtaagtagactgtgtatcaaacttaagagggatttgacatggaaagacatttaaaagatggcagaaaacagctattataagggcatttgaactttagatattttccgttggtcagtttccatagatcatcatctgattcactagggtttggccagtttatattatttaaattgtttcccctgcaactgtagtattttctttaatgttttgaattattcttaatgtgacttgaataagggtaattgtcacatatgctgatgttttcccattaggatgaaaatatttagaaaagctgtactagcaaaaaccaggttaacttgttttcaaagtagaatttaattattttatttcaagctttgattccttttttaaaaattaagtaaatgtccttgagagcaatacctttgtgtgtgtgtgtgtgtgtgtgtgtgtgtatcagttacttgcaccttcaattgaatgaaagacagtagtaggttgtattatggcagaggggtagaagaatggacattctcatgggtatctcaaaggtcaagtcagaattggattccctgtggatggaagagaggagtggagaaggtgcttctcatgtggaaaaacaagaaaagtctatgacaggcctcagtgtttgccagctgcagtggaattctcatagcttgtattgaactctgtgtcctaatcttctgaaaccacctcaagagagtatatattgctaaaataggagctcagctatttttcaggggcagtgatccagaggacactataacagaaatagataatttcaaagtcgaaaatatatt

SEQ ID NO: 113897 - DNA, 1033 bp, Homo sapiens
agcctgggaaacagagcaagaccctgtctcttaaaaaacaacaacaaacctacacatgaaaattattgctgcttcccatcaattttcagtgctatctttatttaacctctctactatttgccttcactttttaaaattttgcttttattcttctttctttggtctccttctctaaaatttttcccctgcttctgtttttttgtatactaggaagacatttattatttttataggtatgatcaaattgtaaaataagtttatttcattctctggtgatttcactaactattttgagagtatcagttaaaatgggatttgtttgtgtgtaacaaaatctaactgtagtggctaaagcaaattggagtttatttttctctagtaactaaaaggccccagtgggcgtttaagggctggtaccacatggagcaacatcatatcatcaatgtccagactcctgtgcttttttcacttgatcatttttagagtttggccttctgtgcttcattcctcgtggtcacaacatggctgattgttgtgcagctttatgtctgatttcaaggaagaaagaatagtgagagaggaggttgttgccttaacacattcaaaccaaagcaaaagttttctctgaaatccccagtagatttgcccttacatcttctcaggtagaagtgcatttttgccattcctggctgtaagagaagccgataaagaaaatacatgcactttctaacaatattgaaattcttttcacaaagaaggaaaggagaatgaatgtactttgggtaggtatcgtggtctgttttatgttgctgtaaatcacaaactggatgatttataataaaaagaaattagttttcctcacaattctgaagactggaaagtccagggttgcagggctgtgtctggtgagggccttcttactgtgtcttctcatggtggaaggcatcacatcaggagagatttctccagagtgcaagaacaggtggaactttatataacaaactcattcctgtgataaggagcccactcccaa

SEQ ID NO: 113898 - DNA, 1034 bp, Homo sapiens
atagagttatcctaagaaacaggctgtccaacacaattttaaatatactcaagctcttttatactgattaagagtttcaagttaaggttttgggttaaaaaatcaacatcaaatgataaataagaaatataatcttgtttaaattatttattctaatagtttatttatgaacacaacatatttctctttcattactttttttttctcagttgtaaaattctagagctggagcccataggccaatccgtagtatatctgaaatgattaaaggttttatacttgacaagccctctgtctgcaggttacttgcttctacttggagcagtggatttatcatcctccactccagggtaaatatctaaaagtcacttctgccacgttatttcccatctggtagattgttataatacctgtgagtcagtattatctgcacagtgtatttcctctgctcaaggcactttgaccatatgaggtgttcacatctgatcaatcgggctgaagcttgccctagtctgaggctggaccaattgatctctaacgatattcttacctgacaatctagaggatacaaatcaagatgtttcaagtgcagaaagcaacagtaaagcataagttctttttttttttttgcattctttttttttttattattatactttaagttttagggtacatgtgcacaatgtgcaggttagttacatatgtatacaagtgccatgctggtgcgctgcacccactaacaagcatatgttctaatgtgtaatatatcttcaagacagtctggaccatgaagtgtatttttacttattgagtgtatatgggaggatcattttataggattggttatatttttccatttcttgattctttgatacttaaatttttggtttcatattctcctctttcacatgttgtccccattttacatatgcaaagatagttgtttgccacaaaaataaacatttaacagactccaaacacatagactgtgtaattagcataacgaaataatagtggctgagtgacgagcagaa

SEQ ID NO: 113899 - DNA, 1042 bp, Homo sapiens
gcttagtgcttagtgaatgggttagaaggagttttttttttttttttttgagatggagtctcgctctgtcgcccaggctggagtgcagtggggtaatctcggctcactgcaacctccgcctcccgggttcaagcaattctccctgcttcagccttctgagtagctgggattacaggcacgcaccaccatgccaggctaatttttgtattatttagtagagactgggtttcaccctgttggccaggctggtcttgaacacctgacctcaggtgacctgcccgcctctgcctcccaaagtgttgggattacaggcgtgagccaccacacctggcctagaaaagagttttaatagatacccctgtaaaatgccaagcaatcagttgccattactaagaactgcaacaagttccagttaaagatgtacatgtttaagagctgtcgttctttaataaaatatgaccaagatgtcttaaacatgggctttaatacatgttactgtgggtttcactccaacttaatagcacacaaagttctgaagacacatgatttcactggtggtacattcgcacattgttttctgtccatgtttaagttcattcttgtccagaacagtttctggttttctaagcctaacgtattaacatttgagttaattaaatcgatagggagccttttatctttttttttttcctatctgggggctttgctttcgcactgacattagcagttcccttcctatgtgcaataggaaaatgtgcagtcattccaggagcatggtctcctcaggaggttaaaagtgattgtaacttagaggttaatgtttcactccagaggaaagtgtttcaccccacttgatgatgtgcccctgggtgctcacagaaagagtagtactcttttttaaaccaaaattttagacacgtgttatgcaaatcttctttataaattacacattcttttctttccttttattcttttactccagtatactattttgcaattaaaacattttaaacttcttccagaaaaaaacttcttccaataa

SEQ ID NO: 113900 - DNA, 1084 bp, Homo sapiens
ccaccacgcccagcctagttactttatccttttaaaagtcctcttccaaaatgtagaatataattaatgcctgcttaatcaggttgttttgaggataagaatgtgtatataggccaggtgtggtggctcacgtctgtaatcccagcactttgggagtctgagtcaggtagatcacttgaacccaggagtttgagaccagcctgagcaacatggggaaaaccctatctctacaaaaaatagaaaaattaactgggcatggtgacacgtgcctgtattcacagctactctggaggctgaggtgagaagatggcttgagcccaggaggcggaggttgcagtgagtgagctgagatcaccccactgcactccagcctgggcaacagagtgagactctgtttcaaaaaaaaaaaaaaaaaaacagcatgtgcatacatataaagcccttggaaccatgattggcatatagtaagctttctgtaaatttgtgttaaatagatagtcttcatgatcagaaaacaaacaaagaatatagcatgtaagtactatgtcctagacatatgacataactgtgattcttcagcaccttgcaactaatttattaaatttttaaaattataaattactgacaattttcccaatttctaaaatatagcaagaggatataatactgatgtttgattttgaaacaggtgaaggaaatgcagggtgtttaatcattcagtgtctggaggctacatactgtagttctgcctataatatgttcccacttcccctgggtgccggggtttgttcctctcctggagggcagcacaggtgtccatagaccacaccaaaccaaagaatctgggatgatgctgtctccttatgtgcttcattcatacttaggtcatttggctgtaaaggattttggtacacataagctttttataatgccatataatttaatatgaactcatcttgaatatattcagagcatatacattttcaagtttaaatgtttattaatgaaacatgctaatgttgctactttgatgtgtaaatatctcatctatattattgccacaaaaaataaatatgcattctaa

SEQ ID NO: 113901 - DNA, 1048 bp, Homo sapiens
tttgtcaggatgtagccccatcgtaaatcgagaagcatgtatgttttagagaaatgtggtaatgggtttgggcctttgggcctgtgattcagactcctttcagcccctctgctggtctcctttggcacactatagcagcgtgcaggaaggcagagaaaagcactgcgtgtgactttgcagttaggggcaccttgttgcatttatttaggtcctaattccccacaacgggacaaacggaaataaacccagactttcttccaggctttaccacatggtgttcgtttgactaaagataaattataaatgacctaatccatggtaatattataagaacgactgcttaactggaggcttaacaagattttctgacaaacggtttttcaaagttgtgctcaagtaacttcagtgaaagattgtgattttacctctgccaaatgacctttcacaaataagtggatttggaaagaacaaatttaagttggcagaagcgttatacttcctctgacttctgagcatatattgtttcacctttcaccagttacattattccttgtagatgtgcattttataaatactatatgggtctaccttttgttacaaacacatatttgtatgtacagatttgtataaattgtggattaagttatcattgatttttctcattagaaaaaacagatatagcagagaactttaaacaaggagagatgctgatgagtttgagttatagtgtaattataaaatttactataaatattttaggtttgtgtaattgtttttctgaaacttactagtgtaaatttttggggtggcttctttcctcggttgattaattttttttttcagagtttatgtttaaccatgagaaagcagagactgtttttatttaatttgctttattgggcatccatcatggaattaatcaaattgtacattaaatgctttgtcagtggattagtactgtttccttatactgctcgcgccctagtggctttcaggtgttaggagttatccacgatagttttttttccaattttgaaatccaaaaact

SEQ ID NO: 113902 - DNA, 1127 bp, Homo sapiens
ccatgcacttgctgggcttcttctctgtggcgtgttctctgctcgccgctgcgctgctcccgggtcctcgcgaggcgcccgccgccgccgccgccttcgagtccggactcgacctctcggacgcggagcccgacgcgggcgaggccacggtaggtctgcgttagggtttgcggagaacccgagagtttgcgttagggtctgcggcggacccgagaacctgcgcgggggaaagtgtgtgtgctttaagcttgtgtacgtgggatccaaagttactgagctcagtgcacgctgctttggagaaaaatcttcttctttttaaatagaaagttgttactagagaggcaagcaagttacacgagtgaagggcccggagaggtgcccagtgagagatcccgaaatctatttcagactggtttcctctggggcaaccaaggggtcttgaaccctgcccagtcagcggggctctggagagtatgagttcattttggtcgggaaatgctcgtttctttccccagctgattcatgggactccaaacagattctgggacactggtgatcagtcaacccagccttactttcctggagtgttcatagtctgcagagcaccaggcgctgtgagcgactttagaaaaaaagtgtcagggactttagtaaccaggctccagagctttcagagttcacttgaagttggtcagacttgagatgtaacgggagattagagtcagttagatcacaatcaagcaatgcaaggcttgtttcaactttataagctcttcattcctaaaatctggtcatgagatactgcaaactaagtttttttttttcttgtttgggttttttgtttgttttgttttcttttaaataagaggtgtttaatcctttgcctgaaaatgttgccaaaatacttttgaggcatcctgattttgaaaaaggatttgtgtgtgttcctacttcttactggctcttccaaaagagtatatctttatctaaaaagttcatacctgccataaccatatagagtatgcttaagagagttcctaaagaagttatattcgacatttcagttcaaacacttgcagtaccccttgctggaactatactgcggtagtttatttcaactggtggca

SEQ ID NO: 113903 - DNA, 1025 bp, Homo sapiens
ttttcaatctcacaaaacaggatatgaaacagtttataagcattcattttatttgaaacatggtctgattatttccatcactccttaaaatttgatacatgtatttaatatgccagctatttatcgttatatatgcttcacagtgtcaggaactgaggagacatttaataaaagttgaatggatggagaagaacaaggttttgaatagtgcaaagtgattaaagatttagaaataaattccatttggactctttcattatgagaatgtgtatattttgttgtgcatgttatatggaaattcctactaccagaatataaaccaggtagtaaattttccttcttcaaagtgggggaaaaaaatcgtggctcattttattgccattatttaaagaaatgagctaatctacagagattcattttccagcaaaatgaggctcatttctttaagcatctgaaggggatttctaaataatttagagaacatgcattatatacttccttaccttcttaaatggatactaataatgatttatccttaatgactcaagatcatcattattggtatccagaatcctatggaatcatgaaacaagggataacaaagaacagaaacattcttacaaaggaggaaaaaggggaggtgattttccatggccattgtagctttttatccaagatgaacatattcggcatgctgcagagaagagagcatctgatcatcttgattttgaattcccatttttttgttacttcctcgtctggagatgcttattgttgcatcttagcttatttggtcaggattaaattaagcagcatgtaaaattcttagcttagtacctagcaaaataaacatcctgggaattgttcctttttcttctggatcagagctttctcaccagacccatttatctgaggaacaccctatttttatgaagggtttgtaatcatttggtgccttcagataaggtacaaagtctttagtctgagtaagtgcttgaaggtcctgcacttagaaaattgtagaa

SEQ ID NO: 113904 - DNA, 1064 bp, Homo sapiens
tttgtgtttttagtagagttttcatcatgttggtcagtctggtctcaaactcctgacctcaggtgatccgcctgcctcggcctcccaaagtgctggaattacaggcaccgtgcctggccaccatggttagaacttgctaaaatctctgatagatgacagtaggtttgcagatatagatgtctgctccaggataacctttgatgccttgaggcataaatcctggaaataataaaaacttctttcaaaaaaacctatccctcagcattggttatgagggacgtttcagccgttcttttcataaactgtacatggaactatattccccacagtgtaggttctatagaatcttgaggcaggatcttataggctcatttaccacataggaattccctgggggaaaatctctggtagaaatcaggatggctagttttgagtctcttcctaatgaatattattaggagtcctaagcattttaatattggggtaaaaagaagttgaggtttccattaagaacccttacttttgtcagttttttcctgtttgttttttcaattgatctcacctgaaatgtatgtcatatggtggtttgaggttaaatgatacaaaaaattttacacattatttctgtaagtattttggtttgccagttacaacaaaactcaatggggcagtgctgctgaattagatttgggcgttttgataatggggcagttgtcttcatggagtagaaaacttccccaggaaattggcaaagttttcagaactgatagagtaaaatcagaaaatctatctactactcttcctcttgttctctgggccatggcatacaagggcctttgctctgtcattccttttgcctggatcatggctcacttatttaaaacttgcccaaatttcaattccttgatgaaattatgactgctcctttaaaattgcaacccgttgcaccctcccccaatcttgctctctccttttcatctccatttcttttccgaatgttctaacatactgtgttattgtgtttattgcctactctttttctactctttttccttactagaaca

SEQ ID NO: 113905 - DNA, 1005 bp, Homo sapiens
ggagctctttatgtactttggaccaaaagctttacggtaagataagcctgtacgatacatcttatctctctatatttaaagatgcgtagaaggctagatggagtttgccgggtgtcacatttaatcatataggaagtactgtgtttttaagagagctccaatatgagaggttgtgattctatcatggaaatcaataaacagcagaagaataaattctgatgtcatcatcacttggaagacagtcattttacagggcttcccaagatgtattagagcaacacatctgttttgctagtccccaagcttcctataccacaagtctctccttgtttttaccgaatgcttattgtattcagtgacatcggttactttatatttgtgacaggccctagtttggtttaaatgtatcacttgatctttaaatatttttctggcttcctgctttctctgaagccttgaatggaatttggaaatttacttagagagtgtaaaaactttccagagaaataacaggttctccattgtttcacagttcccatggaaattcatggctaatatactggcagagaaggactagcaacctatttcctttgttgacttaatgataaaaaagtcaaaatatatgtaattgtgatgcatgatcacatgtttaatttttgcaggaaaatgaaagcggcctttgagttaatatgtctacccaatctcattctgtcttttctgagtttagcctaagcttttgccaactgtaaaaattgatactgcttcctcaaatcgtttttagtgctgtttaaagatactgaccacagttatcacctttttcttaaaagaaaagacctgttcctggaccccatgctaaccaaaggtgaataattgtcacaaagagatgatactatatgattgttctttattgcatctcatctaccacatatttagagtaatccagggtttatgtaattgcttttcctttgaggtgttctcttttcattgtcagcagctgctgtcctt

SEQ ID NO: 113906 - DNA, 1030 bp, Homo sapiens
actataacatggtgctccgcaattagaagcacagagcagtagcattcgctgccaaaagagccatatttatgaactcaacaaagctatgaggagaaggatttgaaaggcggatcacagtatttcatcttgagaatcatttttgatcttcatcatcagaggtcttacagaactactttttttaaaaactggacatgctaatcaatcctataaaatctgaaaggttacgaatttttcatcgctgccttgtggctttcaagttaaccgtaaatatttataaatctcctcttcccaatacatatagaggtaaaagaaaacgaaaagaattgaggacaatagcattttgacttgttctctctttttttttgatacgtaagattttgcaaaaataaaaaaaattgtttcattgcctagtgcaaaacaaggggggaaaagagcatcttaaaccatagatattattttgcaataggtaattatttccaatccattgtggttagaaataaggaatttgaatattagtggctttgtagaatttatgaaaacacaaactataggcaacttaaacttagccttatctcatcccaagcctttgaatctgagaaaatgccaagagatgctagactgttccatgaataaaagatacttcatctgacaagaaaagaggagcaggggtgtatttttttgggcttattgttggtaccatattatttctttgagaagttattttacttttgagttgaaaaactgattgtcatgtcttctatctttataaggatacaaagtcatgagagaaaaatatataataatcttaccactggtttctgccctttaaaagtgtctatcctgactaacatttgtttgcttataatccaaaaaaaaaatgatagtacaggaaaaaagcttgataaatgatatactttctgccactcaaaaatggtttgattttgtttcaggattcatttcggaatgaaaggcttcatcatgattaatccacttgagtataaatataaaaatggagcttctcctgttttgg

SEQ ID NO: 113907 - DNA, 1005 bp, Homo sapiens
agtttagtttcttcatctgtaaaatgggataataatgtttctctgtctaccacagttttgagaaggaaggacttgctgacttgtaaatgtggaaagttatatactatatgcatatatagaattcaataaacacatcttttaaacaaagtaatgcaaatatgtattttctttcttcacagtccattttctgtatccaaaattttcatttttactatgttcagaaagtcaggtattgtagtattctttattaattggcctaaaatgtgaatgaacctcttgctctgcagatcggtcttgagtaactatggctatttttaaattgcatttgcttacttcttcctccagaaaaagatgaccatagaaaactgcccatttccacccagattaaattgggtctttcaatactttccttaaattaatataaattgtgtaattttcagctcatacgtggtgagccatatttctgggcttttaaattttcacagtgctgatggaaactcaagatattttctttgtaggagccttaaatatttgtgagtggaataaaactgaccaaatatatcaaaatatcttttgaagtagaatttataccaaaatggaatatattctctgctaggatggtatttgaatgtttattttctttctttctttttttattaatgaatctctaaggttaaaaaggaaaaaaaaatcctttttcaggtcaacaaagaaaatgctcttattaaattttgtcccctagaattaagttttttggttgttgaaactgagtgagcagtttcagtcttctaaaaataatcagatttcaagctaatctagcctttttcttttaactatataattatggttaatttaaaaagccttaaaagtgtaaaagacatttttaaatatagaacttttacatgtcatttagataagaggataaagctatgcaaagagcaattttgaatactaatgtcattaaataatgacttatttcacacaaattttatttgacaaatatta

SEQ ID NO: 113908 - DNA, 1009 bp, Homo sapiens
aagccagtagtaccagtatgacatgaagcacaaaaaatgctgcatgggttcagggatattagaggtttctatgtgcaggaaggttgggaagatctcaaagaaagcgtcatttgagtggagctccttgttccactctttccccccttctccctactgtacttgactagacttaaaaaaagtatcatttgaaatttaccttaaaaaatagaattttgattaaacgataaagcaaacagtatttaattggaaaaaaggagcatggccacaaaccttgactcattaataaacatggcatggtggagggatgatgagaatactggccaaccccaacagaggctccacgttgtggaataataaaagctagttttacagggagagtgggatcaaatggtgggggtcattagtagtttggagaatggttaaggtctttcctaaattagcacattaaggacttttagttgattgtagcatagttaacatggaaaacgaagagactgaaaatgcatgtaaagaagctggtgcagagtaatgggcaagcgatggttaccagcctggggtcaagacactggacgtggtaccctagtaaaactttttaaaagtcaacaaggactgtggcagatttgataggtaggatgatgcaaaaggtttcaggaccaaataataaaaattttcacattgtgggtctgggaaaattgggatgcagcagtgaagatgcagtatgtgttagatatgtgaaagaaccctggaatatccaggaagacatgtcttaggggctgcgatccaggatgagagaggctgtcggcacagtgctgttgattgaagcattccaacttctcagttcagtaagaatgagaaaggaaatgagccaaggtctgagcttcagcaaatacctataactacaaagtgggcaggaaagaaaaagcaaaggaaacaaaaccataggattggacataggaagagactcagggcaccactcggctgtgggaaacccgggaggtgggaagtgcgg

SEQ ID NO: 113909 - DNA, 3807 bp, Homo sapiens
cagtggctcatgccttaatcccagcgctttgggaggctgaggcaggaagattacttgaggccaggagttcaagacagcctaggcaacacagcattccatctctactaaaaatttaaaaattagccaagcagaccaatgtgcacctgtagtcctagctactcaggagattcaggtgggaggattgtttgagtccaggagttcgaggctgcagtgaactataatggtgccactacgctgcaacctggatgacagagcaagaccccatctctacaaaaaaaaaaaaaaaaaaaaaaaaaaaaaaaagactctaagatacagtactaacttccaagcaataataaagagatagcattggggtattaatggttctataatcatttctaaaatatccagacaagaacaaggcaataataacaatgattaattttaaaaattatcttatagcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattggtaagactgaattttgattttgagtttgttacatttctaagagggttaattatacaaagtcaggaatatatcttgctccatcttgatattccataactaaataaaatttctttctcaaaggtttaaaggaattgccagttttcacatgtaaaccatgctaatattctgttgagtattttttttgaacagggagggaaagcatgtttgtgctataacagtatgtgcctttgtatctcaaaaaaatggagatgatcacatctgttctctactgtttctaatgaattattcaataaagctttgttttatgcagatttcagcaactttcgagtttgttattcagtccaagtgttgcataaattgaaagggaggatttctgtaagaatctctttgcaggtggaatagaaaaatgctgaattttttctcttctttatcccttctaccccgtgctattaaaatctgtatccagacaattgtactgatttcattgaaacccttcaaaataactctttatagctcacgatttcatgcatttagggcatgtaaaacctcagaggaaacctgtgattaagagccatctcattgcagcggcttctattgtgttctcaaagtgttatttctttcttcaattagagatgagaaagttcattcctgacttacgcacccctgcattgtgtcaactgtcatattgtgttttgtttcctgggccagaaaggcagacatcaccccttgcacagctttgctgtgctgcatctcctgtttccatccctccctcttcagtgtccttcagcagaggcggagcccatggaaaaacacaatcttaggttgccacattgatttcaacattctgaaatgcatttatatgtctcattaactattttcttgttaatgtttctgagtcagaaagacatcttaatgataatatagaatgtattatagtacagattccaaaatcctaggatactctgttgtgaaacattgtatttaatagatgttaagtctggccagtcgcggtggctcacacttgtaatcccagcactgtgggaggctgaggcaggtggatcatgaggtcaggagatcgagaccatcctggctaacatggtgaaaccccatctctactaaaaatacaaaaaattagccaggcgtgctggcgggtgcccgtaatcccagctactcgggagtttgaggcaggagaatggcgtgaacccgggaggcggaggttgcagtgagccgagatcgcgccactgcactccagcctgggcaacagaacaagactccgtttcaaaaaaaaaaaaagaagatgttaagtctttgtaattcatctttacttattttaaataagcctttcactttgtcttgtcattcctagtagtctagaaacaggtctctaactgctgacctaaagctttatgggatatcatctctcaactaccactttttaatgctttgcctaatattagcaaaactgataactgagtgacctttaaatgcttaaacatcataaaaagcaaatataaatctttgttaaacccatgtctgggtttctgtaagtcgaaattttgcattttacataatatttcatttcctagccagaagatgattaattctgacttgtctgagctaactttgtgttattagttctatatattagttcactgtaataaagtgaagtaaattttttaatcaaataaaaagatgtttcacataatcagtatgttatatttatgggactattgcagaattacttctctctccttccagattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacaggtatgatgcttttaaccttggtctttaagataattgcttttttttttttttttttaagacgaggtctcactctgtcacctaggctacagtgcagtggtgtgatctcagctcactgcaacctctgcctcccgcgttcaagcgattctcctgcctcagcctcccaagtagctgagattacaggcacatgccatcaggcccgactaatttttgtattttcagtagagacggggtttcaccatgttggccaggctggtctcaatctcctgatctcaagttatctgcccacctccgcctctcaaggtgctgggatttacaggcttgagccaccatgcccggctggttgcattaagttttaagaagacagaaattgtcccttggtaaggaagttgaattacttttggtaacatgaatcaaaccctaaaagactattatagtagtctgtctcccttcccttctctagattataatgttagagaagggaaggaaatgaaaaacgtaatttcctacatgtatgaaaagttgggttttttttttttctgacaataaccatacacatgatcaatacagaatatttggaaaatattgtaaagtataaagaaaaatatttgtcacccataatcatactgcttatcaataaccagttagcattttttaatatttccttccaatgaaagatagtcttccaaaaggggaactattttttataaaagtttagtaagtatactgtgttctaaaaggaggggtctgaggtgcctgtagtgacctttctgttaaagaacgtggatggatctcaaacagtcatgcgagatggtgtttatttttatttttatttttttctttgaggtggcgttttgctcttgtcgcccagctggagtgcaatggcacaatcttgcctcactgcaacaacattcggctaattttttttgtatttttagtagagatggggtttcgccatgttggccaggctggtctcgaactcctgacctcaggtgatctgcccacctcagccttcca

SEQ ID NO: 113910 - DNA, 1031 bp, Homo sapiens
tcatatatttaactcatctctgcattacttcttataatactgaattcaatataaaggctgtgtaaataattgttatactgtatattttgtgtaatttttttattgtttcattattttttgtttccaaatattttcgatccaaggttggttgaattcatggattgggaacctacggctatggagggatgtactttggttgggacctagagtaatctcaggtggaattctgagattcactggcttttcctcttattagctgtgcctttactgatgggtagatgccttctctcagcggtggggtgagggaccatttggtgtaaactcctagagcaacctgtaggaatccttaagcttatttcataacaaattctgagacagtctctgctcaatagatgtgtttactccaagtttcctattccagctctaaatttaccatcagttaatcctgatgatttatccttgactggtttttttaatgtcttgttcataatcatttatgataactggtttaacttttgttcatatactcacatttgaagtaagctaagggggctaaacttttaactgactggataaatccaccacgttttcactttaaccctaattagtgcctcatgatagaagttcattaaggagttaattaagaatgtttgagttgggaggctgtcctggaacagaaaatcatttccaaacagtcttttctgttccgtggcttaagtggaaagtagaagtgatcatcttaaaatattgtggcatttgttgtacctagatgaaatatcttggcatatttttatttccttaatgctttgtagaaaatctcagacattttaactaatgaattagggatttaaaaaaacattaatgtaaccttaaatttaaatgatttcttcataagccattagtaataggatcatatgattaatcacagtgcacagcattacttaggaatgctgcagcctgtgtatgtattgaatataagaacaccaggactgagactccacaatcaatcaagatcaactagcagaataaat

SEQ ID NO: 113911 - DNA, 1014 bp, Homo sapiens
ttttgttttttgttttttttgagaaggagtcttgttctgttgccaggctggagtgcaatggcgcgatctcagctcactgcaacatctgcctcccgggttcaagggattcttctgactcagcctcccgagtacctgggattagaggcacccgccaccacgcccagctaattttctatttttagtcgagacggggtttcaccatgttggccaggctggtcttgaactctcgacctcaggtgatccgcccggctcagcctcccaaagtgctgggattacaggcgtgagccaccatgcccagcctgtggctatgtttttaatttaatttttaagggaagaaatggagtggaaggcagaagtgaaggcagagagatgacatttgggcctctcctttctactttaatcctaccttctaccttggcccttctccccagaaaaattttaatacagaatctaaacctctccctggatatgtggaaccctggagctctctaggttgaaacaagtaggttagaaaatgttcaaccgttatccaaaacagccgcctctaaaataatatataaaactgtttttgtgtccacacaatttttaataagaatgcatcatttcattaattttgttaatattcttaatcttttctcctttaattttaagagagcattgtttatgaaccacttgctttaattgtgaaatctcttgacttctctacaactgtccagatatctggcttcccttgaagttaaagttttggaggagattggtgaaatggagttttggagggggttggtgaactgaaaggttgtggaaaagaaaagtcctctgcctctcagctttcctatttctgatctggtattacccatgacttgaaaatacagccaccacccctctaccctggaaaagttaccatcaaaatagttgctggtgaagtatttaatggtgacgattgatttagcaatgcctgcagctgctcttattttacaaatggctattgaagaaaccttcaaaaactgccctcag

SEQ ID NO: 113912 - DNA, 1039 bp, Homo sapiens
agagagagtgatttctatggccttgtcagagccattgatgagagtttgctaccgatgagaaaataattagagaagattgtgactagctactttggggccagtgggaatggagaacctggacttgagaatattttagaggaaaaagaagtggctacagtgtgatattgggtaagaaaagaactgaatatcacaaatgaaaaataaaatttgatttactggatacacagtccagctgcttttgttctttagaaagttaaattacgtgttttaggtacataggtaactttggaaataaattagaattacctgggaaaacaaagaataaagacagccttttgcataatgacctaatgttaacgaggtccactttttgatagaatttcttggtacaagtgaaattctgacatgtgggggtaaagtggtgtgaatggtcccttagcactcctatgctgtacttattttgtaacctgtcattacagtgaacttcaaattaatatgacagatggccctcgtaccttaaatcctgacagccctcgctgcagtaaacacaaccgcctctgcattctccgagttgtggggaaggatggggaaaacaagggcaggcagttttatgcctgtcctctacctagagaagcacaatgtggattttttgaagtatgtgtaagatttatctagcttactaaaatgtaattaaatgctttggttattaatgtataacaaatagcaatactttcctagttttaccttttacctttaaatttgaaatagccatattggcattcagtctaaagcttgaatgttgactaacttaaaattcagatgttcagccacaagaaatttaataaaataatagctattacattgttagagtatatcatatttataatcataagtctagaagtgttgcacttagcttgtaaagttagaaagacactgagtgactagtaggtactagtagtacatatgtggctaataatccaaggtaagaatttgttcttcctaacttcagcgctacatcaaaacctttggtttatgcatt

SEQ ID NO: 113913 - DNA, 1379 bp, Homo sapiens
gtcagcatgatccgcagtaggcctctggaacttaccctcctgcctaactggaattgtgtgtcctttgacccgcatctcgccaggtccccctccccccagcctccagtaaccaccattttagtctctgtttctgtgagttcagctgttgtacactccacgtctgataacaaattcttacataattaatgcaggtttgtgaaaaccttagttaaaaaactaatgaagacctgttctgtctttgttccgatgaagaatttacttaaaacggtatcagaggctaagtggaactatcccttatttggaacagcttatgacttaatgtgttttacactcgatttcctgccgtaaattgttaataccctctcaaagccgtgtaggagactcaccaatacctggagctggagcctatgctgacgatactgcaggggcagccgcagccactgggaatggtgatatattgatgcgcttcctgccaaggtatgacttcttagtttgtgaattttagagacctttggagaagatatttttttcttttaagatagaaaataatttttgaggctgggtgcagtggctcacgactgtaatcctagcattttgggagactgaggcaggtggatcacctgaggtcaggagtttgagaccagcctggccaacatggtctcgaactcctgaccgtttctactaaaaatacaaaaaatttagctgggcatggtggcacaagtctatagtcccagctactcgggaggctgtggtaggagaatcgcttgaacctgggagacagaggttgcagtgaaccaagatcgcgccactgcactccagtgtgggcaacaagaatgagactgtgtctcaagaaaataaaagaaagaaaacataatttttgtattgtgtaacctgaatttctgtgcacaagagcttcttagaaactgcatacaaacttgttgcctatcattttgataatgataatcattcaagttaagtaatcatagtcctgtgaaataaagtagtatttctcaccctgcttcccagatgagaatacttatgatctatttagtaattgatgtaaagctactgagtaaaggagctgtgataattgatggtaaaagtaggaagtgcagtcatcgtgtacctttaaccaccctagctagatgttgtgcccatgcacactactttcccctttgattgtagctgtttttctcattgaaaatctgtattctttttgagttctggccattacatttgactgtcggtatcattactgacagttattcagccaaagccaaaaataatattccacatctgaaattcatgggtggattagttgaaaagatagactctgtatcaaagtggacttgctttgtggatgctttaacagaagtaac

SEQ ID NO: 113914 - DNA, 1276 bp, Homo sapiens
gccccaaaggttttaagtggatctgttttaggaaaggcataaggaaatcgaaggtctaaaaattgagtctcttaaaactgttcatgtgtgaatattcctttgaaagtctttgtgtagctcacttaagatgctgctgacccagaatgtctctagtacatatatttttgttgaaaagacaatacttgaataatttatactttccttttttccaatctccagccaccacatttgctcaaagtatggggtttatcaatgaagacttatctaccactgcttctcaagctcttcattcagattggcttgctcggaattgccagccaaattattggagggtatgcacacatttaatttaaaaaaataagttaattgaaaatattcagtgacatcctttctgctcagtgttgcctgcctgttgtccagggtactggttagcatcctggctgtacattagaactagtggttttagttgactctccaggtatggatgttcctgaaacacctctagctgcattgggtgcatatccagcatggagagctactggtctctcacaatagttttcaaactgaagtttctgccatgtggaggtggctgcctcaatcagggctgctctgcttgtatttctttctaactaagtctaaaaaatcagtttggaaactatgagtctaaaatatttcttagattttacgtgcagtgtatccagtatcttgttcttgacttgaggacatgtaatattacatgtctagtatgttaccagtggaataatttttctttaatgagacttttggcataaatcagtttgcctttgccgtacagggtccttctgtgggatatcttagtctctcatctatttcttccctaagtcctaattactttcgagtagccatcaagtcagaagtcccttgggttagcacttgaaagaggctaatcataaaacgaagttaggggaggcacctagcgcactgatgtgtaagacatgaggaataggaataggtttcttgctttaataccagtctacatacacaacctaaatttatgagtttgcattatattcttgagccctttagatttataaaggaatcttaaagcacaacttagaatatattcacataaacctagctttgaagaaacaataaaagcttttaaaacatattttactttaagtctcagaattctttggccaaggaacaaatttctgaaatttaaaggtccagtgtgtatctaatttctttaaggattaatatctaattttaaaaaattttactattgtgttgagaa

SEQ ID NO: 113915 - DNA, 1099 bp, Homo sapiens
tattacaatccaacataaagtgaaggtgacttacatggactgtatctaaaggtcaaaatcttcaacatagttgccatgccatcatgatgatgggtttgtctttccattttgttttactatctctaatcctttcatcattgtttttgttgcttgctgtatgtgtgatcaccagttgtcctcaaactattctttagttgcaatacttactttgcaaacttaaatgaaaaacagtaaattttttttaaaacttcacaactacttgtagaaataaatgcattccaaatgttttatttatttttcaagcttcctaatttctcccattcttatcaataaatatctaggtttccaacttatccatcggcttcttttataaatctatttggatatttatttgaaagctacacaacacttctaaagatgtataaaaatagaattacaaaatgataagcttgctagaaatgaaatacataaaacaactcaaagtagaagtaaatcctgagcaactcaaattatcagctatctgttcatgtgaacagccagtaatcaaaagttttcttcctcacatctaccaaaagacgagtagagaaaaacctcttagacaaataccatcctatttcaaaccattgtattggttgtcttggtcttccagaacaaattaacacaaactcagtggccaaaaactatagaaacttattctctcagacttctggagcccagacatttgaaacgaaggtggtggcatagccatgttccttccaaaggctctaggggagaatcctggcctcttccagctgctggtagcttccagcatttcttggtttatggcagcgttaactccagtctctgcctccagcttcacacggccttctgtcttgtgcctataatctccctctcttctcttttttatataccagccattggaccaaggctaactcgaaatgcagaatcatcttaacctggggtccttaacttaattacaactgcatagaccctatttccaaacaaggcatacaccagtaccagagtttaggatttgaatgtatatttttggagtatacaatgtaacttgttatacccgtgagggattcaatttgaacta

SEQ ID NO: 113916 - DNA, 1032 bp, Homo sapiens
tcaatgccctcaatacctttagattcattgaattgaagtaagtccatttcacaacacctctggggacagccaacatcaattgtgcatgagaaaatatggattttaaaatagcgaggggttaaaaccaaaaacagattgtttcctaaaaccaaagaaaataatctatataacattataaatataattactatctataatattatatataatgatttaattttaggatgggtctcctatttcttcacatgtgtttctttcattgtggggtactcgggaccaaccatgaataattctcatgtcttcctccgaggcatgtgcccagatccaggcctcacctaactaattgcatcctcaactaactgcatcctgacctgactaactgcttgattaggctaaactagtcattctatctgaattctgctaggtgtctgtcttagtctgctcaggctgctataaaaaatatcatagactatgagacttaagcaaaagacatttatttcttaccattctggaggctgggaagtctaagatcaaggtgctagctggtttggttcctgatgagggccctcttcctgacttgcagatggcagttttattgctatgtcctcttatggcagagagagagagagaaatagagagagagagaaagatctcctctctcttcttgtaagggccctaatcctgtcataagggattcaccttcatgacctaattacctctcaatggctgtatctccaaacaccatcacactggggattagggcttcaacatataaaatctggatggggtgggggcagtacaatgtattccatagtagtatcaatttatctagaattcgtataagccatgtaagtaattacttaatgatacagtgctgccgggaacattctttcatgatcacttgtccattctaacattcatccatttaactaataggattaaaattctaacagtaaatgatttggttgttatcaccatccggtctcattttccatcagatctcattgaatatttgccttcaatgtcttttca

SEQ ID NO: 113917 - DNA, 1038 bp, Homo sapiens
ccttgctgcttgtggtgtaatgtctcaaaaagattagcagtcacacaatttgtgtgcatttcatgacagcttctagcagcatgccactattaatatttgctcagatgcaaacttcaaaactgcaaaatctccattttaatatcacacaaaatagtaagatatttgctacagcaaagataaagtagagcacagtgatagccttctttaataatatgcacctgcaagatattagatcaggtaattaatatttcctttaaggttagccaaataggtggtcattggagaggtaattaacgaggcaagctaacatttctaaattcaacacaaagttacagtcaggaatacaggacttaactctgggaaaaggaagtgcatttcttgtgttattttacttgagtaattttaaatctttaatgctttaaaaattaattacaccaataggatcattgctttattatgctgtcaacatgaaaagaacctttagagaagtaattcaggtttcttagcccctagactctaatattaaaacagtacatttactatattaaatgaccagatttgggcaaaataagatgtgcatgtaaaacaacagaaaaaatttagtgtgagtctaattaatttttatattttcttgcttggggttttccaaatgaacgaagtcatttctatgtaaatgattatgtcatctggtggttgtactttaacatgtttaagttttctgacaataaatatatttgttaaattcttggtgggatgtttctcttaaatggcatatttttaaaatatcaatttttattcgtctaaaaatctctttattatggcagatttttacaggtgataccatttgtgcagggatacttccaattatttaatattttgttttaagagtaaaagaagagacaaagaaggtatatgattataatagcaagaaaataagcatcacagtgaacataaggtatggaaaggaatttttaacccagatatttaatgcaaatatgaaaaacactgttttactgttagagaaatccagtaatggac

SEQ ID NO: 113918 - DNA, 1042 bp, Homo sapiens
cgccgccgccggcgcgccctccttcctttatggggtcctagtgccgggccgcggcgccgggagctggcgggcgcgagctgggacggcgcgtggccccgggaggcggcggacgcggggacatcttctcagcgcgcggattctctccacggtccggcctccccgtccccgccccgccctcgcgccagccacctccggccgccggctcaggtgggaacttcgccggcgcctctcgcccggggagccaggcgccgcgcccccgtactggggagccccggggtccctgaggaaggcagtccggaggctgggcgcccagtgggggcggggaggggagcccgccaggtcctcttcggcccccgatgtgtggcgaggccccgcgtcttctgcgggggcgtcttaacaggatcctggggggcttccagcgagcggaaagccccgggatgtcaccgctttccggggcaggcaggggacagaaggcttctgcagcgatcagggagccaagttgaaaaggagtgaaggagggagagtgcggggcgaggggtagcgtggggagtggtggatcacggctgaaacttgatcgggaaactctggatggggttggaaacacacacaaaatatcctgagctgggcgtttcaaaaattacgaatttatgagcctgcaactgagattctaagtccctctcgtgttttacaaccgattacaaagagcttcacgtattttaggttgaggcgggttgtgtctgattgatctttgctgagcatcttactatgcagcttggattccattcttactgcctcacctttaaggtagctggagtggtaacttgttaatttttattgtagagagagggtaacaagtacttgtaccgtgtaatacatcacacacgtgtgtttccccaagtcactgtaatttggaggtagagaaaagtttccaggtacgtgtgaggaggtgcaatggaaatgaaaggctgagagctgtcctagactttttacagggccccagacggctgggatgcccgagaacaggactgtctcttcatcatgc

SEQ ID NO: 113919 - DNA, 1044 bp, Homo sapiens
aaagcttggaagagtatcccaaaagatggtattgtaactgaacagaacttggtgatttgatcccttagtgaatttctttaaaataatgacgcatatccctttttccccactgcctacttggagaagtatttgtagtctttatgtattaatatattgagaacagactgactttagaattaagagcaactgtgtaataataattatctattttaatatttcaattaaaacaagattttataaattcaacaatcttgctttgtgcattccttaatacacttttaattatctaaaacttcgagcatgtatatcttaatatataaaattcttgtatgagccctgaaagtttggatttgtaattctaaatgcagagtaaatatttaattcttgatctaagagtgagaggttagttcagtaataagacttgctaatcccactttaaaatgtcatggcattcacaaattattcctaaattcttcaaagataggagtttataatgagtttagttattctattgtgtatttcaggattgtctgtatctcttcctgttgcatttcccttaacaatcttgttctttttttcttacacgaattttattattcctcttaatcaaagatttttttctaatagtaaacaaatatatcttatgttaaataacttagaaaagaatagttagaaaaagtagttcaaatcaaacacacattttacatgcactgcacagtttttataaaaaatgtagttgtactaatcaccatgctaacgtttatatatttggaaaactctgtgaaccccctgtgccaatagctttatgttagcaacctatgcaccctaatgaggattacttgattattgggaataaagcagatagatttatggaattgtgactagttattcctccaaacgggattattttgcatggctgtgtttattttctagaaagatgttttaggtaaattattgaggcttttcttactatgattctgtaggcgtgtcatcagtcttttggttagaaaagggaacctgccttattagggtgaagacaaagaa

SEQ ID NO: 113920 - DNA, 1052 bp, Homo sapiens
tatattttgagattcaaatattgatttactaaagatgcatataaagaaaccttaataatttaaattatctacacttgggcttttatcttttatatgtttcaggggacttcagatctttctttatactggtaatatgatttagaacccataaataaagaattaaaaaatattagtaatcaaaacatacactaactgaagtctgtttaaaggcagcctgaaaaagaaattagatgatccgataattctggtgttctaaaaattataaaaataccttaatttaatgaatattacagtttatgtaatttagatactgggagaatatcatgaatatacaatatgtaaaatccatacagataacaaaaaagttactacaaatgtgaaagatgaatgatacatctttagtcatacagtgtgcatgaatgcatttgcaaaacaagtgtcaggttttaagatacatcaattcttggttttctggtttaaggtaatttcaataaaactaatacagtcttgcatttcattcaagtatgatgttaggaacttcggtcaaccatcagtatagccatgaccgaagtccattttctcattctgaaagttttctataaaatctgagccttcaaatctagttctagttcagctccactatgcagttgtttgatgtcttgtgacaaatgagagatctgaaggagaggactgagtgcttgttctatgagatgccatcagttaattcttctcacattatctgatgaaagtagcttttagacactgtattgtacttcagatgggaatcttaacatatcaagtttggtaaattttatattgagctatcagcaaaggacaatgtgagttactgaaacaaatcatgaatgtatcacgtatttcatgtaaatgtgatgtaagacgtgtggattggttgtgtaattaccacttcaactttaaaaagcctctataattcacttttaaaattttaaatgttgaggaaagtgaagtataaatagttcatactcttggaaaaatgttactaatgtaagcctcgtagggattattttttatta

SEQ ID NO: 113921 - DNA, 1876 bp, Homo sapiens
aaatatatgttaggtattaatagattccgtgaaatgcagaggttactattttgatgcaagataatgaagccagattatctattgaagaatgcttttccatttatgccagatgaccagggcattgattcttgcggggtactcagtcatttaagtggggtacctcctcagtacagtctgcaaagtccatggcctgatgcaagttctctgtaagcttttcccctggttaataatattgaaagcaacttgagaagaaaatagtgacatataaaaatgaagccatcatatatatgagggttagttaattttctctgaacgtgtatgtaatacacgtgtatgtaatagtgagcatattatagcttgctttggtcatggattttaaaaaagaaaatgaaaggacattatattatgtgagtatattcccaacttgtaatgaacaattgtttgcacagcataagagtctgataaaaatgtgtcattctaaggagacctctgtttttttggtccaataaatacattgaaaattgaaaattaagtggtcagattacataattgtgtttatatcagttctcatttagtcagcgtcaatcaaatacaagacaattggttctattcaaaattggaaaataccaagtattggctaattgagtcattttacttgtaaaacacaagtaatgccacctaaaaaagcataatttattatggggaattaattttccttaataaatgggctcttatttctgaggctacaagcttctaaaagttttaaaagagtagtaaagttcactataaaaattgcaaagtgagggaatacagttaagtttttctacagtataagtaattctggtgtctgtgtacttactcattgaaacatacaatcagcttcaaaagatggctctttataattgtcacatttctgttctgcgtcatcttctcaaatattttatatctataataaagatatatgatactaaaattattttctgttcttcagtatttataataaggaaactatttaaaagattatttttgtgatcaattcactgtgccagttgattattgaaggcttcatcaaggactctagactttcataatctttcataattggtgtaaatgtaatgttaagaaataaataatactgcctagaaatgagccagatgtaaccaaatttcaattattttatgagatttttagaagaataataatttaaataagaccttcaaacattttaggtaaataatatacaaattttgaatttattgctagtaaaacacaaggtttaatacatatcttaaatcattgtctgatcgagaaacattactcatcatttattatttcagattcttggaatatatgtgtttcaatttagagtttagaagtaatacagattaaggattttgaagagcaggttttccttccatctttcatcagctctgtagctgaaccctcacaatccctttctttattattctaagccactatcagattctaatctttgctgtctccacagctgtttgaggattttttttttttttttttttgcaaatgtaattacaagtacatgtgttttgtgcaactcacttcctatgaatgttggtgatagaggaagattaaaggagagcaggactatgttgtgtatagatccatggatgaatctattagttttcgagtcattatgacagtggttatcaggaagaactgcaaatgttaaaacacaacaattttggcttaactaatatgcagaaaaaaagtcactgaaagtttaacaatttctccagaacaagtgcatttttatgaggtacgcgccactgaagcaagtgattgctacacttctgtgaatcgtttttttcttttctttttttgaataatttcgactttc

SEQ ID NO: 113922 - DNA, 1099 bp, Homo sapiens
gctgcctttataaaaaatccacatgtttactcttgtgaaattatttgttataattgttaaactcttgggttttttttttaaagacttagaatatcataaaggtataaagagaagaagcaagttatgtttagaattttagctaagttgttttgtggatgacattctgtgttgggtttaaaatgagattattgaagtgggctacctataagatagagttaatctaatgtgggttttggtgtgctctatggttaactgtgggtctcaaaaagttaagtgtacttcaagtgcagtatttatgtaaaaccactaagataagatcttgctgtgtaatctttgctggtgctcaagctaactgattacaatggctggcattttcactgttctcacacttacaaaaataaaatcagaaagcttgagaggatagggaaagacatctggtgtacaaaatgaagacatttatcaaaagggatgccttttttccttttaaaaactgcaaaaggtttgtttcatctcattaggcttagaagtataaattttacataattagtagaaagttgaatgaataacagaaagttggaataaatatttgctcttgtattaaatacatatgaaatgccttgctttagtatattgattatgctaatttatagtctaaatgtacaattagattcaggaggcataacaggatgtagaatttgataaagaatacattaaagaaaaagaattcttgtgtagacctgagtcttaaaaaaattaaaaaataacatttaaattttcttgtaggcctggtgtggtggctcacacctataatctcagcactttgggaggcctaggctggtggattgctagagcccagaaatttgagaccagcctgggcaacatggtgaaaccccgtctctacaaaatacaaaaaaaacattagccgggtgcaggggtgcatgcctgtagtcccagctacttgggaggctgaggagtctgaggtgggagaatcacttgagcccaggaggtggaggtgcagtgagctgagatcatgccactgtgctccagcctgggtgacggagtcagaccttgtcttaaataaataaataaataagtaaat

SEQ ID NO: 113923 - DNA, 2155 bp, Homo sapiens
ttttttttttgctttaagagttagctcctgttaaagcactcttccaaagtgttgtatgtatgcaggatgtatgcatcttcctaatagattatcagcaaccccctagcccctgcaggattggtattttgtaattatgtttcatcctacaaaatagagcaccctatttaatacatatcagctattaaatacgtgatcgaattgcccatctataactcaaacttctatgcctttaataacaccaaatgtcttcaggatttgtggtggctgagaacattcagataactaaatggcccactttattcttttagatagatggcgtcaatttctactgcctcaccaaaaaattatgtagcccagggatagaactttcctaataaattttacaaccagttcctgagaggccagtgaaagatcattaccttcacaacactgttgctcttctctgtggcttttgtagtgattcaaacaatgtgacagtagctaacccccatggacaagtttaatagaattaaagaaatatgaacctacaaacacacgtactaacactgcgtagaatctgtgtcttgcatgttcagggattctcttgttttaggtcgtgtaatttctcataatatgtgtattgtttcccttctaaatttaataacagtaattttgttagctgtggaatatttaagctaaatggtttgaaaaaattaagtcaaactccttacataattgtttcttaaaaaaataaaacaactccatcatcattttcctacagtgtgtttgaagcttctaactttctccagacatttaaaatgactctgtattttaccctgggacaatgtaagcattctaaagtgttttctagttaatgtttgtatatcagcttcttaaacaggtgatgcagttatgaaacttcacctgtatacatctgtaaattttctgttccagatatttaaaagcagaagtcaatattggaatgaaggaaatgtaccagagtgtatattttagagtaataagtgaaatctgctgttttcaacgaattccttttttaaattttaattcctaagtatttgctgactgaagaacagtatagtgcctttaaggtgagaatttttgtattaaataactaaaataaaccgtaaaaattgctgagcaaaacatatctaaatcttgtatttaaattagatttcatttcaaaatgcttttaaggaccccttttatttattcccctggtggtctttcaaaagccaggtgtctgggattgtctccagcctgctctaaaagcaccccaggctttggattagtacaagagagcagctgccttttattcagcagtgcccatttacataatgcctgttcatttaaactcacttggaacctatggccaggatgaacccacaccagagtgagtcagcagtgcatggtcttgtttttgcattgaattaattttaaaacatccctctcttccacagctggaatgaaagacagtactgtagaggcatttctcgattcaactgctatatccttaaaggcaatttaagaatcactgttgcatactttatcacaatatataatagaactaaaatttttaaaaagcagtgtatctattattaaacatttcattcttacaaaatagactatggtagtttatagaagagaacaacaaaatgtactgaaaacctcaaagtaatctctgctctgaaactgtcatttccctctcacggaacacatttacttaatcctttgattcaactttcaagttcaaaaagcatttttgtgtgtgtatttgtgaaacaggaagtttttcagtgttgtttttgtcttctaaatattgtttatgtttgaaatataagtcaaatttaatattatggtataagatgcttctttaattttaaacttttatattagtttagaatatgtatgtggcttagtcagaaaaccctcacctttgtcattttttcagacctcatattcagatccatttttgtgttcttctcccaggagattaggtagtctctatgggctttgtactaagggcaggaatccacttccctaagttacagcctgctttatgtacttacttaagtatttgtggggcagaagtctttaatagttggaattgcacatgcactagaaatttaaataaaacctactttcagggtaaaaaaaa

SEQ ID NO: 113924 - DNA, 1048 bp, Homo sapiens
ttgtttttaataggagaagatcacttactttgctggaacttcttacatttattacatgttatttaccggaaagtaatgttaaaccatgtctatatgcacagaaggagtagatttcacacagccaatgtattgacttctggatcagtactgatcactgcatttgtcttaattaagtgctaattcatgtcagtgagatagatggatttttaaaaacttctgtttatctgagcttagatactttgggtaagaaatatactaatgcatcatatatatatatatatatatatatatatatatatatatatatatatatatatggtcctaccctgttgaataatttgtgttagacacctcatttctccagattttctaaaattcaggcagttggtgtgagggtggaggtaggaggtattggcagagatagcaccgcttcttcagatctctaataaatgtaattagttcagttttatgctttgcctttttttaatagtgaagtgattgtagtgtaaaaagagcagttgtttgactatattatttaattcaacagacttttcttccctattctttaaaaagaaaagcagttattcaaagcataaaaagaaaaaagagattaaaaataatggtctgtaaactttgcaaagtacataagaaaacctcattaattctgggtatttaaagtataaacaaaatctaaaataaatatgagaaaatacaagaacagaaatcttttgaagaaaaacaacattctaaattcattctagttcttttcttaaatgtatttggcaaataattataaacaaaagcaagactattatcagaactcatgtagtaaatttattaagaccagatgctttcctatatgaccatgttggtggagctgttagtagctttaaaagattatgttcctctgggtaccagcactgtccttctttgagtcaaaggaggttaaaatttttgaaggggatagtaaattcgccaactctccccaaatgaggacagacatccaaatgggaaagcctccttcttagaaacctttgtgcccccctcc

SEQ ID NO: 113925 - DNA, 1084 bp, Homo sapiens
tcactctacatactacatccgtaatattgcagccaaccagaaacaccaaagcttatacttatttagatgtatgcacataagaaagtcaaaagttagggggaaagatccactgggaaactagatatggagactgtgtagcatctgaccttgagacaagaagactgatgtggggcgcggcacaaactcctgggctcatttctgaggcttttccaggcatatgtctgggtgagcatggtctcagttcgcccccacacatctcagaagttggtggtctggaaaacttccaaaagggtgtggactgcagtttttgaagaagcataattagtcatgcccataaatcagtaggcgtgtgggtgtgtgtgttgggggtggtgggggccaggctgcatgagtgtgctcagatagccctggctggcccacagtggtggccttcctgagaactgagtagtgccaaagtcctttctatccagaattatctcacctatttagagccaaatttatgcgtaaggcagacatctgcatctttgaaaatacaattttgtggattttgcctttagggtggtttttgtttgcttgttttgttttgggaattctaattttcttacgaactgttttctcgtttcctttagaaaatcactgaaatgactaatgagatgggaagatgaacaagtattatattttgagttctttcctacactgtctcattttctataaacatactaatgcatgcttttaaattgttaataaattggagttttgctgcaaatttaaagaaaaagaaacatttcctcattttggtctttctttttttgcccttacacatgaaattctagatctctggaagggactcaacaaagctttcctaaattaattggctctgacggtaccttcttaaggatttctggtgtggctctgacatataagcaactcagataactacagaaaactgtgtgtaaaaatcagcccaccagtatttgaaacaagtatgcactgttctttctgcgtacctcccgtctgaaaccttgcgctaacagccggatacaagtacaatttctggctcctcattcagtgaggttagaattgg

SEQ ID NO: 113926 - DNA, 1050 bp, Homo sapiens
acaccttgtatggctcttgcagattcctgatagccttttcctgtgatgcttgtacagaattcaagcattaaattcattttcatgaaaaacaatgaaatgcaaatttaaaaaaacccaaaagaaacaaatctctgtgttcaatgaagattacagctttactctttctatatacaaatgtatatgtttgcctatagagattgcatttggagatttctctaaaaagtaacttcacataagatattcatgacaactgagtctgcattgttctccatttcccagcaagctttgtgacttttcggttgcagcagctgtggatcagctgacacatggtcccagaagatttgcagtcttctttatgctcattagcttttctgaatttaaaataaccccatcttacagtaaaatacggtttgagaataactctctaatactcactggataatttaattcctccttcggcatctgactttgaaagcccacattgaccgtggcttaaaacaaaacaaatggaaactcttccaccccgtgtctatcacacccttttccaatccatataaatttcacaactgctgctttgtgactattgctctcctaactaaaatagttgacgtaagctaaatgcttctttacatttaattattaaataatagaatctgcgaacctcagctatttgcatgaccacttctagaaacctgggtctttgcttgacttagagcttctctctgtcttcaggcccacctctcccatgtgcctctgacacgcccctctcccagcacactggcctcagggccttggagcctggctcttgattcaccactaacgtatttcctcagggccccccaggtgcagtggagcgttgctatgactgatttacacccagcctttctcctcatgggtgctcccctgggcccccccaaatcaccgcgccacatctggcgacctaactcattgtcaagcttcactttcgctcattgtgcccttggcacatcgttttccagtagacaactccatgaacagttttatttatttgcgtatttatctatttgcaaa

SEQ ID NO: 113927 - DNA, 1039 bp, Homo sapiens
ttccaggtccaaatgtggggggcactgctgtgagtccgtggccctgtagattgataggaaactgcgcagagaaggttcatgcttcttgctagccacaaagcaatgaacaggtagtagtattttcttatggatggaaagtttaggtaaaaattgtagtcttatgattacattacatggtattgtataattacctaagaactagcccatgtacagtgtacatttatgtgtttactaagaccatagtttttcccttttttagttcccctttaataactggtaattaatcctgtgtaatattaaataataatcaacagctctgtgaaggccatcatagaaagaatatttttcttctggagagattattgtaagtgttatttagaagaagtcttaagccccagcatacgaaactaagatatctacatatcttttagcagagttttgttttaccccttcgcttaatcagaaataatgaagatttatgtatgtcaagttatttaaaattctcgatgaaaagcatggttgttctgtgtgtgtgcttaagtaccttagctcaaatgcagttacactgctgcagaaaaatgttaacattttgaaacagttcttgatttcacttgtgctgattttatcaaaataaggaggaaaaagacaccgtgcctttgttacatgtgataaacaagcgatttgctctttagaggccccctgctataaaagttagccgtttttaagcctagagaatcaggtgagtaatattagaatatttgatctttttaaggatttgccttgacatttattttgtaaagaccagaaactttattgaaactgagccttagaagagtggctttagcactgtgttgctgtcccaaaatgaagagataatctaggaattggtataaagtggccactacccaaaatctcgtggtgggccacatgggagaacattctagaataaaaataccagagctgaaatcatgatgatgctggcagcctaacacttgaaactatattagtttccatcctttaaatgtagtcttgtataatt

SEQ ID NO: 113928 - DNA, 1047 bp, Homo sapiens
agatggtgaaaacgtccttccaagattatcctctttcagaatccaaaacttgaatttctgaaaaatgattatggtgtggcttattttatgtaccccacaatatatattatcgaatcataaatcaaactgctttctaaaagattttaagtatcttcggataaatttccttaatattttaattgaaaaatgaggcaatcatttctcaagatttttatttctgatgggcacatgaggtcctttaattagtgtatccgttcttattcttgctgaacagtctcctgaataagaataaaagtgacaaaattagacaacgtatggaaaaggaaatcctggctttgctaattttaccagggagagtagctaggccctatatttctggctggaattctcaaatgggagaaaattcttttcctggcatgtattgggtaacagttgtttgtgtaccttgtagcctagccgactctgtcaaaggtaatcctcccagtgcaataatcctctgctttcaaaggcgaaaactgtgtaaattgaattttacagaaatctttcttaaatttcaaaattattgttatttaaaacgtatatttaacttatttttgcattgcaaaattggacataaaaacaaaccacagtctggccccaggtgaggtagggagaggattgttaggggaagtgtgcacagcccataataggccctgtcatgccaagcttagttatttctgcagtaaggcaatggagtatgcaggttgaaaacatgaacttttcagtcagatatctttttttttttttttttgaagtggagtctcgctctatcaccctggctggagtgcagtggcacgatttcggctcactgtaaactccgcctcccaggttcaagcaattctcctgcctcagcctcctgagtggctgggattacagtcacgcgccgccacacctggctaatttttgtatttttagtgacggggtttcaccatgttggtcaggctggtctcgaactcctgatctcgtgatctgcccaccttggcctcccaaagtgctgggactacaggc

SEQ ID NO: 113929 - DNA, 1068 bp, Homo sapiens
ctatcaaaatgacttcccaaaagttttccaacaactgagtcatggaggaagagctttaagaactaaaacaaataaagctcattccttccccaaggcctttgtaattattcttctctctgaccagaacgttttcccccatggctgattccttatcatcttttggatctcaggccaaatgcaacgcccaggggaacctgccctatccacccagcctctatgcccttactctgctgtgtgtcctcatcaccctctgaaattcttgtgttcactcccttttgatcggaatccttcactagcaggggtgctctattagggcagagcctttttgttccgagatgagtctcttaggacctggggcagtgacgggcagacagcactcagtaagtatgtattgggtgaataaataagtgaaggaatgtttccctgactgtcggtgctcagtgaagagctgacctgtgcctacggactgaatcatcttttcatttgtaacttttaactattgtaattctagataatggtgatgactgtattgtgaaaattattaaaagttttataaaaatacaaacacaagtaccttttctccctctcttttttaattcagttacctaccgcggtgactcattcatactaacatctgagtctgtgtcagaaacaagcaagagaaaacagaggcagagataaaggactgatattataatttttgaacagctctttcttctagataaatgttctttatataaaaaataaaatctccccaagaatattcttagactttaaaaatctttatgtgtgtgtgtgtgtgtgtgtgtgtgtgtgtgtgtgtgtgtatttttttttttctttttttgagacggcgtctcgctgtgtctcccaggctggagtgcaatggcacgatctcgactcactgtaacctccgcctcctgagttcaagtgattctcctgtcttagcctcccgagtagctgggattacaggcgcctgccaccatatctgcctaattttttgtatttttagtaaagatgaggtttcaccatgttggccaggctggtcttgaattattgacctcaaat

SEQ ID NO: 113930 - DNA, 1052 bp, Homo sapiens
agacagggtttcaccatgttaaccaggatggtctcgatctcctgacctcgtgatccgcctgcctcggcctcccaaagtgctgggattacaggggtgagccaccgtgcccggccaaaaagccttttaaataggaggttttgttttaatttgagacagagtcttgctttgtcgcccaggcaggagtgcggtggcacaatctctgttcactgcaatctccatttcccgggttcaagacatcctcctgcctcagtctcctgagtagctgggattacaggcacgcaccaccacgcctggctaatttttgtatttttagtagagatggggtttcaccatgttggccaggctggtctcgaatgcctgacctcaagtgatcctcccaccttggcctcctaaagtgctgggattacgagtgtgagccaccatgcctggccaaagaggagtttaattccacagactctcagattgatcagtaagtgatatgaagcaagtgcaggatccctgtgctgatccaaggagtgtgccccgagctggctggtctccggcaggcttcccacggaggacaggaacctgagcctgtgtgtccatggccccatttgtccctgaccccaggttgttttacaaagctgcttgaaagagggtctccaaaggccacttagaggccaggagacaaagcatgaaagagcctggtatgtggggatgtggagtcattgtgatagagcaggacagagatgcaattccaggagatcataggaaataaggcgcacacatcagaaggaagtgtagatttcagttgtgaggatgccccgctgtgtgtcccacgcagcgctggatgcctgtacctcgtcacatcagtgaatcctcacagcctcctgtgagactggataatattaccctccccatggtacagctgaggaagcagcctcagagacgttatgtgatgtgcttcaggtcacacagctaattaattgtcagagccatcacagaaacgaaagccagcttgacttccgagtatgcatgcgtccctcctcatggtgtcttctccaaggatgtga

SEQ ID NO: 113931 - DNA, 1092 bp, Homo sapiens
aaattgaattactttaaagcagagccgtggtgggcaaaattagatcatattttctcaacagtgacgactgcattttagcaatgcctccctttgaggaaacgtagaccaaattgacttactccaaattgttgttgtggtttaatatttattgaatagccacaatttactagcttaccttgaaagtgtggtttttaacagttgtctagaatacatcaccaaggtatgaaatacagtggcaaaagtccagcttctccacttggcaggcagtcaatgggaaaccaaggaaactgccttgctctctgtgcctgctggaacattcttgcctgcactccccttttgtggtcaggaagagctttggaagaatcctactttagcagacatctgagaacgcaacatttttatctactgactaggtccattttaatcctctgccgtggtttataactaccactagtaacagcattgaaacaaatttaattgggccacttactcaagagcctttgtgtccattattgggaggtgcctcctttgagcagacacagccccctcctaggggtgctgaactgggcaaccgcaaagcacaggctggattgagccccccaaccccctcagcagatgacccgatgcctgggttgggcgttgtctacctgacccatgaaaactttttaaaattatagattatgcacatatttggtttttttttttatgagacagggtctcactctgtcacccaggctggagtgcagtggtgcagtcatagctcactgcagccttgaactcctgggctcaagtgatccttccaccccagccttctgagtagctaggcctacaggtggtatgtgccaccgtgactggctaattaaaaaacaaaacaaaacaaaaaaacttgttttgtagagatgggatctcactatattgcccacgctggtcttgaactcctggcctcaagtgatcctcctgcctcagcctcctaatgtgctgtgattacaggtgtgagccgctgtgcccaacctatgcatgtatttgtctttatgatataaatcatctaggaaatccagaaccacaaaggtataggatacgtgtttcctattt

SEQ ID NO: 113932 - DNA, 1053 bp, Homo sapiens
gtaatagacactttgcacagctgaaacacttttcaaggaaccaatttcacttgtcctttgaaatggtattttaagtctactttctgtatggagagataaagtctaaaagttgcattattgtattttaagaggaaaaaggcgtacccctcaaaccaatttgataaatgactgtagtgatagcatttccatcaatctctaaagagagaacttcagctattttgcaatccagattttcttgtcaagcagaatatgttatctggaaaggagggcagtgccatttcttctcttcctgaacaactgcagataggtgagagagtgaggaaatagacggacttgtagctcttccagtgctgatcaaattctaggagagtttgagagaaactgctagccagctatgtcatgtacttgcgatcattctaggacaacacaaatgccacatctctcctagatctttggaggaaggggtactgtcttagaattctgaagatgatttgaagagaggtgtactttttcacctcactagcattattccattccttcagctttatccaggaaccttttctgagcctactttggttgttgattgaaagacataaaatggaattctgttgctgtaagaaacacatggcatttcagtgttattctaattttatgagtttctattatacatactaaactatagcttgaatataaatttcactgtgggccctcttccggcatgtaatggtcatttctggcatggtctcctgtgataaattatattttatgttttatgtgcactagaatgtcaaaaatagcaaacgtaatatgtcggtgggcttcctaaatcaggctcagaattaaagtgctgctttacaaaatgccgtcaaatagttcctgatatataaaaataactacattgccttgatagatatacatttacaatttcaatagtgacttgtcattctttgagcaaaagcttccctgtttcatttaaggatgaaatagattcacttcatgggtatgtacaagtcactttttagtataataagttatgatttaactggctgggcg

SEQ ID NO: 113933 - DNA, 1022 bp, Homo sapiens
tattttgatttttgaatgtgtttttgatatccttgaaaaatcacagtggtagcagtaaaattgttttaattaatgaattgaatagcagtgagtgctgaatcaggtttattgatgtaattatcactgaaatagaaaaaataagtgttagagccatagaaccttcgtttatttgccattccgtgagcactcaagtgtcggaaaagcagctaactgagggtttttttggtgttgtttaaagaatattcttctcaaatcataataattctgtttattaacattacatacacatataattttatacatgattatcttgtacattatttactgaatggtttgaatactaacttcagtatattgaaattttcttatatttatcagttgacgagatcgttttccataataaataggctgtacgcaaactaaacgtgaaacctatttgaatgcatgttaaaatggatagaaatgcgtatacacttaagaaaagagcaactaaaaatgtctgatgactattgccttgactttagtcacgcagaacctgaaaactaaataaagggtaacttattgaatagatttcttatttagtatatcaactaagtcttcattcaacgaatcataaatgctggatatggtaccaggtgctggaaaaacaaaaatgagtaagatgtattccctgacgtctagaagctcacagggtggttgggcaaaccggcaagtaggcgtgtaattaggttttaatgtggttagtgttattacaacagaatatgcagagtcagtgtcagcccagagccgattgttgccaacagagactgggggcaggagaggagagaatgtttcacaaagaaggaaggaagcagcgttggaccagaggcttaaaggatgtggagaaattcgagatttagacagaacagcaaaggagaatgtgtaacttccctggggatgctccaaaagccacaaggagtttgatgcctgggacacatgaggctacaaaagtagcccccgagcaaagtcttcatggtgatgct

SEQ ID NO: 113934 - DNA, 1064 bp, Homo sapiens
actgataataccaaattgaatggctattttatctataatgttcttttatctcaaatggggaaaagggcacattttcatataaggctgtgggatgtgaacagtgaagggtcgttcttcctctaagcggctctccattgctgcagccacctgctctaccgtacggagctgaggtaattaataagaggtattaacacgtctggtatcaccggggagagggaaaaccgaaatctgttgaatcgctttaactgtgaaacagcaaatgttgatttactcaccatctttcactttaccacccagcttgccatcatttctgcaagatgtaataaaaagtaagctcacaccccagtgtaactttaatgggtttaattacatgtaacttgaaatatgtgtttggctacatggtacgtccagccaccaatccataaccagcatttttggaaaagcacagccagcactcaggagagagatgggaattagaaatgcagactggggaggagagatgaggccttggagccctgagttattgcccatgtggggagcgctgagagcggaagggagacaggcaaagccgccaaacctaggggaatgcctccacgtggggcgggggtggaaacagagaaggaggcaggtgtgaacagtagagaaatagaggcaggctaaagagagggcatcgccacacaaatcaagagggaaattaatttcttgaggatgtggggcttcaggttgcaacggtgagtgaggaagcactgagaaactaggagaagctgtctgagctattttttaatgaagtttaatggtgaatgagaagagctattgggggtgcaaaattgaagagataagaactgaataacgatagaaatttattttgctaacaattgatgagatttgtgagtatctgtgtaggctgaagttaaagactcaatggagaaagaaagtaaagaaaatgtcggtttgtctttgagggataaaagatgctatcggagcgtttcctcttaatgagatccatttccatcaccgtctgtgtagcacaccattaaaaataactaacagacaacgtcttttta

SEQ ID NO: 113935 - DNA, 1045 bp, Homo sapiens
ggtcctctctcagcttggagtttttttcccgatgatggattagtgataaactcatatgcaggttattccggagttcctctgaaaccttagcttttcatgaatgaaaaggtcctttatacattttctacatcctttaatttttttcccatggaactagattgctttgtacaaatttatatctctgttatcttctttgaaataatagagagcagttgtccagttttaatgccttaattatttgtttggtggtttggagaaactttactgttccttaatgaaatacattacatttagtaaagagagaacttaaaagttgaaattattctttaaaatacaagctaagattctcatgaagccagaagtctccttgctcatttcgtcctaaatgacttttgatataaggccaaactttgtgccagatgtgtggtattttacaataattacatggcacaaacctccagtcatttccactgagaccattcaacatctgttttatcaaaatggctttcagttttttttcaggtccacagatgagtaagaatattaagtgagacactgagtcacttactttattatttcatagtgtgaatttctcttgtatttatctgttttaaattgccacagacctaaagatttcttttaatgactggtcataacagagtttgtttctctgatattttgaggtaaaaattttaaagacattcatttaacatttacactttctattccctttattctgttacacattgtagttccaaatgctgatgaaaacttaataaggaattggtcaggaagtagatgagaagggatggtgcgatccgttattaccatttccactttgagacccctttagcttttgaccagcctacttcactgtaagtcttcttatctgtgctaaacagaatttacaagtatcgactaacaaagacaaatagtcagaggtcataagtggaagggatggcagacccacgtggcagcgtgaaacggttcttactcacctgtgggtgctcccaaagctgcatgaagggccatttgctaatttccc

SEQ ID NO: 113936 - DNA, 1117 bp, Homo sapiens
tttttgttctttctctgacaaatatgatttgagaataaaaggaaatatataaccatgatggaaatgtatttttgtcccaaagctgatttgtctcagatatttttggtcacagttcaattatttcaaaattatttttaggtttttagattcttgctttggtcacatagcaattttgttccaaagatacgaaaccatgtaatccgaccatttccgaagctgggctcttcaatatttctatctttcagacacagtttggcaaatacggcagctcagtcaagtgaaatgtgctgtaagtcctagggttgattggtcaagaataagatttctccagtaagacatttttacaaaggcacgatgactatactttcatagttcaaacaaacagagcataaggaattattctgaaatataatgatggtacagctgtaacaataaaaaggtctgtaataaataaaagattgtgcatctgttttagaagacctctgactgctataccttgtaacttgccacaggcctgatgcactatatcttaactctaagtacaaatgcaagaatagtgtatatcctacattatgttatgtctcaaagaattttagacagatagggacacactatctgatggtgaagagacggaatcgaagctgaaacatcagactgaattatgtttaagtattatctattcttctgcaaagaaaattagcttttatctgtttttctagaagtagtgatgtgtctctgctaaaagaagcacattcttaccaccgtggaacaattggatgcctttatgaaaccgatgtagtttaatagcaggttcttttgggtgaaaattgttttctagttattttattttattttggggatggggtcaccaggctgtggtgcagtggcatgatcatggctcactgcagccccaacctcctgggctcagatcctccagcctcagccttctaagtagctgggaccacaggcgtgtgccaccacacccagctaatttttaaaaatttctttgtagagaccaggtctccctatgttgcccaggctgatcttgaattcctcgtctcaagaaatcctcctgccttggcttcccgaagtgctgagattacaggcaagaaccact

SEQ ID NO: 113937 - DNA, 1106 bp, Homo sapiens
tcaggaagtttctaggcctttatcagactaaaaatagaacatggctacaatttttccactgtaatacttactcagataaatcagttgaaagagattattaggctcagggccactaagggaaaactttagttcaactctggctgctgtgggggcagaatcctgtggatatgattgtacactcttagcattgacatgaggattgatgaatggatatacaccaaactataggtatgtcaaggtaggggctgttataaaaacatgctgggttagtcataatggcaaaccaataaatcaacagttggaaattctgttttttatttgacgcactcagaagacatatctccatgtggaaagatgaggagttttcttatgtccttatcattaattattccattttggaagccacatgcttattctatacattatcctgatagctaagaattgatatcagtgcaaagaaaaaaaaagtcaaatgccaaagaagtaaatccagttattccagagattgagatggtttcatcactgaacagcttgcagatagccttcagaaagtaatttctgaaatgtatgcaatgtcatcagagatgtgacattttaaaaataaaattgcactgatagactaatcaaaatccacatttctctgagccattgtatctgtcttcattgtcctcaccccctcttcatcttcatcttcaccctcgtcatcaccctttattatctcaccttcttctcattgccaaccacactgagaaaagtagatagagaggacactatctccaaagtaagtgagggcttagagagattaaggatcatccaacgtcactcaagtaagctaatggccaagagagcaataaccacagccctgacaatatatatactctttcctctagatcaacgtttctccccttatttcatgctttaggtatgactttgaaagatgaaataaatgagttgtatagtcttaattcccctttgttgctcagaaatatcctctgagcatttcccaaagaatccagaagagaagacttacttctgttagtaaatgtttagcctctggtcataactatcttcctgttttgtgcaagaagagcaagcaagaaagcaaa

SEQ ID NO: 113938 - DNA, 1019 bp, Homo sapiens
ggagaagaaaaagaaaatattagtcactccttcacgtctttaaaattcttttttccagatcaccttatgtttgtacaagttaaagttgaatctcaaatgcctctgaatatagtataaaagttttcacagctgtggtcaatatggttgcattattctttccggctctttggtgatgtcctgtattaaggatgtagtgttctgaaaaattgtgctcactcctgagactttaaaaatggagtcaacaaagcccaatgacttttagtcaacaaagaaactaaaagttagaaatgagcactagatgagagaacaatgccactgtaaaatactcttttttaaaaaaatacacgcaaagcttcatatgttaataccccaagctccaagatggccaatttatttttgaaacaagaaacacctgtttattatcaaccataacaataatatgtttaattttgagagaatctttttggcagttgttaataagccatactgtaagatttaaaatagttttaatatattctaatggacttcttataaggcatgagaaaatatatttagatgttttctttgctttcacgtaagttcagcattaaacatatgccttccgttaactttagtcattatttcaccagattgtacttaatgaaaaaaagaaatttaacagttgtgtcactttatcttaccgtgttctgtaactcaagggaaaaactaagacaggattaacagtgacccacaagtacagtatatttttgaaaaagcagttttcacttgtaatgagtataaactaaaacacatgggaagaaaagaatccctataggtaaaaacctaagaatggtcattcaattctacttcacttagttgactggactaattttttctgtattttctttggttgcagtatctacaattaaatttaaaaagctaactaaaatttaaaacacatacacattaaaattagcaattcaactaggagctctttttgaaaaagtgaaaaagcaaaaatataaatgtaatgtttgtta

SEQ ID NO: 113939 - DNA, 1034 bp, Homo sapiens
gccaataagagaagatgttggagaatggcatctagatattttcctgagcagttaagtggatagagaggtttcattcatggacgcagggaatgcaggatgagatacgagtttgtggaagaggactatttcagctttacaataggtgcttgtgggacatcctacagaagacattaaacaattggatatgagcctggctgaaaaccgaagtcatggaatagcataatttgtgaggtaaaccttggaagatggcagtgattatgaaagtcagagacaaagaaagaaggagacagaagaaagggaggacgagaggaagggcagctaagcaaaggaagtgacgtgatgtacagagggcagaaaaagggtaggggcatgactgagaaaaatcacttcgtcaagtgcaagataaaactcgagtggtctcctgaaataataggctgaggaatgggagttactctcaagtcagtagcattcaatgaggatttgaacatgggaggagcatttgcaaatatgtcattaggaagatttaactagaatatgggttggagtgtgaatacagaggccatgtaatagattattgagatatctaggatagttataatgagatttttgaaggagagtcattttgatggctgggtggcgtgatggctcatgcctgtaatcccagctctttgggagaccaaagtggaggatgacttgaggccaggagtttgagatcagccagtgcaacatagtgggaacccacctctacaaaacattttaaaaattaggctagcatggtggcatgcttgtagtccctgctgctcgggagactgaggcagaaggatcctttgaatttaggagtttgaggtcgcagtgagctaggattgcaccattgcaatctagcctgggtgacagaacaagaggctgcctccattaaaaaaaaaaaaggtagagtagtttcagaagaagtaaaaagaaaacatggatggaacagatcattgtgaaaatagaagtgctacaattacttctcattgaacatggtgaggaccgggaaa

SEQ ID NO: 113940 - DNA, 1115 bp, Homo sapiens
tcatcttcatcctctgccctagttatatggtgtttatttgcagttacttcaggtgaccccccacccccctcagaagacacatgcattgcattgatttgtgaaatgatccttttcaaaacattaagacttaaggaagatatttgcttaagagcttagaagttttgcagtgcccaacaacatacctattgttctattttttgacccaatttactaaagagaaagaatttcaaaaccctgaaataacttcaaaatttatacagtgtcaaaggaatgtctaaattttaaataaccgccttgtgtttaaataatttctatgatatcttcatagtgtcccaattaaagggtgaatatattgatcattaacggaggaatagacaggctggttgtgacgttgtaatagagtgtgtttgtgagtcacgattttagagacccagagttagtgatagaaaaaaaaaaaaactaaggtgtggagactgcttaaaccctgagcggcgttagatatttccatgtatgaggatggatgtcttagacgtaatggaaaatgagaaagaaaagtatctacaaagaggtagaagagctgtattcatattcttgtagcattgggtataaaaagcgacaaaagtcaaggtaaagctagtatgttcaagaagataaggaaattactgttgttgttgaatcatgggaatgaggaaagcattttgtctttactggaggaaagaccgtgggggaagagagaaattctaattgcagtctgctaatcttactgataaatgaaaagagaacactgatccttcctttcttaaagtattaattttttggtttgggtctgtatttagaaggtagttaaaatatggaatgagagctgataaagatatgttgttgatactggtattgtgatgtaaggtgcttcatgttttccttgtttctttataaaaatgagaggtttggagggattggaagaaagcaccggtgaatctaaaaattcacgaacattcagtcattcaattctcagtttaatggaggaagaggctggaggggatggaatgttctggaagaaaaattaaaggaaggacgttggactggaagcaatgcaaaaataatgataatagtggatc

SEQ ID NO: 113941 - DNA, 1092 bp, Homo sapiens
tcgatgactcttcgtcacccggagtggtgcaggtagccgcggggagaatggagtcttttgttcccggtatttttaattagatggattttttttttatgagtagtgtactgtcctaatccgtgaggcaaagctgcccttttgcctgcattcggtgacttttacgaattcgttgggagctagtcttagcagtagtgattttggataatttatgtctgaaatgtgcaaaaatcggcattgagcttaaattaataagccctttggttccattaactaaaatccatcatactaattgcttaatgggggaaaaggtacaaaataagcttgctcattaaagagcagtcttttgcctgcgaaatacgtagtgtgatttttgtcaggtttaatagagcagtctctcagagaaattcaactttgcagttgtgcttcgatgcaggctactcctgtgcaaagatagttggagatggtttggaaaaacttgtgctgtatctgttgaagtaaaaatcatttgccattgatgtgtgtagttcaataaaacaaagatctgtggcagctgtgggaatgagaaagtcacatttcctccctctcctgtgctggcgtctctgtctctctggaatatcttataaatgatatatacagctatatgtgcctgtgtcacaaagtcattctgtcttctgaaagcctaatataatcaaattcagtgccttaagatggtgtagttgaagatttgatccccttccactaaagtggaaatactttcagtaattgaaagcagattcacgtctggagttgtacaagccaaggttttcatttttaaaataaaccttttgttctctggttttaaatgtttcagagagccatccaaagacctctgtgtgctaattgttaaagtagtacttaagaaaggattgcaaatacccagagaaggcatttaagaaatcagctaacttaactaagcctccctctcagccgaatattttagtgcagcatgtactggtctgtgccccacattgttttgtttttgttttttttttccagcggactcccaggtattaaaatgcgactgcagcgttcaaaacactctaggcagaggcc

SEQ ID NO: 113942 - DNA, 1923 bp, Homo sapiens
cttcaggacatgatatctaaaatgagttgtttaattatgaggaaaaagttaaaagagttgtacttttaacaatgacagttgacatcaggaaaagatagaaaggcgcattccaaatgtttttaatgactagtttcttaacctgttgtattgatcattaataagatgtgaatggacgtatttccagagtatgacatggcagtttgatttcttagaaactgctcggtagccctgcattttaccttgttttcttgccttctcagtagtttatcattgcagcacattatagtaaatatggccataattcaaatgatattcttgttattatgtaaaagccctcttttataaaaaaatatttaaagtattcagcagatttttaattaccaaataaaatcatactaaattttggctgttgcgtcacgtttcttagatagcagtggcctagtgtggggcataatagaatttaattcttctcgaagatttagaaaaagaaaagcgacttcacatggactcttctactgatgtctgaacactgattttcagtgtaatatccttgtctaaacatttaaactaaagctttttgtggcttctatttactgttagtttttatgttcctacatatttttacttggttaaaggggtgcacaggatcttctggcatctggaataatacattcaatttttcacgggactcctttctttcataacgtaggcaagtggcaaaggaggcactgtctaaatacagtgatcctgataattaatgctgtaaaatagattaaaatgctgtatttcaggtattcattcccttaaaagggccaccagaacagcgttgctaagcacccgtcactactgcaagtaacagaaaatgacccaaattaaagaacctgttctaagctgtattcttgcattttctaaagttcatttcaaaagatttaacaagactcattcaattagtggggaaaaaagatctgttttcagctctgatcagcaattaagagactgggctttggaacatcagttctttatgtttataatttatttcgtttggtaggctttactttaaacaattgtgaataaagatttttaacaagccacctttctagcaatccagatgtaaatgctaaatacaggacaatatatttgttttaaatttttattaaaatgagttattttatagtaactttgcctcatttaaagaaagtttaaatttcacactaatatgatatattaatgctttattatggatttcttactctgtgaaaatctatatgtatacatgcacacatacagacatatgtagtttagattaaaggatggctgtaattattctatcttatcatagatgtgagtgctttagcacctaacacttgagaaataggatgttcttccttaaggatatttgaatgttgtgggaaaatggtaccatgaaggagatagaatggtttggtgaagaaagtaaataaataaattattaggagcagaagttttctttttagattttttttttggcaggggacggggggcgggggggtgtccagtaaactgtacccttctgggttagaccagaacttctaagtagttgtggccaaatggttagatctttcagtggcctggttcttagctaacacaactgcagtcacaaatacaagctgcggaacttcctggcagagagaaaggaatgaaaggataagggctattagaggagtgggagagaggagcaggcgggttcccaaaggttcagattaggatcattagtgaaattttttgctggatcactttgatctagacaaatctaaagcatataaatatggattttaagttatgaatgataagtgctattttggctataatcacgtgaagtgattcatatccagaaacattgactgttttaaagcccaagtaacacacttctttattctaaagaga

SEQ ID NO: 113943 - DNA, 1019 bp, Homo sapiens
ttcccctcacttaatattaaatagtgtttgacataaatgtcttggtttgtacattgaggaggcagaatatattacaaaatgtaacaaaatgactaatatgggactaacataaaaaacactttagtcttttgtggttatatatattaacttaaaatttgtaaaaaattaaaacgatgtgtggaagtttcagtgagttgttttcatcctggtttgtgcacagtgcctttttttccttaaccttaaactgcagggagagatggggcctgctgtctagagacctgtaaaatgtaatctggatctctttttatgccttttcttttaaataaaacaaaattaccttatataacaagtttaacattgttaaccttttataattatctaaccattatttcattttacctcctgcttcaaagttgtaaccttttataattatttaaccattatttcattttaccttctgcttcaaagttgtacattagcggagtagacacctggctgagctcttaaaagtttatttggctttcaattcctgtgatagtagggggcagtacatctccttaattatctttgttcagggaaatgctgaaaggccagggtagttaaacaaggccatttggatttgtgaggtcgaagtcagatgcaaggaaagtggttaaatgcattatcatcttattgagcccatcatcagtaaagtgaccttgatggaggtggaaaaagccatttggctattttatgacagccacccctgcttgttttatcatttacacatttttacatatggctttatcatattctttcttttcgttttcaaatattatttcctctgattgtagatcgtcagaatgaaggtgaaaattaaaattagtttctttttaatgatagttagagtttctttcataagtgtgtttcatacatcgatttatatggaaataccccttcattaaaaatgaaggtgatcaggttagctaaccattctgtatttgcttttaagggtcttttaatgatgatgattagtcttt

SEQ ID NO: 113944 - DNA, 1195 bp, Homo sapiens
ctccaataaaatggcattcttgcttatatgtttgaacaagtattgttcaataagaggaagagttttattaaacgcagtacaagagctaacgtttttggaaactccagttaaagcaattaagtgctgcatacaagatttttgttttcctaggcaaagctgtgaaacattactgattggagtttagcgtatgcttcactttatactgaattctcttttgttacaattaatgggagctgagtatgaatctttttatcatatgaaagaaaaaactggcccattaccaaaatacctaaaataatatttcatactttattggagatatctccttatcatcatgctatgaattatgtaacactaaaatctcagggactcaagatcatcaaaaatagttcgttcaggagagagtcacattttcttgatcagaaaggacttatttgtttaagaatcatttatttaaagaacaaattggatcaaaaggtgtttaaaatgaagtataaactctcattcccccactctgttcccaccatcagggcccaaattcaagctctcttcagttctccttagactaagctttccatttgggttgccctgccttctgcctgtcttttctttaatccagcctccacactgtcgtcacagttgtcattctgagttgtgttttatcagtcccttggtgaccatacctcaccctctactgctcctccactcccaccttcgcaccagtattttcgctggtcggtgctgcctgtgccccttccttgcatctcacagagtttccaagagctgacttgcatggtatttcttttttttttttttttttttttttttgagaccgagtctcactaggctgaccaggctggagtgcagtggcatgatctcgcctcactgcagcctccgcctcccgggttcaagcgattctcctgcctcagcctcccgagtagctgggattacaggcgtgcaccaacacacccagctaattttgtgtattttagtagagacagggtctcaccatgttggccaggctggtctcgaactcctgacctcaggtgatccacccgcctcagcctcccaaagtgctgggatgataggcatgagccaccgcacccggccttgcacagcatttcttgtggctcctcctcctctcgggcttccttagcacctgattcttatttctgtgagcacttaacacattatc

SEQ ID NO: 113945 - DNA, 1361 bp, Homo sapiens
cacctgatcttctctctcccctgctcagaaagtcagtgtcatatcaagaagatgcttgagtctgattgaagtacaggtaggcttatggacaagtgacaggagaaggcttttcaggtggagaggcacatgagcaagttttaaaaggtggggtatgaaaagtatattggagaaaatatcaaatgacctacttcgagcatgaagttcacgaaagagaattttggaagataaggttagaaaagtgggttggaaccagaacatggaggaccatgaatttcagatcaaaaggtttaaatgtacctttgagatccctgggaatttagcatagaaaacaatcacacagtagtacggtgtgtttgggggaagatctctctggtagatgctgttagatgaattataaaagcaaggtagtattaatagaagtagagaaacccatttggactcttcctactattactttcaattcatgacttcttcttaaacttattaagaacagtttaccaaagtaaacttcacaaaggcaggggacttctgttcactctggtatcttcagagcctagaacagtgcctggcactggttgatgctcagcgggtacttgttgaattgaatgaatgagacccagaaagaccaagtgactgttttgaattcacacagctaagatagggacagatccaggcctaaaaattgcactcccagtttgctgttttcttgacatgctaggctgtcgtacaggtcattactattagcgtggctttttctttgtcaactcttgtcaactcttaccctaaattcttctgaactcttcttgcaagtgattgcaaactgcctcatatcttacatactcatcacagcctcctctgagctttttttttttttttccaaattgagacagggtctctgtcatccaggctgcagtacagtggtgcaatcatagcttactgtaacctttaacttccaggctgtaatgatcctcctgcctcagcctccagtctggcccacacattgccacacctggccaatttttaaattttcagtaaagactgagtctcgctacgttgcccaaggctggtctcaaactcctgggctcaaacaatcctcccacctcaacctcccaaagtgctgggattacaggcatgagccactgctcccggcctaggatcttaataggttgcttttatctacagacttaatgggttgaattgtttattgttacttttttcagatggtaaatcccaggtcagagactgtcttctgcttgttttatttttcagcagccctcctctctgaacagccgcactcagaacgcctttgagtgcagaagctggttgactgattgcccagcctccaagtctgtcttttagtt

SEQ ID NO: 113946 - DNA, 1199 bp, Homo sapiens
atcccgaaattcttgttctcaattctagttctgaatgccaagaacacagctcctttggttaagcatctggacttcaacctgaccacttgcactagaccatagaataggatgtatgtagaatttcaaaatgaggaaaggagagggaaaaacatacattaatggctgctaagagaagagaaaagggtcatatccttggttactctttgccaaaaataaaaataaaacacattgtaaggaccaccatgcttttgagctcctgtagacaccaggcaaggatttgccataggacatttgtgtcagttagggtgtatccattatgtagaaagctctaaaacttcaccatgggaatgtgggaatgggtctgttctgagaccttttcaatgttgtaagtcattagagaactagcctcaaaccaaaactctccatgattcccaggtaaattgcaacacatttagttgcatagctctgaaacttttccatttgaatacaacaattaccgggtgttcaggaaattagatttgttgcaatattttaagtgatttaaatgaagatcagtattattttttagtatagaaatcttctagtaacagagtttaccacgtccgtcaatgtgaatacaattatatttgcctcgaattttatttgcatttgtttttctgcctattttcttgtggaaattttaatgagcagtgaaatgaccaaaagctgggccacggagaggaaaataaagataatctaaaacatgtttaattatcctcagcataatacacacttcactgtaatagggataatgcaagaacattcagattatctaaacacatttaaaaatggccttccagtgttaggagcataagtatgccactatgaattgtgtgtgtatgatgaactttcttacacagtcatgtgttgcctaaagacatggatgcagtctaagaaaatctcattgttaggtgatgtcattgtagtgctacgatcactgagtgtacttacacaaaccaagatggtatagcctactgcatacttaggctgtatggtatagcctgttactcctaggctgcaaacctgtacagcagagtactctactgaataccttaggcagttgtagcacaatggtatgtattggtgtatctaagcagaaaagatacagtaaaaatataatattacaatcttatgagaccagcatcatcatatatgtggtt

SEQ ID NO: 113947 - DNA, 1017 bp, Homo sapiens
gtcaacttttattttaaaacctcattaaatcatccttataagcaaaggtaattaagatggtgtcatttcattttagtgagttatagttctctggactctccctctgtcactgtttccaattagaatttctctaaaagttacaagagtagttaattttaattactaaaaatacctagggggaaatttgttgagtggactcttgaatttcaagggatttttgtcttgcaagtaaattatagagcagaggctataaattagttctccattctttttagaccttgaactttttattattctgcctaaatgtaactgtaacttccattttctcatcttaaaatttgcaaatttatgttctctatatttctttcatgattagcaagaggtctctgtcttacatattttttgaaccttactttctcaatttactaatttgtaatttctactctaatctttattaatccccttctttttcttagacataattatggctattaatatgctgctaaatgcaactttgtccccattccatgtgtaggtgttctttttaaaattgttctgtgtacattttgtgattgaatatttgattttctagacattttgatttttactatttaaaactttctaggtttaattcattgataacagaaaatgtggcttggatatgtaagctttttaaagatttgtaagggttttctttgcctcttacatagtgatcttcaaactttttgcttacatactcactaaaagaatttgatgaactcaataccctcctacacattttaaagttgaagtcaaatacttttcatcacaagtaaaaataattgcaaaggattaatttccagtgtatgacaaatattgatattttaaataaattgttatatcacaatttttttttaagagagtctcgttctgttgctaggctggagtgcaatggcatgatcatagctcattacagctttgacctcctgggatcaagctatcctctcacctcagcctcccaagtagctaggactaaag

SEQ ID NO: 113948 - DNA, 1268 bp, Homo sapiens
agcctgggcgacagagcgagacttcatctaaaaaaaaataaaataaaataaaaaatttgtggccaggcactgtggctccgcaattttggaggccgaggtgggaggattgcttaaggccaggggtttgggcaacatatgagaccctgtctctacaaaaaataagaatattagcaaggtatgttggcaccacctgtagtcccagctactctggaggctgaggctggaggatagcttgaactcaggagttcaaggttgcagtgagctatgattgtgccactgcactccagcctgggccacaaagtgagaccctgtctccaaaaataattttaaatataaataaataaaattgtattggaaatgtatctcctgatgagatgaggtggtaattataattgttcgtggctctttgatttgctgctctagaatgggcattgcctcatggtaagtttctaggtagatgagaaaagaagctcttctgtaggtaccagatcagccaagtcaatataagggcctgaaatgaattcctttgcaactgttcaggcttacctaccccttagaaattttttactcacaggattatagataccatggcttgaagaccactggtctaatagatggtacatttttatgtatgatcatattatgattattaatgcacttgaaaatattcttatttgtaggcatcagcatttgctctctatgcattcaaccatatttaaatgtatgatttagatgagtgagtgtaattcagctagggcactatttagcattgtggatgggataattcctctttttgagaaactgtctcttatattttagggacatcacttagtctaagtatccttagaggctaacagacattgtggcaactcaaaaacttcacaccccgtttccagacattctcaggcaatgagaactgtcccagattgaaaattaccgacataaatcccaaacatcctttttaagcctgtttgcttctttagaggtttaaaagacctgttaaactgttttgtttctgttctttgtgtgcatatttcttactgttttgctttattgacacatagagttcatgcctattatattttcattgtaggctgtaaccttaatatatatccttttttatctaagtgaatgctttcttctatcataattctattttatttgatattaatattgtatccccttctttttaattgaacttacctggtttatgtgtgcctctagctttgcatttaaccttcccattatcgctgctccctaatgctgtt

SEQ ID NO: 113949 - DNA, 1050 bp, Homo sapiens
aagtgtgaagacactgtcttccgtcttttgccgtcatcagcgttccaccttcattgagaccctgcaagaccctggcagccttggcttccaggcatggtttacaccatgtgaaagcaaacaagtaaacacaaatatcaagcctaaatttattttttatggtcacagagttcctaaaggttaaaaactttcagaatgggtctgcatagggccctcccaccggcctcctgaatccctcctccagtgactttcctgtcaggtttataatgtcttttcgttctttatttcttgattgcattctatgattttcccctaagacaagctgtatgattaaattacccaagtttccaggattatacttttctttacatagcacaagctgtttaatacattttgtatctgagatgcaacaaatcacatctgagatacacagataaacagcagttcatctactttattttttaatacttatttttaataatcaaataaaatcatactttatgtctttaaatcatatttttaattacagaaagtgaatattgaaaaacaaagtaaaaaataatgaataaaattatgcagatgctctggaaaatacctggagagaacctgtgactaatttggtacaaagcagaacaaatgttaatttagttatagattatatatacttttatatcataccaattgtcaattttacacatagtgagaactgtttcaactgtaaaatgtctttcaggaacaaatctgaatattaatttagcttacttgtttctgtggaacttaaacacttttgcacttttctttagaattttgaattttaaaaaattaaaaataacttttgtaattgaggtaataatcctcatttgtagtgttgaaaatattattttcatactactctcattctttaaaaataaacactaaaaataaccagtccagtaaaattaaagaattagtcaaattttttctaatgtcatgtgaaaatttattgactattttattttttgaaatattagtgccattgtagtgccagttaaaatatttaatggttgatgtacg

SEQ ID NO: 113950 - DNA, 1024 bp, Homo sapiens
aacctagttattaatatgcttatatctatattgtagattttttgtatgttcctatgaacataatacatacattgattttatttgccttttaataacatgggcagaatgtaatgtggaaggtaccaccactaattgtgattttaaaaaaattacccttcagtgtaatcctgcaactattattgtggaatatatcaatatgattaaattttggcattgcagaacagaatcttcactgcactgtaggttagaatacaagaaaaattgaaaataaaatgagaaaatttctttcttaaccttttgcaattttagtataattttgctaacctgtgaaaatgtctacacataggcattgtcttgtacatggcaagacagcattgtctctgacacacctgcattatttgagatgtatgcattcatgtcagttcttttcagaaacagtaggtaggtattacacaggaatatggtctatttttatggccttctcccataagatgccttctttgtaacatatcacagtgtacttaaaagaggtcattaaaattaaaaagatccaaggaagcagttacgagtgtagaccttcaatatatgaattaattttggatttcagattccttttagatttgttttagctctctacatgtcatatacttaaagttttcattgaaattaagaatattacccaaattttcatattgctttaggaatatttacaggaaaagaaaaagaacatgtttgttcttcagctatttttttctttacggagcatatcatcaccacaatttcatattcaagctttaaagcagaactcattaatgcatgtttcatatgcgttgccaaaaatacaaaattgttttcttgctttatctagtgctgagatttttagctggactaacaacattgtgtttgtctctatggcacattatcaacgtgtctctgtagcagaaatagtagatggttggaataaatagtagacgtgcactggtgtgtgtttatgtttatgtaacagtaccattttccagagcta

SEQ ID NO: 113951 - DNA, 1049 bp, Homo sapiens
ttggcagtcttgacaggtttttatttgtgcagtggaaagaatttgatcgttaagggagactcttaaattgttaagtaaacatattcacttttggagccagaattttattttgaacgcatgaagccttatgagaaatagtacattttataatgtgctctaataaagggaaaatgtgtcctctcaaaataattgaatttcttctctaattttttatgtatatgtgatctctaaagctacagttttataattattcttaccagacaaatattactctgacctaaaatgatttagagtagaaatttccaaaccagtttagtatctttttaggaacagtgaaataacctttggttattttagtagtaaattaaatattcagggtttgtgtggatttataggacgggggtaaacatgccaagtcacatagtgggcatgtgtaaaatatttagactttaatagaaagaaaaaccaacctgtattgagttataaaaacaccatactgttgaaatgattgatggttttctcatcacatgtaacagactaacataatttcatgaaacctttgcttaccgcttacaaattatccaaaattcttttgcagtaaagctaacagtatgtgctccttaagcaaaacattgcctatttcttttcttttctcctctttcttccttactccttcccttccctccttattccttccattcccctctcctcctctcgccctgttccttccctccctcccttcctttcttcctccctccttccttttcttcccttcctcccttcctcccttcctctttctttcctcctctctcccccttctgggatgttgccttaatagaaataacagtctactagagaaactcaaaacatgtaaaaaatattatacaaggtagaaaatgataaaatgtgtaagaggagtaaagaccaaattctgttggagaaagcagaaactctcagctgggaagattaggaagggctttagtagagacacatttcaaaggtgtgaatgtcttaattctcactatattcctctagaaactcatgaccac

SEQ ID NO: 113952 - DNA, 1074 bp, Homo sapiens
tttatcctcctctaattcctagtggcactatacattttaatagtatttgaagccacgttagaattatgacagcatatgttaaaattgtgcaagtggttcagtaatataagctaacatttcctgaaatgatttaaaaatctggcagactgcaaagttatcctgataaggaacttggttttgattacagtaatgagatatacgggatggtgtcagaaactgtcttccagttgacacaataatccataatttatagattggcttaaaaattaaaagacaaagtcaattataactaattatgatgctacatttgctcgaggagttactatatcctttgggataaaggaagtaatattcatgtcagtcaggaatctttagctacagtttcctggttctatcttaagaatttttcagtttcgtttcatgagaatcctaagccactgaaagcctgaaaccctgctatttttagaaatactgtagtagcttctgtgtatcactgcacatttgttcctattctgaacttcttatctgtgccaaatcttcagagaggttactggaagttttgctcgatgactgctgaatcagtcagaagtgaattttaaattatgcaggagaaaataacaataaactgagttacagcatcaagatatcattgttatttctgttgatactggtttcatcacttgataggatttaaatacccagactattgcatatttactaaagttttatttcatcatgtcaacatttttttttttttacagtcaaaagccaaattgtcagcaaaggatattacaaggataggtatttttagcatcttttcaagaagtgaaaggaaggagtggtttatatttttctataattttatgccatgagacgtgacaattttccatcttaagaaggacaattagttcttagaaggaaagaaaaatgcattcttatataaacttcctagaaaatttagtgagttgataaattcctagctgcatatcaactttctactcttgtggccttcttttgtgtgagctttgatcatcaagcagtttctaagtgtttttgaagcacatgtgttgcatg

SEQ ID NO: 113953 - DNA, 2799 bp, Homo sapiens
tgatattaatgaattatgacaagccttttgcctgtcaagcagaggttcccgccttcctcctttaagacaaaaacttaatggaagatgctcagatgcgcgagctctctgatgataccccttaagtgctcttctctttctgatgcgaatattcagagagccgtgaagctgcaagtggcagcatttaatattgcctttctcataatgcctgaataattttccagagactgatctctgcagctgctgtgaacatggttatttgtttatttttcaccttggtcctggtggaatgctgacctagccaatcttcaggactcacagggaaaatggtttcagattcatagctctcatcttttctttcaaataaacacaaaactgaagcttgtgacgttgagtaacagaaaaataagagggactgtttctttagtttcctttaaaagtgaaaaaaaaaatgactgtatgaatgaagaatttatttggtgaaaaatgaagactctcttgcatatttttaatggatatttgtgagaggaaaggagaaagcataggctgttgtggtaagctatagaatgttttcaagatttccccccgtagtgctgctcattatgttaaacagtctagcttttagctactgtagttttcgttttatgtgtattggccttcatttgctgaaatgcttcaagttcacagtactaaagtcattttgaaaacgggatgtaattacaaaggtatcttatgcttaccaacagcttttttggatcaatttaattatcattacttgtggatactgtaaattgaatatcccgtccctaattacattaaactcaggggttagctgcttaaacgtctaaatgagaaaagttcatcctttgctataaataggagaattgttctcttatttagactgaccttggaagctaagcattttacatgatattgtcaggtgagcattataaagacagcctgtaatgagatctgtaatgaggaactaaggtatagtagccctttgaaaagttaatttattcagcattttcttattgcatgatagaattaaagtttgtgtatatgtccggacccctttttaaaggggccagtctcactgttcttggtttactcatattctgccagtagtttgaagtgggttagtattactattccaccttaatggaagtcaccattaaagtagtgaattcatcttgcccttttaaacagagctaatttatttagggagtaggaatgttattttccctaccttctcctcacttccttttacagaaatgatatatcagaatttattcaaaccactttaagcatacattttcctgagaggaaaaaaaaaatgcctttagacatcaataaactggaacggcatttccctgttctggaaaatcagcctttaattagttgatgtgtgtgtcttgggttagtatttgttgtctgttcagctcaagtgatttttgtgctttataagaaaacggattgttctggtgggagatttgattgatttctgcttgttatagtcattgtaaattttagtgccatgcatagctacttgcttttatttactttgttttctttgtcaattgtagcttcattaaaaatctcttatctgttcacagtggaaactcttaaaaatgtaagcgtaactacttatttccatagaacagctcctgctgagtgtgctttacgatttatcataaaaacctgtaaggacaaattgaggctggatgtgctaggaaatgaagccgtccctgggatcactagaagagatttctattatgcaaaagaagtagctaaaatgattgattttgagacttcagtcaaaacataccctgaatgttttctggattttctaatgagacatattgtagaatacaccagaataacgtgaaaaatgtagacttagtagcataaataattaacaagtggttttgggctctggggtttccaaagcaattccatgttatactaagtatactgggagccatccacttacagctttttttttttttgagacggagtcttgctctgtcgccaggctggaatgcagtggcacgatctcagctcactgtaacctccgcctcccgggttcaagcgattcccctgcctcagcctcccaagtagctgggactcaggcacgcgccaccatgcccggccaattttttttttattttagtagacggggtttcaccatgttggccaagatggccttgatctcctgacctagtgatctgtccgcctctacctccaaaagtgctgggattacaggcgtgagccacggcacccggcctcacttacagcttttaaaaatattttcaaccatactaaattccagaaatttacttttagtgtgctatactaaataacaaaacaacaattctagaaaacttgaatttaagtatagtgtgtcttttaatatcttttaaaactagttttctaaaaatatggaacattttacacatatcactttagtggttaaagttatgaaattgaatgttcatacaactggcagttttcctcatcaattcaaacaggcagtgagctttggatgaaactacatttctaatattagaggactaatcataggcaacctaactttttaaaaacaggcaacaattttatgcttccgatacaattagatacagttaccaatcatatcagtccattagctgtcaagttttattcttcttcataaaaagcaatcagaggtagacatttaaacatagattatgtagacacgtgatgtatatatatatgtagcatataccccatctctactaaaaatacatatatatatatatatat

SEQ ID NO: 113954 - DNA, 1989 bp, Homo sapiens
tgcaggttggcagtggcattcctgggattggcaggctcaggtccacacatctcatttcaagatccaggtaatttttctggattagatggttttcacggtagagggcagaaactcaagggaggacagagccaaatttagccaatgcacttaaagcttctgtgtagctgtgacacaccctgtgagcccatattccataggtcaagacaaattgcatgggaaatatgatgaggaaagaaaaaataatgagtaattcaacctactacaccccagatatccacgagacttactccttacttccttcaaatctttgttctaatatcaccatctctgtgatgccctccctaattccaccctatttaaagttttattactcttctattttctgtttcccttccctgatttatttttgttcctaacacttcatactatctgacatattatctaatttacatatatatatatttttattttatttactgcctttcccaactagaatatttgtaagcaccacaagcccagagatgttggtttttgtttattactgtgtactcagtacccagaatagtgcctgacgcccggaaactgctcaaacatatctaaatatcccttccttcccatggaacttttttttttttcttaaattttaaaatcactcatcccctgatgaatctgcatccattttctttggtttttgtggtttataccttcactattattaaaggctctgtgcagagagagacgtaaatgctttttatcaaattagccattcttaactacaaatctgacttcttaaatatttattaaataaagaaagactcttgatttaatgtgctggctttcatacaaattaccaaatacagatttgattgggatgtttctccagagttaagtcctctgtaaaagtgttggagtaaatgaattacttagcataatagctatacaagatatgttttggttggtgatgccaccctctgtgaataggtgatttcttgtttgtccttcatttgaaaaagtaacataatagtcaacctacttgaaagcgaattagttcttattcgcatgcgaatgaagaggcctaggtgggattaaaagcattttctattactgaatacatatggcgttcgtaatttgtattcaaagacctgtttgctatttttggcatggcttccaacctcataaatgcaaaaagcagctccacttcttatagcaatatgccagcctggtctgtcaactacagttatttcccatcagttattcatagtcttagactttgtttcagtaaattgttctgcattgtttactgccctcactacttattatctccccagcccaggtcataatacaacagatacttgggtatcatgatgttatatattcttttccaactcagcatggtgatattgggagggtgatcttattcctgtttttcatatgggagattgatgaaacttgtttttcattttttattacatcataatacttatttgctgacaaactcatcaggactctgagggagccataaatttgtatcagtataatcaatattgatggaaacactttgaaactcctcctgtagaattagagtcagcttacaagccacattacaatggtcttatgattatataccagactcttagttctatgttaatttagtatgaatgtctatataccctagcatttttttactccaaataatgtttatttcccaaaataaatttcattctgcaaagatgaaaatctgtatcacacctaaaattgtgcaatacagatcttaaaactgccagatagcattccaaagtgcttactttggaaggaaaataattaaatgtctaaattattatacatttttttaaagatttctttattgctgtaattcttactgcttcctctgcttttccttttattttattttattttactattactattatttttttgagacagagtttcacccttattgcccaggctggagtgcaatggcgcaacctc

SEQ ID NO: 113955 - DNA, 1034 bp, Homo sapiens
atggaattatccgttatttttaacatattcactctaatgcacatggatgaaaatgactgtgataatctagcagggatcctttgtgttttggtgaagcatgtaggtccgcatcctgcagtctagtataaatggatttcaaaccgaatttaatgaaaattacctttgctgacagtgagcctgagacacagatggtcactgtatcctcagatgtgtttaactccatttcagtggggccacctttgttgtttataacttctaggtatagattcttgtgggagttccaagatttgttttaagcagtttttcctttcttaacaaaaatagtaagcaccatataatgcttgcttcgtttcagtgatattttttcattcttcactctctcttgcacatttatttgatgctcaagtgatgatatacaaatcactgagaatattatttcctagttttctggaatattagaaggacaatattacatagaattttactttcacatatataattatttcaataatgttgccagaagaattgagtatctcttctgaacaaatgccgtgtctaagaacaagaaggatagaattaaatcaatgaggggatggaaagtaaaaaatgggtcagacgcagtggctcacacctgtaatcccagcactttgggaggccaagacaggcggatcacctgaagttgggagttcaagaccagcctgaccaacatagagaaaccccatctctactaaaaatacaaaactagctgggggtggtggcgcatgcctgtaatcccagctacttgggaggctgaggcaaaagaatcacttgaacccaggaggcagaggttgccatgagccgagactgcgccattgcactccaacctggacaacaagagcaaaactctgtctcaaaaaaaaaaaaaaaaaaaaatgtagggagatacaggtatattgtttgtaattcagatctaagattatttctgaacctgaaccagaagatagacatttgaaacagaaattcacactgtcagttaagatcttagttgtgttttt

SEQ ID NO: 113956 - DNA, 1049 bp, Homo sapiens
ttgaagctttagtgccaaaaaaaaaaatgtaaaatatgtcaattattgttatgtattgattccatgctaaaattaatattttggatctctcatattaagtaaactgcattattcaaattaatttcacctgcttttaaaaacttttaaatgtgggtattaaaaagttacgattatgtgtgtggttcatttatatctctgttggaaagagaagaatttgaaaaacaagaaagaaaatgaaactcacatcccactactcagaaataagcattgttaatattttcatatactcccgttctgttatttttaaggtagaaatttttctttccctctccacagtttatttcagtatctcaggaaacatttgtaggggcaagagaaagcaaccccaggaaagcttaaaatgcttgcctgagacgttacatttgttaagtgaaggagctgaaatccaatcccatgtctttctgagaattccacttctatttgcttccaagacctgtgctctttctgctgtagcacagtacatctcttcaaaaacctttacaagaaaaattaaaagatgacttacagtattacataatccaaagtattgagcagaaaagaaaactcatcagggcctgaagttttacatttttatggatagttttatttgggaaggaaatatttctatatttcagaatttctaacggaatttctaaacattggtgactacttatgtttatacagttgttgtatttgggaaaaaacctctgtatttcaaaatttctaagtgaatggctaaacattggtgactaccaatgtttataggattgtttgtaatttttttcctaaaatttattgaagaggtataggtgggcaggggatgctggatatagttaatgttggctgttaatgctagcaattattaataggtatgtatagaattaagcaaataattgctttagagataattttttaaaaatgaaatttgaaggaaaagaaagatacagataggaaggaagaacgaaaattgtcttcgtttgcagactacatgatcttgtcttagaaaatct

SEQ ID NO: 113957 - DNA, 1025 bp, Homo sapiens
cctcccaaagtactgggattacagacttgaaccgtcacacccgacctgacaaacctcttttaaaaccaaactcatatttgtaaatccaaactcagagtcattgctttttaagacaagagggggccaggcacagtggctcatacctgtaatcctaaactttgggaggccaaagtggatggatcccttaccccctggagtttgagacatagtaaaactctgtctctacaaaaaaaaaaaaaaagaaaagaaaagaaaattaaactacctgggcctggtggcgcgcacctgtggtacggtcccagctacacaggaggctgaagtggaaggattgcttgaacccaagaagtggaagttgcagggagccaagatcacaccactgcactccagccttggcgacagagtgagaccctgtctcaacaacaacaacaaaaaagaccagagggaataaaatttcatgtgaggaaacaaagacccaggaggtgcacagtaattttcatagtcacagaggtgggccctagtgtccttgagtttagcatctgtacctgccgattccctgcctctgccttgagtaaggaacgaatttagtagtcaggaaatttatgaaagaattgcccatagggctgttccacaaagtggactccatagtctattaaaaatatgatcttaaaaattaaaaacaaaaacaagctatagcagctgctggttgcagacataaatttaatcctcacagccatgctgttggatgcatattatctccagttttacagattaggatccagagacttggagaggttagttaggtgattaacccaaagtcatacagtaatagttgccaaaacataaaattcagcctatctgacttcaaagaccaaacactttccatcacactatgctttctctcctttatacttttcaaaaaatccatttctgatgaagcaaagcacatgtatgtgacttacgaatgtaatgctgctatagagttgtccagaactgtgtgtatgtacacccgtccctctgacatctgc

SEQ ID NO: 113958 - DNA, 2878 bp, Homo sapiens
tatctttctgtttcgtgctccattactccctaaaccaaattctcagcttcagtcaagtaaactatttatttaccattcccggagcaggcactttgctttctgctatttcttggcctctatacttgcaaatgcttaacatttgcatgtagaatgctctccttccttctcaccatgaaaacgtcttctgccctttttcaaaagttttctatgacaccgtctgcataatctcattgcctctagtaattctacattttccacatgtgtttaattatttagccatgactagttacttgacgttaattttctatcaggtttctgtggatacgtttgtgtccctgtctctgtgttttgttcatgctgcagcgtgttaagtttccaggtaccccatacagtgttctgtgaatgtgcacagatgcaaactgaaatatatttatatgaccatggaagatgattgattcatcttgctgctcactgactgctattttggagagtgcattgtttgtaatcttcccagtgatttaactgtttttattaagtgagggctttaaagcacttaccatttgcttttggctgttctttttgaacaggagtaaaaatgctcatagtgcttggcaattgaatgcttaaatatatacattaattagtctaatataagcttttagatagtgttttttatgttcacgttttgggcaagtattcaggcatccgcacgtctcttctgtttaccaaaggtgtacccaggaagagtttgaagaaacaatgttattaacaattatttatggagttcccagaggcacaaggcatttggctaaatgcttagaatacaatagtaggcaaattcagaaaagggagtttacaagctaacaaggcatattaatgaaatgatcacacaaataaatgtcaagtcaccactcaggtcactcagggaactggtacttaagcagagatttgaagggtgaggacatacctggggacggaggaaggagagaaagaagaaaatacaggtaaagggtagagcatatgcagaagtagcaggtgggagcctgacatgtttgaggaattggaagtagatgattgttgctggaacacagagcaaagcagcataatgcaaggtgagctttgtttaaggacttggatctttggccagaaagcagtaaacagtgctgggggttagaaggatgtgaccagattgctattttgcattattaccttggttacaatatagagcaaattggagactgcagggaggtggtagtggagttgaagagaagtgggtgggtgttggaagatatttagagaatactaatatagtatggatgtaaaagcaaaggaaaaggaggtttccaagatgacagctacatttatgatttgcaggaaaggatggctggtggtaccattttctgaaagggggtatgctaaaatagaacaaggtttgggggctgaggaaagatccttagttctgttgtgaacattctgaagttgagacattttgcagcattcaagtggagatgtcaagccactagatctgtggctgagtagctcaagggaaatgtcaaagctatggatatcggtgttataaagtgatcattatatagatgataactgacactgtgcgtatagatgagattgcttaagaaaaaaagcatagattgggaagagaggcctgagtgattctgtatttcagtggcttagtaaagggacaagaggctacaaaatagactgagaaggtacaagcagaagggcatggaggaagtgctgagagatgaagagtgcagagtccctgcaggcaagagaagagaccatttgaagagggacctaatcagtggtgtagaaaaccatcaaacatcaagaaagatgaaaaataaaaatgctctgcttgattcatttacgtggagaatactgatgagctagcagtgacttctccggagggatgggagtggaagccagagtggatgaaggagtgagcaaggagatggagacagtgggaacagagaactcctccaagaagttcggctatgaataggaatgagaggaataacatggtatctgtatgttcagggaatattttaatgtttttaaaattatagagaattatgagtgctcaagtgctattcagatgtagaaggaagatattggatgtgtaaaccaggtttgtgatcatcaacaaaccataaggatcattcgaacgatattaaattttcgtacagcattaaaatttctcctctaagcacaactattaacttcattccttcattcagcaaatagttattttaacactttctatgtgtcatgcactgttctaggttctgggaatataaatgtgtataatatttactgagatggagaagattcggtgtgggtgaggttgaatttgggggaaaatcaagaagtttgttttggccatgttaagtttgagctgtcttccagacacccacgtggagatgtcagatagactgctggagaagctgactgtagagtgtggcagatgtgaggacagggaccttagtgtccttattgctgtatccccagcgtctggaacacagacataatttgacttgagcactcttcctaatactcctagagaacctaattgatacaaagtttactgtgggacacaataaagaatagaaaacggtaaatctaagattgacaagaaagtttgatttgaatgtaaacctttgtaaccttagccctacttgtagcttttgttcattttaccttcaggcctctagcatttcctccataagttattatgaagccatggtggagggaggaagagggactaaaattcaagatgttgtatagaaaaacaagaaattgctaacagagtattcgtttccaccagataaaaatttcacttaaggccaggcacagtggc

SEQ ID NO: 113959 - DNA, 1064 bp, Homo sapiens
ttacctgggacacttttttcctctgcttgaggttttcagacacaggtaatgtaaattcaatgggcaaacccatttgagggctacctcttggatacaaattcttgaaggagatgtttttctttctccacctagagccaaggtcaaggcaggcaggtttctttgtgtcactttatatagggtagttttgttatagtttccctatactgagagcacaattctttgggagccttgctttatggaagggtttttattaaactctctactttcaaagggacaagccctgggctttatcttcaccccagcgttccgtgtactctttcatgatgaagctcgaggtcaagtttcggattcaccttgtttttggcctcttagtatactttactttcttacaaagtcagtgagatgagtaaaaatgattctatacaattttttatcctttatttaatgttagcaggagagttgttcaggtgtctactttccatatcactgtaaatgaaagtttaagcttttaactatgcattaagctgttgaatcctcacaacaattctcgtggtagatgtgaagaacacacgggttaaagaggtttgtatgactcagctaagatcatacagccagtaaaaatttgaaaaggagtttgaacccaagccgtctaactttggaagctatagcaaatgttggtgacataacaaaggagttcctaacgaatgtagcttgtgattgacctatatctttcctactagaaggaacaaacacaccagtaatgactcgatggatgcatggatgcaaggatggagggatgcatggatggatgcatggatgcaaggatggagggatgcatggatggatgcaaggatggagggatgcatggatgcatggatggagggaagggagggaggaagggaagtgtctcaacatagagaccaggagaagaaatggcactacagagtgtatttatttgaacaaattcaataggagaaagaagaaaggttctatgtcaggaggttcatgcaattattctgctgcatctggtagggtcattgcttctatttggaggttacatgtat

SEQ ID NO: 113960 - DNA, 1057 bp, Homo sapiens
atcttcaatatgcatatttttacaaaagaaatatctcctcttccatttctagatgtacctcacgtgattaattctcatgagtaagcagagatcttgacctgtagcttcttacatctgcctatttgtttagcagaacagagaattacggtaaaacagaggcatggtacaagcgtttgtgtttgctttacaaacacgtctcccaacttagtacaaaaaaacactgcaaactcttaattttagatcttcttaggtttgttgtaaatagaaagtagagtataatgttttatagatttatttctaaactatattatggttacttttctcgtgcttttcagatatttgagaaattgtttatgtgctgtcatgaatatgaattcattattattaaatgttaatgaataattttgcttcaaaataaaatagtgagcctgtatactttcacttgtatagtgtcctagcccatattttaattttttagtttttccctttgttttctttcatgtcagcttcttcatctggtccatcagttattgaacatattacgtcacctccgccccatcccatcttcatgacaatcagaggaggttgctaagtgctagtttcatccaggccattttgtggccaaacgctaagcacactaccagttctatccaatgctcactcactggtgcagtttccatttgagtccagccctatagaaagaagatgacagctttcggttttcatagtttgactaaactatctttttgtgtcatgtaaggaaccaaaatcatattttaaacttgctccttgatagctccttatttaaaattttctgggaatgttttatcactacagatattaaggcatggagaagaaataaatgctttattgtagccacagaaattgttttctttttctaacccaatcatttgccatctctctgaaaaaaaattccaaggccaggcacgatggctcgtgcctcgagtcccagcactttgggaggtcaaggtgggaggatcagttaagcccggtagtttgagaccagcctggacaacaaagtgagaccccatctcta

SEQ ID NO: 113961 - DNA, 1025 bp, Homo sapiens
gtcatttacttttaccaaatggaaaacagagatgatgtggtttttttctctcttacttggcagcccagcaataacttaactaagtgagcagtagcctttttaaggtaagatagaattttaaagtcggctccagatataattctaatgtgtccggtgacactgcagaaaatgtaaatttccctggaaccatgtattattctgggatgtgtgcatgtgtgcatgcttgtgtgcatgctggtagatgttacggtcaagtaaaatgtcagcacagtaattatagaccaaaaaagttcacttcaaagaattaatactgttcaaaggaaaattcacgatttggaaactcacaaatgtaaaactaaagcattttcttttcgttcctttccattaaaagttgagaggagtagttaccactctaggatgaagtctataatagcataaaaatccctctggataggaaagagtgtgttgtttgagttttccagcccatctgatcggatttcagaactctttaagcgcttagcttttggtgtttttgggattaggaatgtgtgttcttgtagagagttggaaagcaaatgttaggcttgtcagcatctgaggaccgcagaagcagtccacccattgttcgagtcacgcttccagggcccagcacttttcactgaggagcctgcttttgaagtgttttctttgcttaattttctccacctttgagatcctttcagaagtattttctttcaaaatatcatgcattcttctttagaagaattggcctttctaataatacaaagaaacataggatacttgtaatctgtcaagtagggctaaaaacattagggcattaaggacagatagaataagggttgtggaagaagttttgcagtcgcattataaattgacttttttccctttttaatttagtctgactatagagaactatatctaggcaagaaaataagaaatgttgggttcatttagaaattgcaattggttttttcatacgtaatgggaaatcaaaatggaaatgc

SEQ ID NO: 113962 - DNA, 1030 bp, Homo sapiens
gtacattttaaaataattgaatataattggattgtttataacacaaagaataaatgcttcagatgatggataacccatttaccctgatgtgatttattacacattgtatccctgtatcaaaatatcttctcatgtaccccacaaatatatagacctattatgtacctataaaaattaaaaattaaaaaaaggtttttttttttttttaaaaaaagagtaactatccccacaacagtacatcacaatcacacacacacaccctgaatcctggcagcattgcagtacacaggaatacgttacttgaattgaaactgcaaaagtagtttaatgcaaacacacacccccacataaatacacttttatttattaaaagacaaggaaactaaaaaactgaagtatgaaggccaattggaataataatgtgtgttttacaattttttctcaaatttcctctttaacattaactcgagagtagattccattcccaaggtgattcagccattcaatatttcaaaactttcgttattccctcgagctcagtgccccctctactgcttctcctacaaacagtgatttcccagtaatgccagcagaagcaacagtgaagctaatgcagtcactctgctagggaagagaagttttcaagagaggcaaaggcacagtttccctttttctttcctaccagttaatgccctcagtgggtggtcatgcctgctctgttcttgaacaaaggacttccttctcaggagcagcaggaataaaaccgacaagtatcacatctgtttcatgctgcttctccagttcccatgggatagcaccacgtctatagcagcagttctgatggtgccacagggaaacaaggcagtaggacatcataaatgaacagatcctgcttgaatgaaagagaaggggaaaagaaaatactaaataacaatataatgaacagtggagaagtaaaagggcaaagatacaactcctcagagaagacaaatgttttagagatagtctctatttggtgtaaggtctgagt

SEQ ID NO: 113963 - DNA, 1043 bp, Homo sapiens
attaacttgtattttaacagatgaataaatgaagtcattcctacacattaaaagtatcttttgatctggaacaagtaagataaaatgagaggcaaacatataatgagtgctttcagtgagtaaggaatacactaggaaaaaagctgttacaaatatcctaataatgcctaacatttctctaaacccttattgattagaaaccattttcaaagttatagtttttattgattattcttttgaaatagtttgtgtccattcttttcttcctaaaggtatctcttccatgcaggtcttcatggttcatgtttcaactaccaccagatccttcgctcctgccaatcattcctgccccagtatgttcttcacctcacttgattttactaaaacattgcttggatcacgtcatcataaagaccttaggttggaaagagcctcaaatgcagcctctcgcctggctcaggaatcttttcaagaggatccctggcataagattttcctgcctttttgaaccattggatagggattcactgctttctgaggcagcttgttctatttttagcttaaagtatcagaaagttccttcttttggctctactgaatgcttctctttaacttccacacaaaatgaatccaatctttcttttatgtgaaaacctttctttaaaaaaaaaaaaaagaaattgtataaaaaatagagacgaggtctcactatgttgcccacgctggtcttgaactcctgggctcaaacagtcctcccgccttggcctcccaaagtgctgggattacaggctgtcaccaccatgcctgggcagtgacaacctttcaacaaatatgagactataagtcttttcacctcaattattctcttcaccacaccgaacattcccaattcctttcttggtgttttcgtttgtttttttgtttttgtttttgttttgttttttttttttttggtccaatatccctgagaccaccacagttcttgacacacggtaaatattgaaggcatatttgtttcctgagttaatgaatggctaaagtgc

SEQ ID NO: 113964 - DNA, 1060 bp, Homo sapiens
tcttataattatggttcagaagcagctatctcaagtcctcccgaaggatatagtgtagtgttgccactatgttgattattcaaccatagaatttttaaaagtataaagccaagtacctccaggaatgaccttaattattgaaattagcatccctcataccaatgatcatttaccagtatgttttcaaactttctatcttaaatcacagtactataaatttttatagtacccttttaagtatccagatttctctttattaagtgaaatacacagaaaacacatttcttgcttgctatatgtagcaggattagacatctacagcattatgctttcaagaaaatttttcttgacattgtttaagaaggagagagaacagtgagatttccacatctgttaaataatcattagcatgtaggattgaattctgtcttctttttcaacctaagaccagctgttgaagtaaactagaagggccccttaattattgcatatttcaatagcttgctgaggattcagttacctagatccaccactctgatcaaaggggactgatttactttgtcaccattgttattgaaagcattccttatttgattgttttgcttctaaaatgttctataaaaggtcagacagggtgtctttctctgattccatcaggcctctgggaagaacctctgctaccaattatgtgctacttggacgggtgctaagacattgcacggcttctttcccttggccttcatacaggtttgcttttgtcaccaatattgctgagtcaaaggtgtcttaatgtccatatggcatttggcatcagtgaaaagcaaattcagaaaaatgaacttatttcctcttgtttgtgacgcgatttggtaccattgccgaggagacatttgccatgagttgtacatctgtatcaaaggctttaatttattttaagggtctccttattaccattggcttcatgattgtttttgtaaacatggaataaagtcttaacctggcataacccacagcctagggactaaacaaaactaaactaatgcctgcaactttggccctc

SEQ ID NO: 113965 - DNA, 1062 bp, Homo sapiens
cttttaatattccatctgctgctcccttgaaggaaaaaatgtggtaacaaaagctaattatatatttatggtgttgtgatttgcagcttattttctgtcctcatgattttcttaacttgtatatttatacataaagaataacatttttgtttattttaaatattctaaaaagcaccactttggtatcatgcttctctatttggggaaatcaaaacatttaaagttacgtgtcttagaaaagtaagaaattctttttagatataatactgtattaaaggaacaaataacactgaatttctgtccttaaggttttcatccctaaacatgaataataataagtcagagagtaaagttctaggttgaaatagcaatttctgcacatttcctcatttttattcatccggttacagagttgaacatcctctggaagaatttaggttgtattcagttattctcattttcagggtgggattaagcatgaccttatgcagaattccactttaaacaagaatgccctcaagcttactttagacaatgttaagaaaatccactcgatgagattttgatatttattcggtagatttttttaactttttctttctcttcatcctgtcacatcatgagcagtttgaagacatcaggttcagttccctagcaaaaccaagtttcttcctcctagtatgtttctttttccttctgctttgagtggcttctgtggaaaaacatcttatatgtgggataaaaacgaaaacaatttgtgtgagagacacacatgcggtaggtctgtactcaatgctgtggactgttaaaaacaaagaaaggttttgctatttaaaaggagaggtaatgcaaatactgcaatgcactcataagaaaaaaataaattttccagtaactataatttaacagcaatataagccagtcctgtgtagagttctaaaatgatgagagtggttagagccaaatagggttcatatgatgagatcttgtgatgtgaagtaattttaaaagatgaaagatacttcttaaatactttggaaattatatggttgaccctctttt

SEQ ID NO: 113966 - DNA, 1130 bp, Homo sapiens
gacccaatttaatttttttttttttgagttggagtcttgctgtgttgcccaggctggagtgcaatggcgcaatctccactcactgcaagctccacctcccaggttcaagcaattctcctgcatcagcctcccaagtagctgggattgcaggcacccaccaccacgcccagctaatttttgtatttttagtagagacggggtttcaccatattggccaggctggtctcaaacttctgacctcgtgatccgcgcacttaggcctcccaaagtgctgggattacaggcgtgagccaccaccccagccccaatttaaaattttgattccttctccagcagttctaatcgcctaccctgccttgtattctgtcaatatcaccttccctttcatttactaatttattatgtttcctgcatattgttctccccttcttcccctccacttgctacaatgtaagctctacaagggcagaggtttttatgtttgtttttagctgtgataggtgcttgataggtgctgtgataggtgcttgagtgaatatctgtggaatgaatgaatcaaccaatactacatgagtctctcagctcacattcttaagaaaatagtcatcacttcacagcctgattgctgtcacatggcccttaagaaaatagtcatcacttcacagcctgattgctgtcacatggcccttgtactctggaagagcactcaggttaatctccctctgacttcttttctcataataaatttcttcccaggaacctctgtgtggcctaccaaatcaggtacagattcttccacttggaggtgaaagtggttggttggccccactttatctatccagaactctctcttaagttgctttccaaaccagtgttgtttggaaatctccagtcttcctgctttgactttgctaactgtgcttctcttcaaggtttagctaaatgttagtctacactttaagccttcgaaaccaaccccggcacaaagcaaatgtttccttgttcaccttcttcatgtagtttattattttgcacctgcctgagatttgtgttctcgctgtctcaggaatggaagtcccatctcctcaattagggaataagcccctttaggccaatacacctgccttctt

SEQ ID NO: 113967 - DNA, 1069 bp, Homo sapiens
tggctacagagggagggacacactggaaactaatttatctgtgagaaggcagaggagcagagtatgacattttggtccttttgagaaaatttgcaggatgttgaggtccgttgctgctgctgctgctgtttctgttgttttaaatagtatataactaagggtgaggaccattagaggacagaaatcacatcttaatcagctttgatttttttatgtttaaaaaagagattgagattcactttgtagtctagggagtttaattaaagtaagtggagacaaaagtactcttttgagagctgtcatttctcttagtgtgacgctattaataatgtagtgtaatgctattttggaagtttggttctttccttttcttttgtcttcctctgactcttttctgtattctaaatgaaaggggaataatgcacttagaggggggcactctcctaaattcactgtctcatgtacgacattatctccgacttcggctctcatgttttgaaaaaatacctcttcatcgctctatttttatttttcttcttcttttattgtgaatctcttttaccaaaaacatttgtagggttcttcacaaagattttttttttcaatcaggatgaaaactagatcatgatgtgaccatttcactgtgagtgtaacttccctttttgacagctccattagatctgccaggttataaatcttcatatttctgacttgccttgaaatcagaaagtgttttcattatgctagtctctgtgagcaacaagcatgaaggaaggcatggcaggtatcatagcccctttgatgaacttacctgtttcaactcagtgccagggcagaacatttactgctaaccctgatgggtcaactttgattgcaaattatgtgtggtacattttgaatttaaagaatgtttctgagattattctacgatcacttgtcatttttatgtgtgcagtaatgtgttgtgtataacttggatttcaacaatatccattgtttgaaagttagaaaatattctaagaatactaattatcttgctcaaataatcatttaagtacaactgtcactt

SEQ ID NO: 113968 - DNA, 2326 bp, Homo sapiens
tatatgcattttgaaaacctttgtgttctactgaaattacccatttaatttcagggttggtttgttaaaaaaagctgaaatctgaaggcacattagaggagctgtcagatgctgttttctgtaggtgttaataaaaccagatgaaaaaaaaatctgaaacaaattaaaaccaaaagcaattttgccatctgttgtgtattaattagaactttgtgtatcaagggtaaacttgctcttagagaatgtcactgaacacccacttaatagaataatatgcaaatttattaggttatggatttatatgcagtttttaattctaattcatctgcagtggatccccaagaaattggtagtgtgtatatacatatatatatatataatgagttctctttctttttttttttttttttttttttcagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggtaacatctaaaatttcaaaataagctagcccaacccttttctcaccaggagcaatttactatacttacatattctggtgtggtgttttggggttttgttgttgttgtgttttcttttttcttctctaagaagcagttccagattgttgtgatttttttagttgctgggtcagtgaatgtgcctattcttttcacacagtttgttgcctacaagagatgagaataaattacttcagtgaaactttcccttaccactgtttgtttttttcttatctacaaattatcaggcatgtggagaaaaggacagagatgtaaaatgttattctcagttgcatgtagtttgattcagtggacatgtctggcatcttcttggttctagacctctgtactttctcagactatattttgttcattacatcatatattcatagtggagccccactatgaatataacacttaagcacaaatcagatgacagtttgttaaggatattgtagtttcttgcagtatgagggagataggacctactctctaaagttccttgcaggattatttcctaagacaatccattcatcctgacacagttctattaggaagtttttccctacaatgaactgaaatctccatccctgaaacttccatcctctgactgtaaccgtacaactagtagtctgcaactatacaaaacaattttgccctgattcatacatgatggcccatgagcttctcagtcttctagaggcttcagcagtttaatggtccttctctgtacacatagcatagtgtttcattaaggttcaaagttaggacttctcgcaaaggctggctgacaagtggtaaactgctcatacaaaagtatgatcagcgaaagctgttttgagctaatccatttcattattcaggatctcctggcatataaaatttcgccttctttctttggacaggagcgtaacagtcactgtctccttgtaattatgtattgcacaaccaacagtggtgtcttaccttattggtcttctgttggcagctttgcggggaggttcccccaacattcctcttattctttatttcttctctgccccagggtttccgttaggcttggagaaaaagagttatcaccatagaaaagccagaaaatagagagctcttgacgccttgagagactgtcccccaaaatgtcctgccctagagcttccggttaacattaggatttaaattagcttctgggtgaacaaagtgtctcacaatgaatacattgctatttctcaccattaggtatatggtctcaacccattctgccttgaggatgagctagcaggaggtccccacagttagttgtcaacaatgaaagtctttctgtgttttcttttactcttgacctaagaacaaggttctaaagaactcttatctttttatccatatcagccacgagtagttgagttttattgtttattttgtattattgaacattcttctgggagaaattaggaagagaaagaacaggaaaaataggcaaacagcagatttctcttcacttaagacacagtcatgtatacggatttttttttcctgaggttattagcacagacgtaaatttacccagtgtaattaattagcacacactgaacagctaatcaacaccgattcactattgtcatttggaaaaaat

SEQ ID NO: 113969 - DNA, 2285 bp, Homo sapiens
gactgactgatgctgatgccatatgcttttgttaaagacagcttggggagacacagggtacctgtggggaaaaggaatattactgaatatggaaaagaggtccaaaaatgaagaacctaaggttacttaacaaaaatttcaaaattggacctgggccaatggtaggaaattcttaaagtttcaccatcatcatttatttaaaaaaaaaaaaaaaagggaaagtcaacttaaattatatactaatgaatagtaaaaaatcacttggattctaagtctcttaaaatatggcaccttttataacttagtatttcttaagaggactaggaagggatattgtttatttgtgagaatgggaagaaacatgaagagggagatataaagttcaagaatttgctgtgtgctgttaatatttaaggcctatttcaagccctggctaaaaaaacctttgtctcagagagaggaggataattgaggaagctattgtaagcttaattcagtgcctaagctctgtggtgaccatatagttcattactaaagccaggacacttgcagagtgagaaggggccatatcaacagttaccctggaattgcagcataaactgatagctgtaccaggcaaagagggacgtgtgattaccacactaagttttatttccaagagtaaagttaattttaagtccaaattttcttatgccttagataaataagaataagaaatcaaacgagaaaggcaggttgaatgcaggtaaggctccagacttgaacatttctaatagtttctattgctaacttagagcaaatatttaaacttttattgacccccttcgcagaaaaagcttctattggcctccaaaatatgtagctcctaaaataatacttaaaatatttgtcttaattttcttctcagagtttcaagagaacacttatcacaatatcaagagaacaagaggtagcaggccgggcgtggtggctcacgcctgtaatcccagcactttgggaggccgaggcgggtggatcacctgaggtcaggagtttgagaccagcctggccaacatggtgaaaccccgtctctacgaaaaatacaaaaattagccaggcggggtggtgggcacctgtaatctcagctacttggcaggctgaggtgagagaatctcttgaacccgggaggcagtggttgcagtgagccaagatctcaccactgcactccagcctgggcgacagagggagactctgtctcaaaaaaaaaaaaaaaaaaaaaaaaaggtagcgtatataaaatatggtcctgaatttactcaaagaataaacatctctgtgtctccagcagcattacagtttgggtttccaaaaccattctctcaggctgaagtagaggcttcattctaggaaagtttgagataaagtttcaaagatggttattaagataagtgagagtaaaagccctattttttaatgtgagattattattaaccacttgtaatgctgtagcctcaacttgattgtttagtgggcgtcacgccaataattaaaatgtgaaagaaggttctagaccaatagcagctctcaaatgaaggtcattctcaggagtcagtattgatatatattctaattaaaacctggtggatatagtagggatacaaatcacagtttagcgtcatgagaaaagcatatgctttagagacctggtttgtaatcctgcatccaccattttcactaactatttaaatgtgaggtcacatatttaaatgtgaagtcagtttccaatgcaataataatacctactcaaaatgatttataagtgtgaaatgaaataaagtaagtggagcacgtggcacatgctaggtgttccgtaaatgtttttaaaataattaccaaatggtaatagcagccattgtgaagggcacctcattggttaatacctttcatcataaagtagctctcatctctccaaacaataagaaaagcatttgtcttaactgagatatttttgtctaatttatctttatgtgttaggtaggctaaacatgaaattaaaccatggttaattttactagattaaaatctcttagttttctcactcttcccgtcgcttaacaaaaagtaggtggatttttgtaggtaggaacgcccagactgttaattttgttcttgagaagaaaaaaaatcttcaaataataatgaaaggcaactattcatatccttgaaacatttaattaactaaagtaataaatgtttggaatgaatcaataaaagccttcatagatgcattgtcttcacatcactca

SEQ ID NO: 113970 - DNA, 1065 bp, Homo sapiens
acactctccagagaactgggcgtccataaagcaatgaatggattatatactcattcatatatgtggatttttcttctcttctgatgtagtattgatcatgtttttcatttgatagtaacccaaataatggaagctactaatagaagttgtaaatattgcttttatttaaccatttcataacatatctgagcattcacactactggaaatcgctttttaaaatgccagaaatgaccacattgtgttttgatcttcttctaagtataggaaaaggcctaccacattgaaatgctaatggtgtccactgagataaatcacaggctttgtggtttatccaccaagaacaatagccagtgatgcatcctcaggtttacaaagcaatttgtgatgccccatgaaattctataactgaataagagtattgcagagctgtatgtagaatactatgatgtttctgcagtggaccagtatcttccactggctacaatactcctgtgatataattatgcactttggaaagtgaaataaccattttgtgtcagtgttcaatgggaaaacagaattgtagagcatgaaggaactttagagacaattgagtcaggaatggcaactacgtgacaagttatacagtattttttccaattttttgaccatggaagacatcattaatgattcacagcactttctctccttaacccgattacatgctgcttatcttcatcagagtgcttcatacagtacctctgacggcctctaccagtcagaggtaaaagcaagatgaaacctttctgttacctttctgtcatcttttaatctaagttaactttctccttataaagacggtcaaaccagatactgaaggggttgtctcttgactaggatcacaccctagtgaaacaatactgctgttgtttcataacagtgaaggtaaatgagtaatttcacaacaaaaatcaatattccagagacagatttctagtattcggttagaaaatgtatcagccatcaagagattctcttctagttagctgtgtatattatttgtacctgtcagaagtgtgctgct

SEQ ID NO: 113971 - DNA, 1081 bp, Homo sapiens
tttgggtttaccttaacgcaaaggtagaggatcatgtctcttaagaatctacaggtgttgcagcaaagtagcataaatttgcaagtgacctgtggtctagtaagtggcaaatgctgttatagggtgttctaccagttacttaaaagatggtgaaaaatggaactcaattagagcaaataatgattgattcctaagagtttcctggtaccaatgaagtgaatagtattaaatcactattgaagtgccaccatattgccctgcattgctatgtaaattatatttgtttgaggaactctttgttttataattttcattgcgcagttatccttggtatttcagaaaatggaaattgtaactttacatatgactcttgttttaaacatgcttagcaattgccgttgtagctgaaggcagcagatctttaaacaacttgtgttctttacccccagcaatgcatctctttggcctcaactggcagctacagcagactgaaaatgacacatttgagaatggaaaagtgaattctgataccatgccaacaaacactgtgtcattaccttctggagacaatggtaagcgaaagaattatgtatcctgtgtttctcttttaacatcccttttccataaatttatttttacccatgcttacatctagtttagatggaacagggaaaagtgttcgaaattacagatatcatctttttataagtttttttcaattaatttacttgaaaggttgaaaattcacatttttattacaggaataatatgattttctgccttctgatttgatggctaggcttttctgcctttcccttctgcagatgtatattgagttttatttttagtctgcaaatagattataattcagtgtatcatctcttgtattaccttgggtttattaggttttcttcattcaacttgcgtgtggagttggaacactgtattaattttattataaaagcatttaaatgcaaagcacattaaaggattatagtttattgaccttttctctggttgccctttctctaaacctttaagaatttgcactttgagctaacaaagattttgaaatcaattg

SEQ ID NO: 113972 - DNA, 1051 bp, Homo sapiens
aatgcatggttcctgtgaagatgatcgaatggtacttattaaccatacatgtagggaacttttttacagactgaagaaattgtaattataccaaagagacaaacgcttattatggatattgtatttattttacaacatcttaaccttttattatgattaaaatgaaaatagagtttggctaattagtttcacagtcctgaaaagcatgatactgagaaagctgtggatttagagactcccacagcctgggtgctgggtgctggctgctggtattttgccagggaatacctctgctcacgtcagcactcctcagctcacagaagcctatattcaaatcctcgctctttcgcctgtttactttgtaactttgggcggcgtgcttggttattcagatttgcaagaaaattttagggcagctgtggaatgggctgcctaggatcctatcagtcgcagaggtttggaagaaaaaagaacatcacatgaatgtggccatattaatagaaatctccgtaaagctggagtccttgaaaacagtggcttttaagctattgaccatgacaatgcaataagaaatacatgttacatcaaagccaacatatacacacacatatacatatgtatctgaaatatgcttcccaaaataatatttatccttgccttgtaaaatgcatcctgggattttccattttattttattgtatttctcatttttaacaaacgccacttgcaacccactaaaataatttcatactttatgaaatattgtgctctgtaatttcagaaatactgctttggtagcctccttctctaagggggactgaagttcccccaagtgatcatagaattcagttttatacagttctgtgcacctttagagcacctgtatatacatataagcgaagtactttcttcctagatgtgtaaaagtctcctatatagggaatggttaacggaagccccagaatcagttaagtgcactagagaactgccaactggactaggggatttgtaggaatttccctgcatggaaaagctatctctctctgggctc

SEQ ID NO: 113973 - DNA, 1085 bp, Homo sapiens
caggctgccttgaactcctgagctcaagcaatcctcctgcctcagcctcccaaagtgctaggattattggcgtgagccacctcgcccggtgcttccagccttcttgaacatagtgtgcttagtcactttgatcacttctctgccttctgtttacccccttacagttgggctttcacagtacccctagctcatgacttgtcctcctctaccttcaccacacactcatacttcactgaaactgatgtctccagagttacccattgctttgtcagtagcaccagtgaaacctctttattctttatcatgtttgagtttttggaaccatttaatagttaacctatccctcctgttgcaatagtctttccttagcttctgtgataccacattcactttgactttctccctgactgttttggcaatgatgtctctgtttagttgactcacctcccgtctacctgatccctaaatactgctgtttctcaggactctgcgcttgacaatataatcactctggattctgtcacccactttcatggctccagttacattctctgtgcttcctaactctcaaatcagtaagtccagcctagatgtctctcttcagctccagatctcaactacatattttgtagacagtggtggtagtagtagactacataaaatctacccaattgtctttggaacatttccacttgggtgttttccatgcatcttaaactccacgtgtctaaaacagaacccatcaactactttggttatctattactacataacaaaccataacaaaactcagtggcttagaaagcaatgttatcatctcttgtggttcagtgaattggccaggtacttcttgcgttcttacttaggacactgcgattgctttcagatgttaaccaaggttaaccaaaggctccactgagctggaagtccagggtagctcactcacatggctggcagttaatgccatctgttgacctgagctcaactgtagtcaccagctggggcacctagacatggccttccatgtggcttgggcctcttagaacatagcagctggttctgaagaggaatatcccaagagggag

SEQ ID NO: 113974 - DNA, 1013 bp, Homo sapiens
tggataagaagggattcctatattaggaaatggcaccgtcgttcacttcatcactggtccaggaggcccggtgactgcttctactctctcatctcccgtatttagtcagtctctaagttccttcaactctgaccccataatatcttttgaatcctgttttctctcagctggatatggtagccttctatctgcgctgtatgtctccagtcttgctcatccactcttcacacacaaatttgagatatcagttccttgcctaagccccttcagtgacctagattctagtcagaagcctttaaatgacttacaaggctctccacagcctggctgtacatcacaccatactgcaatataaaaacaatagcacacagagacaaggagtgtagagttacgagcctcaccacctgatgtggtgtcctagttctgatcattaacgcctgtgctacttgggacaggttatatagcttcattgtgcctaagtggtctcatcaattaaaagggactaatttacttcatagaatggtctttggtcttgaatattcaatgcaaatatacaaaggtgtaaacatacaatggtgtatagtacatagtaaatgcttgaaaaatgtttatggttgtcactattactatttaatgcatctcatctttactagactataaggcaaggatcctgtctgttctttcactgctgtataccaagctcttggcacagttctggcatgtagtaggtgctcacaaagtatcagttgaatgaatgagtgaaaataatacaactaaatgatatgatataaagtatacgaagggccatgcatcaagtatatgcaaagtactagtatagaatagtggctaagaactgaagctctgccactcactgggtgcctttaagcaaattaccactctcacctcctgtttctttatagggtaatataaaggtttacaatgaggtttgaatcaggtcatgcatgcagggtgccaagcaatgattggaacatgaaagctattcaatgcatatc

SEQ ID NO: 113975 - DNA, 1228 bp, Homo sapiens
tacaaatgcccaaccttgcttcctgacgtcttaattattagtgcctctgtgggatttaagatgatattatcatttaccttccgcaacaattgcagttagactttgacagtgaatttcttttctgcctttccgtttcactcattataggcttgtttactcacatcataggcaggtggcaaattcatgatatatatggcagaaaacttagcattttataattttcactgatttttctgatagcacaaaatagttttcaaacagataccaaacctcctaattaccaatatgactttaaatcttctgttttgtccttacagcatctcggttggtaaactattatttataaagtgtttttcagttcaaagtacttttgaaaaggcattatctgaaaagctgtcactccactgatgtgttttcatatgaactgggtatcacataagaaggagaggaataacaatagctttgcgtatgtggtctctctctgttttcacactctgacaactgtattttaagacattaagactgttgtgacacatacttactgatgaaagaaaaaaatcacagttagtaggtgaaaagactgctagtggctcccacattcaggcacaacaggacacgttgaaaaaaaccttcaagatgataccctattgtgtttgaagacgtggtacgtttcactcttactgtgaaggctttaattggtttgattcctaacccacaagctttgagtttagaataactacagggcactctgttgccctgtctctattttttcctccagttttcctccttttccttttagtaaaacctacagacaaccttagtgtttcctatgatcattcccaggttcaggctctagggctttatggaggtagtgatctcagtaagggaggatagagagccctagaactggcctttttttatttcttctgaagccaaagttttctggaattcgggacatgatgaaagacttctgtgtccaggcttttatctaagaggactgatgagcttcagaggaaaaagttgtgcaagtatttacaagtttatcaaactgtgtcaatggcccactgacttccaggtgtgtttaccatcaataaagagcatttgaaaatgctaacaggaatgaacacacttgacttgtccaaatgagagaatggctgtgacttgaaaagcagcagtgcagaatttaaagacaaagccccttcacgaaaccctagtcccctgtattcaa

SEQ ID NO: 113976 - DNA, 1071 bp, Homo sapiens
agccaccgcacccagccagtctagaccattttaaagtttagatttgactccagttcatcttataggtgacactgactaggatataataaccagattttcttaaggctaggcacagtgacttaggcctgtaatcccagcaccaggaggccaaggtgggtggatcacttaaggtcaggagttcaagaccggcctgaccaacatggtgaaaccccatctctactaaaaatacaaaattagccgaacgtggtagcgcacacctgtaatcccagctactcaggaggctgaggcaggagaattgcttgaaccctggaggcaaagattgcagtaagtgagagatcgtgacattgcactccagcctggacgacaggagcaaaactctgtctaggagaaaaaaaaaaaaagcagattttcttaagtggaagtcctctataacttcaattatagtagacagattggatttatagcaattgtccagtgaaatatgaaaaaatattttcccactgaaaccgcatatgtgattatttgtgtataattcaagaaatatacctctaagctgagcacaatagtaaacatgtaacttacaaattctagaaaataatttcaggtaagaattgtctattgtgttgtgtacttgaaaggtttatttaaagatttagttgactgcaagttgtatataacatttaagattagagaaatgaaaggtgcagtttcgggttttctcataatccttctagtatttaaacacaatacatgtgatatcctcttttcttttctaccacaatatatgtgtttaagtaggttatgcattttcttaagcttcacggttattatagtttcttcctgtggtttattcaagatcagcagagcaaacaactgtttctgagttcagtgtttaaacatgaaatattgtataaggcagcccaaattgaacatttctctgtttctggagaacattaaataaatcaacctgaaataattaaaattggccagccattcagaatagttgcttgagctttcgcagtctttgtgaccctttgtaaaactgcccgtttgattgttgccaaggaatca

SEQ ID NO: 113977 - DNA, 1679 bp, Homo sapiens
gatttgtgtatctttttgtggccatacaagggacaatgcaatacctctataaccaaacagctccatgccccaggtcccagaatgcctatataccagaggcagggcaggaaaactatacctctgatcacattccctcattctttgtgactccaccacccgatacccgatacatcagaagaaatgagttgagtctagctgagggagaaaagttatgatctgactgtatgtatcttaggaagtacaacaaacacgtgtgtatagctttgaaaaccaggaagtgtgccaaaaagttatccataggcggatttaacttaccaaccaatagttattcaacaaatcattttagtgttgttctcagtggccttggtattattacatggataatagtttcccatagatgagctgttcttgaacaaatttctagttgtttaggaacaaacaggatttttattagcagtgggtctttgtattataatttaataaaccctgcaatagttcttaacaattccatttcctatcattttaatttattctgttgcttttatactccatatgaataacattgtgggaaataagggacctgcttcatttacaaataaatcttagatgtgaaccttttaaaagatgtagagcacctttaaagcattctgctcttttatactaataagatgagttatttccaattttggcatacaaagatccaattgcctttcccctgtttccttactacctgtgtatatgcccaccatagtttcctggttagggcccttagtggccctacggggccatttgtgagccacagattaaacacccaggaaactctggtgtgttttctcacttgggatggttactgttcttgcatttcctccccattttaacccctacgcatctggctgaaagaagctgccacttggtgaaagaatgctcataaatcagccagatttttttctttctccatattatgtgccatctcattgaataccaaacaggaaggttaattgaaagagaaatggaggagaaagtaaacagaagcaaacaaaaattcccactagaaagcaaaggacattcttcattagtcatcctactgtcttcataaactctgtctatgctttcataaaaccataggcattttgatagtaaaataggttatgaatttggagtgttcactgaacaccctgtctacctgaaagggttctattctgatatttttattagagtattcatattttcctctcattatgaatcatgtgttcagcaaattaggcatattcgtctgcaggttcatcatcccaagtcctcctttcttgggtttccctttgattggtgatgcatgcagatggaaaatgaaacaaggagaaatctacttttagcaatattgtgattaaaatagatacttctcctttcctccccagaaagcattcatgattattagaccctttaataaataaagaaaaagagaagttacatgattaaaccacatcaaataagcaccagtacttactgctaaaatgatttaacagtaatagcaccgatatagatgctccactacaaaaatactctcttttatatgtgaccattccatataagcttcaaaggattatactcatgtgctgccactgtttttcatgggtaggaaatatgtaaaaatatttagaggattcagagacaagttaaaaata

SEQ ID NO: 113978 - DNA, 1066 bp, Homo sapiens
cctgtggatgcagttagttggccatagatgcaatgcaaatgcagtggtaggctctgctgaacagatggttataggcagagtcaatcacttttaagtgtaatacgaagtaaataacctggacaatgataaatactaagtaccaaatttttactactgctaacctatcacttccacaagaaccattctttttagtatttgttgaagaggtttaccccagaattcattcatttgtatcccagagaattggaggctgtaagtgagattgagaccatagcagggtaatgattgaataacatatttgattgttatctactatggagggttgttgtgaaggaaaagaagactcagctctctgtagacaggcaagttgtcttctggaggctgattggcattttccatttatccaggagacagaaatggagaatatgggtttacaatgtataaatgtttgttagatataatgaagaagctcgagtcagaaagcatatttaaatcctggaacaagctactcaagaaattttggaacctcccaagtaatcgtagtattgttaaagtttaatactatgattacttaggtgtgaaacactggaggtttcgtcagttctttttgttagcttaaggagtatttttagaatgggagttttttttttaacttctctccatccgttatcctaaaagatcaagtctcttgtgtagtagccctatttgaaggacccctcaaggtctcttgcagttctaggattttttcgctgttgataatttctgctttatttggaaaactactagatttaaacatggggttctctttttatctctatgtcatttaactttttgtttttcctatggcattgaaacatagtgagaaaccatcttcactttttcagatcatttggggtttgttttgtgggatgctctactttgcatgcctcacttactttttatttgttaattaattcatttatgtgtccagtaagcaattattgaacatctcttctgtgatactgagaacaatttcttacaaaagtcagtgtaagataataaaaaaggtatgggctttgacatttta

SEQ ID NO: 113979 - DNA, 1067 bp, Homo sapiens
accacacctggctcattttttgtatttttgtggagaaggggtttcttcatgttgcccaggcgggctggtctcacactccaggacgcaagcaatccacctgcctcagcctcccaaggtgctgggattataagcatgagccaccgcacccagccgagagttgttttttaaaatcgtgatgatgaaagaaaggtggaggatattgatgtatttttcttctagtaatgtctcaaacacagagttgtatattgagctacattgattttcatgtacttttaggcagttcacttggaaatttggcctaggggaaatcctaattcctttaaactacaaaagagcagctatttgtttttattctaattcttagtacattaggaaacaagatcattaatgatcacaaagacatgctttgtttgctcagacaaaactcacacatgcagtactcagcatcctctgttaaacaccagggctgcccttgggctttgggatgccgaaggttagaaattgagaatgaaatgcacacagctggggaggtatttcggaaacaagatggggtggaaagagagaaagagcaaaacttttactgatacagacaagcttaggcttggtgttctaattcttatctcagataatggtgaaagaatagtactttaattgttaaattaaaaagtaagtgacaaatttgaaaataaaatgaccactctgataagtgcttcacttaaattacaaaactcaatattctttgcaacttttgtagtgtttcccagattgagcatcatatccaaaataaaacaatatgtaattctaaaaatatctttttagattttaagtcacattttgtttataatttccaataacagtggatatggggcaccacatcatacccacaaatagctgttctgggaggcatttggcttcacatcagtcagtggttggtagtggtgatgaaaggcaaccttgcgccaaactaccagcgtccctgaccttgccagagacaggtttactgtgaagctggtgtagcataaatgtcagggtccttcatttgcactggcacctcctaagatcccaca

SEQ ID NO: 113980 - DNA, 1051 bp, Homo sapiens
ctcagacttgtaatttttaaaagaagaggtcacttaatctcttttctacaaatgcaaacctggttcctctgacctttctaaaaggtggaggccctgtttggttgtcagtattctctactgtttcaatatttttaaaactactacaaagataatgtttattttgatgttgtaatctatgttgatgttgcagtttgtctgtccttcaaattcttctttcgtatttgcttgtctttacatacaccaatttcatcaaaaaaaggacatggagccttgggttccgcttccttgcagccagcattgagagcaatggcagatctgcactctgagccaaattcgtctttcgctcagtgttccacagcctgttgagtgagagagtaatcaaccaccaaaaacaaatttagtggcctaaatttgaaactttagtaagtttgactctgtgtttctatcatagtttagccttaaatactacctgccaagggtttatgaaatcattccatttctactgttacaatctgtatactataaagccccaaaggtggtagtaatttggactcttctaccaacctctggtgaagtgtgttacagatttaaccttgtagtgtccctccttccttatctccttcaccttcccgtgtgagtcatacgatgacgtctccaaaagtcccattagaattacaactgcaactcagtttacagattacatcctcaaaaaagtaggtgagactcctcactgacttctgcacctgacttgctgtgtaaccgtcaggaaaagtcacagtcccgagggccatgtggatacacgttctccagtcatgttggtgatttattttccactaaagaatttcccaaggcctcggtttctgtcccttagaatgggagtaagtgtggggataaacagctctcactattgacatcaggccttgagttccctctttctccaccctatccttcatgccgtaatttatcctcatgaaaaagacaggcagcagcatagtcatcagctagagctgcgtggtttcatatcagacggcagtgccagtgctactgagag

SEQ ID NO: 113981 - DNA, 1041 bp, Homo sapiens
tttgtgtgagtatctacacttttttagaaaagattaatttatcttgctcaaataaaattactagtgaaggagcagaaaatatataagggcaagttgtgatgtgttctttattccaaaaagctgaaccccatgttgaccaggaattgtgcatctaaccagcagagggtttgtgagagacaaggaagaaaacttcctgattccaaaatggagttgtccctaccctgggaacaggccagttcatataaagaatgttctcagcaaaaggagggcagcttggggaggcagagtacaaggggcttctcctgctggtatggagcagaatggaccctggggcttatgaaaccaaatcattgccaatcccacatttctttcctcaaagtcagactttttcttttcttcatagtcacttaaaaaataccagctccctcatgagtttgtcctttttaaactctccctattaataagatgaatcaataatatttaatatgtattgagcatttactacttgctaaggcccaatgcaaactgttctacattaattatcatgtttaattctcaggtagaagctagtaaaatctccactgaagaaactgaggctccaaaaggttatgtaagttttctgtggacgcacagctagtaagcaacaaaatcagaaccatgtgagcgatttccaagcccacgctcttttttttttttttctttttttgagacggcgtctggctctgtcgcccaggctggagtgcagtggtgcgatctcggctcactgcaagctccacctcccgggtgcagccattctcctgcctcagcctcccacatagctgggactacaggcgcccaccaccatgcccggctaattttttgtatttttagtagagacggggtttcaccatgttagccaggatggtctcgatctcctgacctcgtgatctgcccgcctcagcctcccaaagtgctgggattacaggcgtgagccaccgcgcctggcccaagcccatgttcttaagccctagatagactgtcctgcctcctgaattatttttc

SEQ ID NO: 113982 - DNA, 1050 bp, Homo sapiens
taaacattttcgatgagccacatttgtctttcacattcaaaacttccatgagtctttgcctacctgtaccagcaagtagaccaaggacccgcaggtcataggcttgaaacccgaatacttgcctcatttgttatgttccagggatggctgtgtatctgaatgtattttgaaaaacagttaaggccaagaattagccttggcatttagagtaatctgtagatctgccttgtgctttcctacggaatccatgtagaagccatgtaaaagaaggtggaactgcctggtggctttggagaacgaagtgtctggttctgagctcctttcatcagttttttctactggggggaaaaaacacctttttttttttctttttttttctaaatctccaagagacgacattgtgatagagtggtttagagcaagctctggagccaggcagcctaggttgccaaggtgttaccttgcccaagttaatcactcctctcctctgtttcctcatctgtatttactgtctcaactgttattacatcatagggttgtggtgaagatgaaatgagagaataatatatgcacttagaacagtatttggcacaaaggaagcctttattattacctacagcgagcagggctggcggcaaagtgcttcgtgtgtgtccctggatcattctgaacctggtcagagctacgagatagaggcctgggccagagctagaaatttaggaatcattaatacatcagccaggtgttcataatctgtacattacagagccagggctcatggaagagctaaaatcaaggcggcattttgtgtttgtgaacatatgtgaatttttctgggaagagaacccaaaactttcaccagtttactcaaagatctgagacctggcggggcgtggtggctcacgcctgtaatcccagcactttgggaggccgaggagggtggatcatgaggtcaggagatcgagaccatcctggctaacacggtgaaaccccacctctactaaaaatacaaaaattagccaggtgtggtggcgggcgcctgtagtccca

SEQ ID NO: 113983 - DNA, 1016 bp, Homo sapiens
gttctctatgatataaaatgcaaatgaagaatcgtggtatctttctcagtacagatatttttcttacggttggtttttagccttttgcaaaacttgtgttaagagttgcaaatattttaagtattatgttaattttgaccggctatatattttaaatgtattttctactttgctttctacttctgatgttctggtgacccaaagacctacctttacctgtaaatcaatctacagctttgcataattgattctgttggcaaaaataatctgattggctgattagaaataattttgtccacccttaaaactgctaatccagatcagaattaagttgtgttatttattttggttgtgcaggcctaacgtaaaagcaaaaggtttactctctaacagtgatcagcgttattaatttttgtaaactaagaatttctgtagaaatactaccctatgagaatcagaaactccagaagtttcgatggcactttctttatgttcaaatcatcaattaagctgttacagggttctactagtttatatggcatgtaaagtatatagcatggagaaggaattataaagaaattatatgaatgttatgcagtaatacatttttattttaatgtttaaaaggtaaattatttttattattataatttcagagtagcacctaacaccatatgttcttcactgtaattttccttgcatcatcttatcaattagctgtaaacatgcttattttaaaatgccattcaaacgcctctaatagaatcctgtggcaaagtgaagaatccttttacatacacagtacagatgtatcaaaaccatgtactgttttgtttacacacatgacagaaccaccacacctgagtggcccaactgagggttacagtttcagtcattctgttaggagtcctcctaccacttgcatatgtcagcagtgaaaaataatcaacaaaagcatctttgaaaagcaattttagatcattaaagatgtatgaattttgacaaggcgggagatt

SEQ ID NO: 113984 - DNA, 1082 bp, Homo sapiens
tttgagggaatttttttaagcaacaaggtgctttaagaaggcatgtcttgataaatgaccagtaatgtttaaaacagattacaaatctagactagggattctgaaattattttgttgagatggcttttccacaccgtacaatataccttgttgcttggctaaagggaaaaaatttaagttaattttgtctggcctgcagctatttagtggatcgttgcatatatttctgtcctgcacaggtaagtggtgtctcaagggtcaggccaatcaaagatgccacttggataagaattagattccatagataacgttgctgtttctatccatgtgcaattacagtatttgtgctgtttataaaggcctgttcccactaagtgtcccttatctgtttattttaggtgcaaaaactcaatactcaaatcactggtgttttccttctttgtctcgacagagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggaggtaagaaatactgagcatgaacacgagtctgtgccagagcacaggttcgtaagtgacagtgagtacatagatatctgttgccaaaaaaaaaaaaaaaaaaaaaaaacctgatccccatcgattagattgattgaaaaatgtatgagtgctgatagaatgattttgctctccatttttcctgaaacaaatgcaagattattatcattcagggaaaaggcaaggtaaccaagctactgcataatgtccattgttctccattccttttcctggtccccaggtgactcttctcctcaaccacagtatttagggctctgtgaattgggagctccaaagcagtattttaataactgacattccaaaagatgcaaagaattttccagcctcttctgttgaaaggcatggatggaaaaaaacaaaacagtaacagagaacagtcccctggatgctgtactctagtgacgttttatccttaacttgatactcg

SEQ ID NO: 113985 - DNA, 1263 bp, Homo sapiens
aattctttaaaaatgtctttcttttagatgtaccaaacatttccttctctgatgtttatagtattagtttgctaaggaacccctttaatatgtagtaagttttacctcatccttgttccaattctcacacattgcaaaatttaaaaattacattaattaactaataccagccaaagggcacttaaacatgtagaactaaaaatcaactttgtgaattttatattaccaattaaaggatcaaagaaagtgtcaatcataagtctgtgaatttgaatccattaaagtgtagataccaaattataaaaattttattcagtaccccttattgacttaatatttaaaaatcaagcaggcatggaaatatcacaccccaagtccctgcttgcaatattctaaacagtcttttggttaccataaaagaagctgttttacttttatatgtgaatatagtttgttatgcttcttcaaatgtcttgtgttctaaaggctgtgacacagtttccaactcagaagatagaagtgctaataatatctgttctctggcttgttctttgtgaatatttctctagtctaagaaggttgaattatgacaaaataaatgagcaaatccagcctgcacttaccactggatctgtgtctaattgaatgagactagagaagatgtcttgataattgtgatgatctaggcaattcaggatgagttaagaatcaaggtgtaatatactaaaggttcttaacttgatctcagtttccttggttttgctattagtcaaaattgtaatatttcaaacctttctgaaatagtgaaatctcaaccaatcacatgagaatgctgctgtgcttccgctcagcagagatttcccaaaaccaagcattttgaaaatccctgtgctccagctgctggctgcagccggttccgtcgtggtagcctcacgttttcacagtagatagattactgacctaaaaattcaccactcgttgtacccacacacccgcctcttcagtgctttggcttttcagaaagttggaaagcaagcacgagctcacactgtcaactctctatgctcaaattaggtgaccttgaatcccagtcctatggcatatgattcagagcttcactgccaccagtctgtcaactagaaatatccagactcactttttttccttttagtacttccatgctgatccctcttttcatttaggagagaccagcatctaacaaccagctctaatttgccatcctagcctgcgctgctgggaatt

SEQ ID NO: 113986 - DNA, 1047 bp, Homo sapiens
ggcattctctctttacttccccactaggataaaactgatgacaataaaggcaaagcttatcacttgaatgtccattcgtttttgcaccaagaaaactcacgtcccatagctaaagaggatgccaccaccactgaagctgccacctcaataatctgtttgtttgttttttctcaaaatgagggcatcctgaggaagtgtgcatgattcatttaccatgaatgaatcatcattgttcatcattactctctaaacaatttaaagtgggtatattgagtcttcattattttaatagtttaggatattataaactgctgttataacagcagaagtaaaaaaacaaatttaaacctaaccaagtttaggtttaacaaacctaaacctaaaccaagtttaaacctaatcagtttttttcttttaatattttcagaaacaactcatactttagttaattattgtattcctgcactttctaaggttataaggcaaaagacattgcactgtaggaagagacaggacaaaagcgagtataaggacggttaattcttagtgagtatgtagtatgcgctaggccctgttctaaggatcttacatatatagttcgtgtaatcctcccagcatcctgtgaaatatgtattattatcaccacctttacaggtaaggaacctgaggcacagataagttaggcagcatgcccagatcatacatttagtgttagtaatgaagttaggacttaaacccaggcaatcgggtacagagttcatactcaaaagatgtacaactgagaagaaaaaaaagtatgtgtgttatgtatacacatgagtgtatgcataccatgtacacagctagtcacagttaactgtataatcagggaggtaggaaagactagaggggcctctccaatgtcatgtctttcaaagtagactcagcttggtggagttgcaactctgtcaccaattatatatacctgaaagaccagctgtgtcaacattagactgtttatagaaaggaaaaaaaaaaaacctctaaaattgctctgaatgttatatt

SEQ ID NO: 113987 - DNA, 1160 bp, Homo sapiens
aggtatgagcggaatcagtagtatattgtacttcactggagaatttgatggagacatgcttcccctggaataaactttatgtccctcattcaggggcagttttttaatggctttgcattgagcacaaaagatttagacaatttgcttctttgttttagggtagacacatactgccttttaaaggtaatattttttaagatgactgttagtaaattgttgaatcctcagcgtcaggcaaggaaggcaaacagtaatatcagagaaatgctacctgtgagcacattcttttgagtcattattaaatagacagtactattcatgtctaatctttgatcatggattccagactataatcagtttctcatgatctgttttattttgcttttaatttccctctgtgtattaggagtaactccctttgatgtttatctatgatccttttcacagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggtaccggcagttggcgatttgaggatttctttttatttattaaaaaaaaaaaaaaaggggttgaaaatccatttagtgcctagtcatgtttaatgctgagtctaactttttacctttgacagtgttctggaaagctgtttcacatctagggtttttaaaagccatgtagcatgaaactgctagcatcctaacttggttttacagtaaatactaggttcttggcattttttattatcataccattttatcagctcttcaaagaatgaagcaactaactactctatataattcaggccacatcctgttcaacttcaaggaagtatccaaattctttcatagtcctggaatttctttgtcatgaatgagtcccaggcttctttaaaacccatcactaagcaaccctgtgagccctcaccctctttggagagctgtgaaacttttgtttctatgccatgggaaaaaatccttgctgagaggaat

SEQ ID NO: 113988 - DNA, 1050 bp, Homo sapiens
ggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggct

SEQ ID NO: 113989 - DNA, 1063 bp, Homo sapiens
gcagactggctgaagtagaggttgggttggcaagccaatcttgtatataatgggaaaacattattttaaagaatgaaagattttaattaattaaaatacagcaaaatcacattttcaccaatacttattacatgtcatatttaaagtatatctattaaatcttataactagataaattgctgtaagggcaactacactattccaaaaagcattattaaaatatcttacaaaatatcaccctcacaattttatatatatccatatatataaaagaatatcatagtttaacaaaccagtgtttaaaaatgacttttctaataaaattagcagaaagactgcttttaaaaaccagcgttttgttaattttcctcataagctggctacagcaaagacgactaaaaaatgtctaagaaacctttatgcattttgcaaaataatgtgttaaagaagagcacttaacccaaggaattcagaatcatcgtgtcagaatgacaaatgatcattttttttcttcccatacattcttgtaatttggctgtgaaagagcaaaggccgcctcttctaagggtcagaaactttaaaacacattcaaaaggaaatgcacaaaaagaaaagggtggggggaggtgtcattatcaggccgcccctccagaagcactgtctgtgttcagacacagcagcacgtattgtctgtgtaagtttgagatggttaatgggcaaactcaacccctgtcgctactcatcagagccttgacaacagagtttctgctgcttgtctcccgacctgggtgtgcggcgggatgtgagcatcctaatagaggcagcggggggcttctgaatccccgtcggaatgcctttgtttttgtagttattggtgaactggccgactcccagaatattagtacgtgtctgtaatatttcccttcatttttagagtaccatgtgtctatgtgtctactttagaccttacaaagggcagcctgtaagttcacaaagaagggatttgacaggtttgacaatggccagagtgtcaccaaaaccacaacgagattgtgaaaaaaaa

SEQ ID NO: 113990 - DNA, 1011 bp, Homo sapiens
ggccaacatggtgaaaccctgtctctactagaaatacaaaaattagccgggcgtggtggcactcacctataatcccagctactcgggaggctgaggcaggagaatcgcttgaacccgggaggcagatgttgcagtgagccaagatcacgccactgcactccagcctgggtgaaaagagtgaggctccatcccaaaaaaaagaagaagaattagagaggtgtcttccacaggacaaaactgagaggatatcctttcctttgataagcatctgccatccaaccctaaaaactgaaacactgaaccttgcatcattgttatttctgccaaaaactgcattaaaaactgagcagcccactttataagtatatatgtatacacacacacacacttatacacacacacatatatatcttaaaatggtgctcagccacctgctttattttccttttcctttttctttcttcatgaaagaaaacatttaggagtttaagaatgatttgcaagagagtttatcagcagatcacttaaaatcatgggaaaattctatttttgatagaattttaaatatttgatttagtagaatcaaatagtttatttctatttttgatgttttgtttaattgcttaataatttttgctttaaattattaaccaaaacgtgtatttccagggacatcaataaaaaaatgcataggcaagtttctaaagtgactgctgtacatttcaagcattaacctgaacactatgaaggcaatacttttattaatacttgatctattccaattaccttctgcagtctagtttttaaaaatcattagttctgcccaggtttcaaaggagaaaaggaactggggaaagagtatgttgttcagattactcaaaaaattgcacaaaaaataaaaacagattagtcagattttctcagttcatcggctgtgtccctggagtgtgttgatagttgcaaggttgaattaactctttcagggtgttccatttggcaagtcaatattcc

SEQ ID NO: 113991 - DNA, 1022 bp, Homo sapiens
cacttagcttcagctactccttagaaggcacaaattcagaacttccagggctaaactgttaagctgggccgctaggatcccagcttaaccctctgtcattctaactgtactacctacaaaggttacttgtatttttatttcccaaagaaccaaaggctaataggtgagagtctgaactttcagcttcctgggctgtatctccctgtgccgaggatcctgtgatatagaatgcctgcccagcagggaatggaatgtgtggtaagccaatgaaagagcaaagtcagaggttgcagaaatgctttctacaggagaaaggtgaagtttctgcttcagattgaatggggctagaaaatataaaccagcaaaagggtcaaaaaagggcagaggagaatgaatcagcaagctgcttgcaggtggtacaatctatataaagctagagttcccagctttaaatcaggcactgtgatctacaggagggctagtgggcctggggtcagctgcacaaaagtcccagttatggtccagtcaagagatagcgtgagagccagatcaaatcagctaaccacgtcgtattttcattttccgtctctgaaatgggggggggggaaatagtacaatacagaattctcctatgtagaggcattcaaaagggcattaattttttttaacccgatagcacgttcttcacatcataccatgagatgtgtaatctgctgcaagacttatgccaaactgaacgacagaactttaggctggttttgtcaataattctgtaactctgcgctgcttgttcttaaataaaccagtgcgtgtttgtttcttcaagagcagtaatttcttcaaaaaagcgatcacagcaataaactctgttggatttctttcatttatgccttcctttgctaggggcgtttgggttggtggggaggacatcttcagctctgccttttgtgagtctaaacaatgattccacttaatggtgcattggcttcctctgtgtctccatccctggcttctccctcctg

SEQ ID NO: 113992 - DNA, 1035 bp, Homo sapiens
agggattgggtgcaggggagggaagtcttccaagaccttggaggtgtgtacaccgcgctcctgagagatcacatatgtgcctctttacaaaatatttacttagtgcacatcccatggaagctgagctctcatttcatcaggcaaatgagaaaaagaagtctattaaactgcagaaggacttcaaattcccctaaagtttgcctttaatatttagccaaacctctgacagcatgaaatgccaaggatcaaagttgttttgtttctttctaaaaggacatcatcaggtactccttattcctagtcaacttttagaaatttagaacctatctcacggcacaaccggccaagtatttaatccatatctaatagttcatgttttgtgcttcttgttctttagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggtacgtacgtgttgtggagcaggagatagctgcagccctctgatctgtgcagatcatcctgagggcaggttgcgtctcctgctcacccccctatgtctacactgagtatgagcacctcgctcagtgtggttccaatcccacatgggcctgttctggcaggtgcagctggggaggctggagggaggtcaggtcgtgagagggctgagaagaaaaagcaataggacactagagggaaaaggagatcaggagtgaaggtaaagccatgaccatgaaaaccagctccagacatcttccaggtcactttcacagagctatggtccattcccaaagcggactccagctgctgctctttgttctgctgagccccagacactgccgccacctgcatccccgtttgctgcc

SEQ ID NO: 113993 - DNA, 1270 bp, Homo sapiens
tgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgca

SEQ ID NO: 113994 - DNA, 1149 bp, Homo sapiens
gtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagc

SEQ ID NO: 113995 - DNA, 1002 bp, Homo sapiens
tgagactaagatttgatgtacagtaaattgtaattcatataaaaatccataaacaacttgtctcacataatttacaaaaaaatcaggatttcctttgcttatcagtgacaaggattctagttgccagttttttccccgaagggaaaccacgttagcattgtaaaatccattaataaatccccgccgcagaagtcactgtgccaatgtccttctacaaagctgcacagggaaagcagttgggttgtctagaaacagtaactttgccccacattgtaaaatgaacagagatagctatcacatcctatgcagacagactacttcttgtaagcaaaggtcgacaattcgggactatttggaaacactgtacacatttttttttcttttttaaagttagttaaatacagtgcctagaaggaacagacggcccagcgcaacaggtcgaggcctttgtccttgatgatttttttttcctctggctacgttcagtccgactgagtgcagcgctatgcatatgtaaacatattcgttaaagccgatcacctttaaggtcattcggaaaaaagcggtccttgttttcgcggtgtgggtgtgggtcgtaacagcagtctcattcccccgggaggaaggctcttgggcgttggagagtcccactcgggttgtgccacaggacaatgtgggcagggcgtgagcggctcggcgggcgcggcccgggcgttacctcctgccgatctcgctctgccgcaggaactggatgttgttggcgctgtcggccagctcggggtactgctccaccgagagtacgtagtacccgtcgtagccctgcaccttgccggcgctcagcagctgccgcttctcgccctccgtccagaggcgcgcgccctcctcgccgtcgcgcacgcgctgctgctcgcgcgcccaggcccgggcgagcgcgcgctgccgcgcctgctccaggatgcgcgccttctcctcgtccagggtcatgccgtagcgcacgtgcag

SEQ ID NO: 113996 - DNA, 1057 bp, Homo sapiens
tctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgtttttatattttttcaagtcttgggctagccagcattgcttttgtgtttaacgtggaggacgcaaatagatgcagttgttggggaattgattcatctgcaacccagttggtagtatcttttttttttttttttttgtccattggccagactgctggctcagcagagtgaacttcacaggggactctcccatggcctactttagaaaaacagtaaacacacccccacaaagccaaacacgctaactgtaaagaagagtttacaaaaataccacccattactacttgagagcaggcctcattcctgtgatcctggcaataagtgtgcttaattaaaacacttgattagaataatcagtttgggcctggtaggcttgcagcctcctggagatgtctaaatctacatatagaccggctgattagaagatgcttagttcagcaattctggccggca

SEQ ID NO: 113997 - DNA, 1040 bp, Homo sapiens
cacttctgcgccgcggtggctttcgtggctgccgcaggcttgggtagaggagggagactggatgtcaccgctgcagggaggccaggccgaggcggctggggagctgcggggaagcgggagggggggcggctttcgctcttccaggctgtcactccagcacgttccgtgagagcccagctccctcagaaataaaaatgccactctgaatttaagtgatccgttcttccgggacattctttccagcgacaggactgttaacatgaaaagtaaaagggaaacaatatgatagttcagaaatcactgttttcaggcgctgcggaactcagcccgcggacgattcccgggaggaagggccttatttcgatctgtgagtgagagcaacgcggcatgacagtgtctgctcgacgtgcagggaaatcttacccgagccactttggcagggcccaggcctcggtgcggcggtgctgaagcagaagtctccgctttaagtgtgaaactcggagggcagagcagaggtggggaagagagggtcagagagccggccccgccgcggttggggtggagagtggcgagcggcgagcggcggcgccttctcttcggtttcacctcggtttctggcccgggaactgcccttttggcgtgcaggactttccctaccacagccgcgcgtcactagggggcgccggagcccttcctgaaatcgccgccatcccctgcagggcccgcccggggatgcaggagggggcgtcccaggacccctgcccacggggccgccggatgttgggacggcttttccatgtccgcagaagccgagtcccaggaaccccaggggaaggccagagggaagccccagatgagggaggactcagggaagggtgtcgtcttcctctcgctacctcccgttctctgccttgggtcacctctgtgttctgcagtgacctgtcacctgtcaatgctccagactgaagttaaacgccaggcttgattttttttttttttttttttttttgagcttggaaatcatgtcatagctgaataaa

SEQ ID NO: 113998 - DNA, 1077 bp, Homo sapiens
aaaatggaaattccctgagagtccactgctctgctcctgcggcggtgcttttccccctcgttgtaagcatgctctttaccagagctgcacggatgtcataaactgcctcacgatgcactagagcagaatcgtgcgttagcaaatttcacagatgcaaagtgggatttctgtcaatggaagcctgcatggaaaatacggaacagcttaagaaagtactgtcttctctcaaaattccacaggagcctgaaatgcaggggttccggcctaggcgttttttgaggcaaataacgtcgccacacggccgagatacaggcccctttttgccccatgagacttactggcctcagagtccggccgcttctgttttgtttcttcatgtatccttggcttctagcgcagttcctggtacacagcaggcgctcaatacatatttgctgagctaagcaaatatgtcctaggccctgtggaagatacgacatgaggaagaccaggtccctgccaaaaaggcaccgagggcccaggctggggagggtagtgctgacatcgagtaggccttcagctctgaccccagcttcattttaagtgactaggaacaaattctcaaaacttcttttctatcaactcttcttcacccccaatatcacagcacaactgtctgtcattgatggagttcctgcaataagacaagcgctagaagtttaccatatttgtatccttactggattcccaaattaatcctagtaagcaagtgacatgattgtttttagtagagacagggtttcactttgttggccaggctagtcttgaactcctgacctcaagtgatccacccacctcagcctcccaaagtgctgggattaggaaaatgaatacttttgcaagcacaatgacaggagtgtcaaaggaggtaggctccacactctgatgtctctttatcagtgaggccttttctgactccctcacatgaagagcaaactcacttcccttgtgccaaagcactcaacatatatgacatcccacacggggtaggctgaatcgtggcccttaaagtatgtccatgttccaatccttagaaca

SEQ ID NO: 113999 - DNA, 1049 bp, Homo sapiens
gagtgtgcccctcctgccccaaagcacctttggctaaacattgtctgttgggtcgtgagtagggaggagcaaagtgaacagtcactaaatccatagcagggctaagtccaagcagcacatgctgaggcctgggcgggggctccaggcttgctgggtttgcagccccagctgcgggtctcaaagccagcacagatcacaagagcaaggccagcagctcctccagggaagagcaaaacgctgccttggaaacacattttaattgatgaaaggattctttgttttagccgctgatggcagtgcaagtgaacttcagggcactcgaggtgctttggcccaattaggaagtcagccggagcctcccgtcacaggcagccatggtacctgctgtctgatgttttgccaacttgctttagtgcaatcaccccgctgcaccgggatgtttcaatttagacttctgctacgtcaggactctgaagacgctcattgtctgggagtgggcttcctgcctgttacctctttcctcctgcctctcctctcttggacacagctgtgacattgctcactggccaagtgagttgttactgtccctcggctgcgggttggcaggtttccactctcggaggagcagcagcagggtttgcaggcgaagatcctggactctgtcaatgcaagcccggcaccttggcattgggagtgctggagttctttgtgagtcatctgtgtggccggcatggcacagtcgttgctggagaatattagagtttagaatcgtatctccagcattgctttgtagataaggacatgcagttaggacttaggcaggcttgcacagctctagaggtagaacggggctgagaactcaggttccccagcttggaggctggtgcccataccaagacactgggccaagtgacatggggtcttgggacagctcatgaagctgggtgctaaggcaggcaaatgggagccgtagtctgtggccctccaccacagctggctttccagcctctctgctcctgccttccgattcctgatgccctagccttgcc

SEQ ID NO: 114000 - DNA, 2294 bp, Homo sapiens
tgctgggattacaggtgtgagccacctggggattctttttacagcaacattttgcattgagatttgaagtcttacagatttttatgattatctttgctaagaaatggttgtgagctatattttacttgcaagtaagttcaactacctttgattcatggcagaaaattcctttgggactgtaaagttttccagcgcttcatggtattggcgttcagcagcagtgggaccatggtcataggtgacgtgccctggccccttgtgctggtcattagggatacagctcagtgtatctcatgaactcaaccgtggtgccttctgagactttaaattcaaattatttgtatactctcttgttcagtgattcttaaaagaatttgttttgttcccaaatgtcttctttttaattgttgtagaagaaatgaggaacaagtgaaaagttaatgagcaaaaaaaaaaaaaaaaaagttggtttatgtttgcatttttagaatgtaatttgaaaaattactcctcactaaaggtagtcgttttttgctatatataagcggcaaaagaaaatttactatttttttgcattagagagactccaagttggctgcagaaatttttctagaaaataagataaatctgatgggaaaactagtaatcggatatcatgttgtgcagctgacttgttagaaatcctttgactccccaataattcgtgaactcagagagctgaaaacatacaaaccacaccaccccatgcatctttttttgtcttagtcttttctgctctgtgtttctcttggtatggtgcactataattggctcctatagagagaaaatagcaagtgaatcccaggacatatttttctctgcacagaaaatatgagttaagccaaagtaaacaaattgctttcactactcaccagataataattgtattttgtttttatttttaggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaata

SEQ ID NO: 114001 - DNA, 1785 bp, Homo sapiens
tctggctgctggcgtttttccttgtgcgtatgtgggctgagcacgatgtggtaaagcagatccctcaggatggacacgctcagcttcgtcacttgttgattctcttgctcttaaaatcccctagccctcttaacagccacggtgaacttccccatgtgtgcgtgtcagcacaccaatgagccagctcaggtgggcactttcatgccccagggtcttgtggagccgtgaagcggagctgcgcttagggtggggaaggcacttgacctcggccgtcctggccgctctaggtgccttcaggcctcactgctcatcagcaaccagccagaccacgtgggcctcatttggtattcttaggacttgccatttctaatcaatgtttttacttgagtctgttatatgttatttcagaggggggaatggaatgtgttaacacttagtaaattcttcatgagctgcaaccaaagtttttctttctttccctttcaacccacagtgtgccatgcggagctgaatgccatcatgaacaaaaattcgaccgatgtgaaaggctgtagtatgtatgttgccttgttcccttgtaatgaatgcgctaagctcatcatccaggcaggtaggaaccgggtctttccatttgtcacatttgcattgctgcctgctcgtcagtagctcattgctgatgtgtttgatcttaaattgctattgtttagatctaaattaattgcactatcagctttgcaagatatttcccgtgttttgtttttgaatggtgccaggtattctaagactaattgcatcctctgtgattcttagcatgtttttaatttagtttgcaacttcttaaactgcaagctgccaaaaaacaacacaggcattgcatataattactgtcaatttactgttctctgacatattgtgcatagatttgggggagggaagaaatgaacttctgtcagaaacaaggtcagctgggagtctgtatatgaaattttaatttgtatctaatacatggtagatatttgaggatctcaacataccttggcatataaatgtcataagacccaaatggcactaccttcaggttttcttattttacggttcccataaatctacaccattgtattctgaatatttcgcctttttcaaactgtcacatctaagattcagctacactttgtctccataaaactctcggctggagatttaaagacttaccatgtttagccaaatgtgtggtttgaaggggccgtttatcaccagtcctgtggatctcagagcagaagcggcctgctggtactgaggagtcgcgtgggctccctggctgtcgccgtcaccgttcctgggaagctctcctcgcggtgcccaggtgtggaggcggtggcaggcctgtgggccgagcagtccgggccccacactgcagcctcctctgccttcagaggctgatggagcagcggccttcagtgcggggcccttgggattcctggctgccgagttagcgctgcctgctgagatcaggacaagaaaacagatctgccctctgtagagctggtttgaagtggtctgcaaagccatgctgggaagcacagtggtgcccacctctgaatttgccagcagcccccactccctccattagtcctcccactagtaagagaagctaccttgtgcatactgccttgattacctgtagtaagggaaattggttaatcggatcaaggcttgactacttgacatgttttccctttgcatttgtttaaaaaaaaaatccataaagactggagggaagattag

SEQ ID NO: 114002 - DNA, 1050 bp, Homo sapiens
tcagccttatgcctgcaacattgcattgctgctgggggacccaggcacacagaggtagctgcagctgcacccgaacacgagagggtggctgaggagagtggccaggccttcatctctctgacccagagtacgtgctcagtaaatgatcatcgatgaagcaagtgagtcgggactgaaatgtatgagcgccataagtttaggccactgctcatttaaggcctcagaactcctggaagtgttacgtgtagaaggttggcaggctggagagggtaggggagaccttgaagattcccatatttatattctaggtggcttgtgtgatgtgggccatggccggatgtcattcattaactcgtttgacaaatatttattttagcacttgtgtgcatagcatgtgctgggaataccaggggagccagaaggcagtgcttccggaacttgtctgcacgttggaatcacccggggaattgcttacaaattcaagcccaagccacagcccaggccatcacactctgcaggcacagggcacagatctctgtattttggaagcgcctaagggtgttctgatatcagagaggtttgcaagtcacggctgttaggatttataatagagttttagataacacacccaggaaaattcagtaacgatacaagacggccatccagaaacctcctgggcaggatgagggagtcaaacccaggtgtgtgctgtgggcaccactcattccccctcaaggaggatgtcgcctgtggattagggagcgggagcatctaggcaaactggacctctggggtgtgtgttggctttgccaggttcgagagagggaggaaggggatccccttgactctgaactcaggcaggtccggatgtgacccgggatcatgggtggaatgcactggtctatcaagagctcaactagtcattgccatttaagtggatgaatgtttttcttataaaagacagactgggctgggcatggtggcccacacctgtaatcccacagctttgggaggccaagatgggaagatcacttacggccaggatttcaa

SEQ ID NO: 114003 - DNA, 1283 bp, Homo sapiens
aatcctgtaaattactgagtttttttttttttttttaatgcacaggtcaaccttgaacttgggtatgccatttcatgtcacttgttaattgcagggtgggaacccagtagaaataatagagggtgatgcttcccaccttttcattccagaaggccatgagcagacgcttcttagctcgagtcctgacccttgtcttgtcagtgaacagaactgtccgtgctctgaacggctcagcctggggtggcggcagaaggcgttgcaggtctgttctcagtggcagcaggcactccatgcctggccttctgaccccggtcctagcgggagccaccacaccaggctgccacctgttcaggtcagctttggcagaacaaccctcaggtctaaggacatcgttttctttaaggaaaatcctgtgtcactaaaaatgagggatttttaagcaacctggagagttcagaactagaactagagttcagaactagatcagaaccttcattttcctgactccaaattttctcaggccccagtagttcctgtcacatctccatagcagatgaagatcagttgagggtagaataacactatcactgctaaattatttaggcagcaattagaatttgttcagcattatttagggtttttaaacaaacctatctgagtaaccttataatactaccgtctaaaatagatattgtatcagtcttatatcagatgaggtgaaagtcacatctataaaacgctgaactcttaaatctaaccagggatggaatatatcctgttaatttgtcaaacttctagagaaccgcctacatgagacagtaaggattaatcaagccctactaagagagaatttgaaaaatacagttttctaattatacagtctcttctccatggtccaaggttaatgcagttctgaattctgacagttagtaatagaaaagaaaaaaaaaaaaaaccaaagcatatgaattgtcttataattacctgaaacagaaagtctcttctggcaatcaaggccttctaagcattaatctgatattttcagcatttgattcttttccttttaaacaaggttgggaataactggagggttgtgtgtcactctttgtgcttatcaaatatatatgtactgtttgcagatttattttgcttattgcttagctgtagatgtgtaattctaggttgaacattttatctttttttctttttttttttacaatttagactaacttatgaatacttcctagacactgtatctttgaaatacttgatccttattccta

SEQ ID NO: 114004 - DNA, 1074 bp, Homo sapiens
gagaattaacttgttcccgttgttaaacttaagggaatttttagtaatgcttgccacatgtatccagctgcccagcacttgtggccttgctgatttctgctggcaaagggctctgggttttggtgagtgcctctgtgcttggcctcctatcccacccaatggaccagggagccagggttgcttggcctgctgcatctcactgcaccagggagggaaccgtagcatctcagtgtccccaagagtcgggggaggcctcactctgagtgcgttgggtagaagtggggctcttacccgagtcagttcctatgtctacagggatactctaaaaaggatgtaatgctgggaaggaaaatgctgaaaaacctggaattaattaaggcgaaagagttcagcagagcatcttaaacacctttgccagtgtggggcagtgcctctttaaattctctatttaaatttcatctttatttttcagacttagcatattgttaagcatgcatagatgtcacttttgtgattacttagccatttactttacccccttgaacactgacattttcctgactgccatgcacgtgatatatttctttggcatctgaaaggttagtgttgagaaactaatttatcaagaagttaggaggctgatccttcttaagatatgacttcctcacaacttgtaagagcttcttagtaattaagatcaaatttgttctttccgtcctgaaattgaatgtcctctggtttcgttagtcagtccatgaatttgataacttgctgtttcttttcctgcagaatttaatttcacttaaagcttcctgccgctcctcccctgcctggccttctactagttgtggcccgacagcaggtctaattagggacttttgtacaaaactactgttataatcaatggaaaacctttgaacaactgcatagaaaagaaattaagtagattatttttacgaatcaaggggcaaactcagctgtgatcgtgtggggtttcagataaacagagggacacaccagtgtatatatgagtcttctcccacccactaaaatcaaccagctccatgtaagcat

SEQ ID NO: 114005 - DNA, 1062 bp, Homo sapiens
gggttctatgcccacaggatctaagcctcctcctttcttgtaagtaacttctataatgtcacacatgcagggtgacatctcctaattccaaggtcagtgctcttcctgctacctccctgtgtctctcctgtggggcacatgaattcagctgtactgaaatgccaatcattgtctcatttttttttgcagttgatcagactgaggctccgataaaataattactcctcagagatcaggagctcggggaggggtggcctgtgtccggcatcatgcagaaagccacatgcgtggctcactgtaacatttcttcaaaggggagtgcagtggactgaatgtgtctccccccaaattcacatgttgaaaccctaattccaatgtgctgatatttggaggtggggcctggggggacgtaattaggccatgagggtggagctctcctgaatgggattagtgcccttctaaaagggaccccagggagctcagttactctttttccatgtgcaaggataggcggagaagatggctatctgcaaccctgaaaggagaccttgccagaatctaaccatgctggtgtcctgacttccagcctccagaaccatgagaaataaatgtccattgtttctcagccacccagtctatgggactttgttatagcagccccaagggactgtgacagggagcttgagaactgtgtaaatttgagtttaccaaataacatacagcttaatactgctttattaattccgtaagtcggaagtcattagtcctgattgatgccttgtggggaggagggaaacacacactacttgtaacataataggaagatggagcttttcctgggctgtgtctctagagagttatttttaaagggtgtttttgttcttccagtcttgggatcaaaacttcataaaactattttattataatgtagtattaatgtggaaaatgaaaattccctctgctaaagaagctttttattccatccttttcctgaaaaatccaaaagataatatgatgtcagtaacattaagtggcaggaagaaggcaatgttattatactaa

SEQ ID NO: 114006 - DNA, 2187 bp, Homo sapiens
ggggagactcagtggacgcctgtcaacttaaaagtgcagggtcggtctgccttttgtgctgcgtttctacaagcttagttcttcctgtgagacagaaaattgtcacatgccattgttaactgcctcttgtgccccttctgggactgggggtgcactttccttggcttgtgggtgctgccacaaaaaaccaggcaaggagaccgacagctctcagcacctgcagcagctatgcgtctgttttgagttctgcagtccccctggttttattccctgcttccacagcggcagaccagccagttgcaggcaccaagcctttgggcatgtttccttctaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacggtagggcaagttttatgtcccattctgcttagtgacatagcctggtgagtgcctaattaagaaagttggtcagaaggcatcatctcccttttgtcatcaacaactggaaagaaaagtatcctactgaactaccccaatttcctggccttgtctcttaagttccaaagagagccacggagagaagcatggtagtggccacacaggctggccctgagatccagggctctgctgcctgtgctgagcctggcaggcttcactggcaacctgctggcctgcaccacaccagtgcactgatagtcggcgtctctgcagagggtcacagccccttgcagagatagctgagggatgtgcatggtgtctctgtgggttcctttttttactacttggaagcagggtcggctaaccaggggctggctcgggctttggtctgatgagaagcaggcttcattcagcccatgtgcctgatgagaacatctggctcaagctcattgctggcaagcaggaatcaaactgtgaactagacatcaggagatggaggatccagttgcttcctccagttacaggggatgctgcaatttcacagtaggctgtggtcagaccaaaagccagaagtgaggctgggcacgatggctcacgcctgtaatcccaacactttgggaggtggagacgggcagatcacctgaggtcaggagttcgagaccagcctagccaacatggtgaaaccccatctctactaaaaatacaaaaattagctgtgcgtggtggcaggtgcctgtaatctcagctactcgggaggctgaggaaggagaatcgcttgaactcaggaggtggaggttgtagtgagccaagactgcgccactgcactccagcctgggtgacagagcaagactctgtctcaaaaaacaaaacaaaaacaaacaaacaaaaaacaaaacaaaaacaaagaaaagaaaaagctagaagtgtagaactgtaaacctttggcttgactgtctctggattttccccttgaaattagggaaggctgcttcttagagtttgttgcctgtctaagccccagggaaaattccttcagagattgcctgggagggtccagccatagctttacttttccttgcattccttggagaatatgcaagcaatgctggaaaagaggcaaatcatgctgggtatgcaggttgctgatttttgtaaggttaggccctgtattttatgtctgagaatgaacagactggcgctgttggaagtgaagggagagtaaggccatccaaatgggaaagattgtgtcttcaggccaaggcgtgatgtacgacctttcttctttgttgactctcctggtaggttttcttctgggtttttctcatgaagaatccaagtcaacatttagtctaatttatatatttttactaatgttcctggacctcaatcatgttaaataagccccataaatttctttctaaattgcctaggggcaacttctccatgtttgaaagaaaaagttaagaggtacctggagagagaggaggaactgaggactgcaaagcagtctgggtttccaggatgtgaaaagtagtttagggatgaaggggaccgaatcctcagatccttgatttaacctcaccctccctcgtcggagtgggaagagaggatggagttgggggagggtaagactgtcttctcagcacagcttcagagccggtggtagtggatgactaat

SEQ ID NO: 114007 - DNA, 1006 bp, Homo sapiens
gggccggaggtagggaaggaaggcacccacggcgaatttgcccgctttgaccgcatttagggcggccgcttgtgcagccagccttctggaaggtaggctttgcgcttggtgaagagaagcccccacctccggatctgtgttccgccccagtccattcatcaggaggtgatcacacaagtcaagcttctctagttcccggtggaatgagacgccctggtggggtcttaaggttgaacgtttgaatactgtaaaaaagatgggacctgcctacaattaatctctcacactactgagcgaatgtgcgttgttttggacttccctaaattggcccaaatgcatagccaacacttgaattgcggtgtactaacaacatcattcagcaccaaaccaaaccattcttatttaaaccttgcttcctagcttatttatttcccaaacaacttgaaaacatttgttatactaaaatgtctacatcttactattaaaaaaaaaaaaccaaagtaacacactttgctgctgccgtaattttatgtcactgagatgaactattctacaatacttgtaatttcaaatttgttaaactttcagctaagtagttttacccaaattctaaaaccagtgaggaatccaaaatagcacgcagcattaaatgacgtttattgttccataaatcttcagacttcaaaaagaaacgctaaatagacaaacagaactctaaagcaattaagagacaagctcgctgcttcttccccactgactggcaaggaaacatttggtcatacaaaagccattaaaatgacggaaaggagagttgccactctctagccttttttgttctgatcaagtttgaactctgctgttcggagttcacacaatttacgtagtaacagaccttcagagaattcctaacggtcaagacaatgaaattgcatttatatctgtaaaaggaaaagaaacatgaagattatccccattttagaggtggacacatttagatttgatttga

SEQ ID NO: 114008 - DNA, 1058 bp, Homo sapiens
ctctcgaaagttttgtggtttccctagaagacgaaagaggttgagaaggttgcggagacttttgcaatcttccccgtccagaaactctaaaacctctcggcgtttggcccaggggagctatctggggtcaaggggagggagctggccgcacattccttcgcccgccttcctcccacctggagccgcggccccgcggggcagtgcgtccgagctggtgcggcgacgccggcagcggcggggttaagctcaggaatgcggcgcgaggaatgcgcatgcagatgaggcgggcgggcgcatgctaatcgcatgcaaatgaggggcccgccgctgccgcggcagcgccgcagcttcccggatccgagcccagacggcggcggctccggcagcctgggcgccgcgaccctcggcggccagagggggacggggcggaggaggaggaagaggcggaggcagcggcggcgagggggaggagggttcgctcgccggctccgacgcagacatggtggactgatccgcagcggggccgcgaacagcgtttcctgaggcacctcccgcgcgtggttccgccgcgccccgcgccctgcgcccctcagcccctcgccggcgcccgcgtcgcgggttggcagcctagcccggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttctacattgaccacaacaccaggaggaccagctggatcgacccccgggacaggtgggcgccggccgcgggggcgcgggcccgttcggacacggcggctgttgtcccggagacccggccgcgcggggggctggggcggcgccggcccgcggtgccccgaggggtcccgggagggatgtggggctggctgctccggcggggccgaggagccgcccgtacccgggctcctccgcccaccggcttcccgacgcccctccggggacccggccccgagg

SEQ ID NO: 114009 - DNA, 1097 bp, Homo sapiens
taaatttaaataacgtgccaccagggataacttcgacatttggacttttgtcatttctgaaaattataactttattgaatgtggccctttgggctttatatactttttaggtgcttctcctatttaacattttcccttttctcaatttgaagctgaaatacctaactactttataatctcagttacttttgccctaaaaatgttgtttttgaaagctactaaaaggcaattacaagaaagttataaataacattataaatttatggaacaatccttgttcaattatccgtgaagctacgggcctaggtttccctcctgaaatgagaaaaggcacctgtgctgaggttcggtcttgccgcagcctggctgcctgttgctggcctgatgaaaattgtgacaggcatcacaccttcccagtgtctccagacgtgctagttgttgtcataaacttcacgctccaagccagttatttgacttatgctattgcactttgaaactacttaacagatagtaaatgtcagtgctgatggtgtgcacccaactgcggcttttaaggcacctgtataaatatttgacttttacagttgtgtggtaattctttctgctttctgatacttggagtttcaggtaattgaaataacaataaattcttgaaatatttaggcattctaggttctcttcttcggtttacatgctttactatattatctcagttgtgtttaccggaaaggattacaagaatatgtaatgtctgggtaaagtaaatagaaagtggagtgaaattatatgacttggctatccatatcactacttttttcacaagtcaagcatgtcctttattttaaactcttaatggattagtaattattatgaactattttcaggaaactggataaacaattcattggatagggacaaatagttttgactaagatagctttttatttttccaattttccttgcagctgttaggtcttaaatattcagagacataaatttgacgacttacaaatatttctggatctcagagttttaaaagatactctgttgagatcagagtcaccattatatactcagtttaaatttgattatatttt

SEQ ID NO: 114010 - DNA, 1032 bp, Homo sapiens
aaacatatggaaagagagatgttacacaggccaataggagtgtgtggattcttctgcaggatcaacttacaaattctgaaagaaaaacaacttgatatactatgggtctgcagtacttttgaactgtttaagccatttaattagaatggtcacgatgatttaccttgcatattttttatgttattctgttaaggaaaagaattttgtgtttttgatagtctatcagaatttgttgaatatttctgattatacagataattatgccgatttagtaggggaggctagggcattttataagaacataatttcattcaacaggtagtcatgccagaatgctgaagcattattctaaaatgcttttaagcttttggaggtgaatgacgtcattcaaactttgctgggatgtgatcaaagcttttattgctccacttcttacttttattgactaagtttacgtgagtttctgaatccctctaaacctccatttttcagctctaaaatgaggataatatcatcttcttcataggggtgtttgtgggctcaccattagggcccagcctaattgtattagtgtagtgttgacattccagtttaggaactgagtgaccctggaaatagtagaaatactagcatggacagtatttactcagtgtgtattgtgtgctaggcactctgctaagctctttaactgtgatctcatttcattctcccgttggtcctgtgaggtaggtactactgtcatcttccagttacagatgaggaaattgagtcacagagaagtagcccttgttaagtgtggagctaggatttaaagccagacagcttgactctacagcatgtgtccttaatcattcctttaaattgtctcgacgcttgcgcatgttcaggggtctttgggtggagtgcacagaggggcagaacctttttgcccagtgtttatttttcaggctgagtgactaggctaatcctggggaaatctccctgtttgtgattaattccttgtccccctaccctgcctgcatgggcccactc

SEQ ID NO: 114011 - DNA, 1802 bp, Homo sapiens
cgggaagcggagcttgcagtgagcagacattgcgccaatgcactccagcctgggtgacagaacgggactctgtcttaaaaaaaaaaaaaaaagaattttggacttctttatgcatttctaaactcctgttactgaaaaagttaccacagaataatgtagaagaggaaagggattttttttttttgacaagagttttattcttgttgcccaggctggggtgcagtggtgtgatttcggctcactacagcctccgcctcctgggttcaaggttcaagcaattctgcctcagcctcccgagtagctgggattataggctctcgccaccacgcccagctagtttttgtatttttaatagagatggggtttcaccatgttggccaggctagtctcgaacttctgacctcaggtgatctgcccatctcagcctcccaaaatgctgggattacaggcatgagccaccacgcccggctgaggaaagggatttttaaaggcacagtgtgtatgtaagttgtgagatacaaatgatttatcaaaatataggttcacaatgttttcaatgtcttcagtgattttttccaattattttatctttattagattaaaaaaattcctcagcataaaattattcattttaaccattttgaagactacaccttagtagtttttagtatattcattgttatgaaaccataaacactgtataattcctgaacattttaatcacccccaaaacaaacgaccccttacctattaagaactcacttctcattcatctcccgtctctacagctttttgcaaaaactgatctactttgtgtctctgaatttgcctattctggacattttatataaatggaatagtaaaatttgtatccctttgtatctggcttctttttttcttagtgtaatgcattcagggttcattttgtagcatttattgtactactgcatcattttcatgacttaataatattcgattgtgtagatataccatattttgtactttcattagctgatgtgcatttgggtcatttccactctttggctgttatgaatgatgctgctatgaatatccctgtacaatttttgtatgaatgtgtgtcttcagttctcttcagtatatacatgtctaaaagtggagttgctgggtcatatggcagttctatgtttaactttttgaggggactgctagactgtttaccaccattttacattcccaccagcagggtatgagtgtgcaaattcctccacatcctcaccaacacttctctctctttctctccttctctcctctttctgtctctctcttctctttccttctcttctcttctctcttttctttttttcttttctttcttcttttgagacggagccggtctctcttgcccaggctggagtgcagtggtgatctcggctcactgcggcttccacctccacctccagggttcaacagatcctcccacctcagcctcctgagtagctgggattataggcacaagccaccatgcctgggcaatttttgtatttttagtagagacggggttgggccggtctcgaacttttgacctcaagtgatctgcctaccttggccttccaaagtgctaggattacagatgtgagccaccacaactggcctcacttctttcttttttttaaaaagttattttagtgggtgtgaggtaggatcttactgtggtgttgatttgtatttccctcttcgtagtgttttgatggccttagttgggcccaagcctccccttattctagccttttatagctgttgctattctgccccctttttgt

SEQ ID NO: 114012 - DNA, 1043 bp, Homo sapiens
gttcattatagggttcgctctcctatgagaatctaatgccaccactgatctgacaggaggcggagctcaggcggtcatgcttgctcgcaccacacacctccttctgtgcggcccagttcctaacaggccattgaccggtaccagtctgtggctaggggttgggaacccctgatttattccacaagggatttggactctaggtactgtgtgggacaaaggtgagtcagacatgggtgctgaatttgaggagctgtcttgtatctcatgttacttttttttttgtttttaaaacaaggaaatgcagcatgttacttagtttcccaaactggttctttgaattagctggacctaatggtagtggaaataggtctgttactcttaaggtaagaatgatttcatgggtccctgttcaaatgtagcagcctgtggattctgtatacctcatgattattttgatggaaaatcaagagacatctctgggcacctggctttgccatggcagggcctaaagtagagattgcttttgtggtgtagagacagctcaaccccagtcactcaataaagttaccagataccaggcgctgctatataattcttaagaagagttgtacataggacatgagaaaaacaggcaaaatgaatttttggaagtaccatagttgtttgtttatacttgactgttggaagtatatagtattatgctttggtagttagaaatactgactttcttgtggcatattgataatatttataaaattactaggtgatgatcaagcaaaaaattattccatatattatccttgtgatgcctgtcactttgaagcatgtcccaaagactgctctgtagagctatttttttttttttttttttgctttgtcagtaatttttcctatactttttgccctgatgtcagtaaacaaatcatggttccaaaatggagccagctcagaagtgaggtagtcatgcactaacagagttatgtattgggagctgttttttcactcctgtagctcatgaggaattacaatagttccaatagagc

SEQ ID NO: 114013 - DNA, 1055 bp, Homo sapiens
ctaagtttttttgtactttttgtagagtcagggtttcgccatgttgcccaggctggtctccaactcctggcctcaagcatttctcccatcgtggcctcccaaagtgctgggattacaggcgtgagccaccacgcccagccagatcatttacttttttccttctttgtctcccttccccttttctgctaaatgacatagctaatgatatttctcataggacagcatgactagaaaccagtatttaacttggcagaatgtttaacataacatcagtgccctggtttgctattgtagattgaaagactacaaaactaacttgattgtctaactctactttcagtccttcatttacccctgaaggtatgcctgtagaacgtatgtagatgcattcttgagagatttcctagtgtctcatgtgtaaggagcttgtgtgtgtctgcatcactaatgttttcataaaattgattctaagttatttgagaatagagacctgctttgtgtgtgccccttcatgctctgtgcttagattgcctgtccccacagggacacttaacacggcggaggcctgtacccatagaaatgaaatgtatgcatttgaaggaccttttccttcttccagtaacctccataatttgtccccagcttactttactgacttcaccacctagtcattcactcagtcactcattcattcattcaatcaaactattcgtcacacatttattggaaacactatatgcctagcacatacatttcggggacacggtgttgaatgaaataggtgagatctctgttttcatggattttatattctactttggggaaggcaaacagattctaaagatagtagtgaatttgctttgattaaaataaacaagatgaagtgataatagtgtcggtgggagctgctttgggttaggtgatcaggaaaggcctttctgaggagctggcatttagctgagctatgaggataagaaggagccattcatgtgaagatctggggggaagagtggtctaggcagaagaaaagactaaacagaagtactagccctgtg

SEQ ID NO: 114014 - DNA, 1234 bp, Homo sapiens
ttcactactgtattccaatgctcagctttgtgcaagctcttagtaactattgaataaaagaaactttgataggtaccattattatttccattttaggaaactgagactgaagaggtttaagtgacttgtctaagggcacaaagctgttaagtggtggcagaactcaagcgtgtctgtctgacttccaagctgtacatctaacaagatactgccttcgattcctgctaggaaaggcctttggccgcctccctggctttggaagatagagcctccttcaggatttagctgaagtttcatcacttaaagtttgccttaacaacttagccacacataatcttccagtgcttaattcttatgctacctgtttttagcatctgtattaaaactacatgtgtactgtattttgactccttgaattaaactattactttttcagaatttattattttctcaaattaggttataggctctgtttagttaaatcatgcacaatattatttatttatcctgccttgcaagatacccagtacaatgtcttgtggatattagttgctcaaataaatcctaatttgattctgtcatttctgccttgttccagtgttttcagttcttttagaggctgagatctatatgctataaatcctcttcattcctgtcctgtctctggttctaaaaacggttcagtgttgtcccacagcttctcccaatctaggcttctgtggaaccatctccttttcaaatgtgccacttacaccacctacacttctgcatatcccctcccttttcgagacaagttgaactgatcatgaaggatagagaattttcaaagtgataaagtggagttccagctcttccacattcttcttctttttttttttttttttttttttttgatggagtcttgctctgtcccccaggctggagtgcaatggcgtgatcttggctcactgcaacctctgcctcctgggtttaagcgattctcctgcctcagcctcctgggtagctgagattacaggtgcccgccaccatgcccagctaatttttgtatttttagtaaagatggggtttcaccatattggtcaggctggtctcgaactcctgacctcaggtgatctgcccgcctcagcctcccaaagtgctgggattacaggcatgagccactgtgcccggccacgttcttttctatagtgctttttcattaatttaaaccctgttgggtgtctactataatcca

SEQ ID NO: 114015 - DNA, 1047 bp, Homo sapiens
ccactgcgcctggccggttatggatattttttttacctctactcttatagtcgagcctcagtcttagaggaaaaatagtttctttcagtcgattgccacgttatagtttgctttaaactacttagatttggattcagggtaaagagccttcataaataggaagtgatagaaattcagagggagtgtggcatgtttttgttggatttacttatgctgtgaaacttacctagaagtgtacaggcagtcactaaactatggttaaagaggaatcttttcatttgtacattccttatccctgttacaggttgctgcactttttttttctgtctttatggtagctagaaatatattgtgtatctgattctatgttttcctacatttctacatttgacttggtttgagatcaagtttgtgaattttgattaaatgcctagattatgcatgtgaaaaatcttttgtcctgtgttgctatgagcaacaattgttaaaattaacttttttagaaaatgtggacaaatacatgaatcttaacagatttttaaaaagtcatcatttagcattgtgagtgttctgtctataaaataaattgttactgtgaccataattatcgtggtgaagggaggaatgcagtagaagtgaataatcatcagacacattgacaaaacattcctaaaatgctattcaaatgaggaaagacattatggggctgcagccaagtagccaagcgttgagtccttttagccagttgtctgaccgggtttactattgtgaccaaaaagaagctgtgtgtagtggtttgcatagaagggtcatgatttatctgaaatatctcaactttttttttttttgtaatcctgtctctcatcctcccctgacaacactttacttcattcttaaagactccttttgtcctgatggtgtttgtttcattgctttctaccgtactccagtctgaattttactgactcctagtgattgcttagacttgctatttgattctgttgtgtgatttttgattatactcctttgtgctatttaaactagcag

SEQ ID NO: 114016 - DNA, 1033 bp, Homo sapiens
ttgttactgtgtgataacgcagacttgtttcttttgattcttgttcttgatacctttgtttccttgtatgtttagtgatttttgactgtgagctaagttacttatttttaatagaactttgtatgtattgatcctttgaggcctggcaaaagatgggttctttcagaaagggtttatatttactttttctaggtgctgaggggctctgccagtctggaatcacctaaattcctatctttgcttcgttttagccaccacatagggtaaaattgggctgtaaaacctatctggaagttgtattgattttatgaattcttgggggaggtgggcttcaccctccccctataacctttgggctggagtttcggacaggctctttctttttgcagtcttctggggttctgggatggatgtgagtattactttaccattataagaggatctagtctctttggcatctgaacttaatggtagggttttgcttagtttcctcactttggtcaaactcttgagtgtggttgtagatcctaattaggaaaactcatgcttagctcaggggtttggacattgtggtctgcagaccaagtctggcctggtgttttctttttgtaaataaagttttaatggaacacaacaacatccattcttttatgtgttatctatggctgcttttgtacttcagtggcagagtggagtggtttccgcaggagaccatatggtctgcaaagctgaacatatttatcgtatggtcctttatataaaactttgctgactcctgcgcaaagtcattaacctgatggacaccctatctaattaggtgaaagtctcctttagggccccatttccttttctggctactgctttccttcagttcctggcctgaacattctttattttctcgctagctcatggacaaaggcaagttttttgtttttttgttttttaagtaacacatttagttgtcttaagcaggattgttggtctggcatctagtccttcatgtggctggaaatacgtatgtatttttataaca

SEQ ID NO: 114017 - DNA, 1027 bp, Homo sapiens
aaaaactggtcacatgatagggaggatgcagataactttatttaggtaagctgtgaggttgagacttctgtgatctggtttgggggcatgacaaaatgaataacctgagtgcgaaacagctgactaccaatgagtgtttggggcataacctcagtgtaaattaggatacgtctctatttcctttatttttcattttggttgtttgacttgacctacgttacaggtcattgctaaattactttggaagtaccctttgtcttgattgtgttactgtatgtggatggtgctcaaaattattaaatttaattcagaagtttcaattttgtgaagagatggtgggtattttctaggtcataatacaaaagtgatttgtgatctagctattgggtgcctcaaattgtataacataattatagttagaattgaatcatcaaataaggtggcaagattaatgggagtggctagctttaatgttccaggttatattaattttagataaaatgaaattagtattcctatggacaattgagtcaagttcttgaattactgtattcagttgggattgactcaatttaacaaaatggtactattagagtttttgaggataatgagaaaatggaactgaaattaaaattgtctcttgcactttggacaaaataatttctgtgagcagcaattaagaaggtccatataagagattcaccttctgctctaatttcatttagtaagattgcatgatcttaagctccgtgatattttacttggaaaatgttatgacttaacgtaggtcagtgtcccctgcattatgtgatttggtgtgcgcatatatatatatatatatatatatatatatatatacatatatatattatatatacatatatatatatatatacatatatatattatatatacatatatatattatatatacatatatatattatatatacatatatattatatataatatatatatttttatatatatttttaatatatatattttaagtagtggcacagaaag

SEQ ID NO: 114018 - DNA, 1054 bp, Homo sapiens
ggaacacagaattttcatatggccacggagtgtggttcttctctgtgtgaactctggtgttgatttttaaaaggcatgcactgattcgagaaaacctaattttatatactggagttagacatacctaggaaataattcatcccattagacatttattgagaacctaccgtatgctagacattgtggggataatgatgactcaggttagtgagggagaataaagccttttatacacatagctcgaatacatgcagaaatgataagtgagaagagatacaagtgagaagtgtggcagagatttaagggagagagaggttatttctgatagatgtgcatttgagttgggctttgtgtagagctgtcatatctcccagtctgcttgggtcagccccagtttactccggatgtcctgatgtcccctccaattaacatctttctggtcaaaattgttccagtttgtgtgataaattatatggatggtccccctagctttgagaatcaggtaagacttggcttagtggagatagagaacagtctaggtaaagataaatggcataaacaaaaaacatgggtgatggaacactttggtgcacttagaaaaaacatgtttagtttgactgtagctttgggaacaggaaagggaatcactggaaatgaaggttgggaggtgagttgaggtcaaattttgagtatcctgaatgccagactagataccttgattttatgtagttggccatggaagtttgtgatttttttttttttttgagatgatgtcttgctttgtcaccaggctggagtgcagtgatgtgatcttggctcagtgcaacctttgcctcctgggttcaagcgattctcctgcctcagcctcccgagtagctgggactacaggcgtgcgccaccatgccaagccaatttttttgtatttttagtagagacagggtttctccatgttggccaggatggtctccatctcctgacctcgtgatctgtccaccttggtcccaaagtgctgggattacaggcatgagccaccacgcccggctgactttttttc

SEQ ID NO: 114019 - DNA, 1083 bp, Homo sapiens
cacaaactgccttagattataaacatttctgcatgtgccttatctttccaattagactcagtctttccaattagcctcattgagagcagggtcaagggttaaaaataaaagtgaaaacatttatgttgtgctttaactctttatagaatacttttcatatatattatttggtgtcttttaacaatatattgactgggatttccaaatgaaaactggaagaacaaggtataatatttatgttttaaaatttgatttaagattcactagagtttagttatactaaaagtgtatattggtaatatcttcatatttttatattatgtattttggagtactgaaaaatatactttacataatctctgagcaaatgtaactaaagttttatgagatttctttagaggtaaatttgaaatcagtaaataaacatggtagggaaacttttctgacttttaaaattaaaattggaaacttagtgggagattttaaaactttacgttaatcaaagttatatctgtaaatgattaacaaacactcaaatggttcccaaagcaaagacaggcatcctgtgacccactactctcccccacacttgattcactgtctctacagtcgaccacatttacatatttaaaagtttcttttggtatttgccgctgtgtttttaaataactttatctatctatcttgacttcttagctttggattttgagaactgacttcccgccctggttgaggattcagctttcttactgtgccttcctcatgcacatgtgcctccctcccctcatcctcttggtgttttctatcaccttgtaaagaaatcagtagtctgtgtgtacatttttatgactatgtaaatattattcatggatgacctatctggtgtactatgattgcatttccttttgttttctctgtagttaataatcatctcttttttccattggcttacttctctatattcctattaccaatttgtggccagaattataaatctcctttcagtacattccaacacactgtgtattctgttggtttggaacctcctgcaccttctgttcttaatttcaagtttgtcctggt

SEQ ID NO: 114020 - DNA, 2182 bp, Homo sapiens
atcgctataatgattacaaaatgttttctatttctgtcattactgttgcggacataaaactgagttcatggactggtgttggtctgcagagtagaccaactttgattagtgctgatgcagagggcagtgtgtctacagtcctgtattaggtgaatgaaggtgggttgggtccagcttatgcagggcattgagtgctggaatgaatagcttggcttttattctgtaggcactggggagccacagaattcttgaatgatctgattgacaacattgtgtgtggtagatttatagtgagaatacactgttgatcagaacctggaagaggaaggaagttgatgagactgggtaaaataaaactaaaatttctggagaagtcactccagcacagctaaataaactccttagaggatacaagaacttaagctagcctactccctaaagcttaaacaagccggaaaacaaagttaaattctaaaaagtaccctccacctaatgttttcagaaaccacgcagatagaagatccaagaaaacaatggaggggggaacaggagaagatgctcaaggactacctctctgtggcacaggatgccctccggacacagaaggaactgtaccatgtgaaggagcagaggctggcgctggccctggatgaatacgtgcgattaaatgatgcctataaggaaaagtcaagttctcacacaagctgtaagtacagtgtggctattcagactttggaagtggagactgaattgtagataacagaagaccacttacatttctatggagtttaattttgagtccttttccctcctaagcaggaagagtctctcaaaaccattgagaggtgagggcacaccccagattttctcacccctacttcagataaaagaatccctgtttgggggttatgcatgccttctgtttctgcacctgcctctgccaggttgccttttatgcatttacgagttaatttttaccttttcagaacagtgcaagtagtttggccctttttgctacttttgtacaatatttttagtggggaggaactggaactattacctagagtgtaatttctgttgaccatctgagttgatttactgctccctcatctcacagattgactatttggagctggctttgtttaaagaagcagctgtgatgagctcagaagttctgcttaaattataaattccttgataatgcaaaactctgatatactgctgcagtatagtcctctgaggacatagtgtgtataaaatccagaagaaaattaagcaccaaggtcttaatgacatttctctttacagagttaaaaaaaatggtagaggtttgaagataactttttatatttaggtgtctgatcaatggcaataaaggaattagaaagcaagtattcacagaagcacataaatcttgtttttagcttcagtaaattctaagctgagaactagttatgcaacttgtaaataattagtttttcttttttctctataaaagtattctcaggatcttcatccagtactaaatatgatcccgatattttaaaagctgagatctccactacaagattaagggtaagaagttttaaattgtggttctatgttgacccatatgcatagagtctgaaggctgtggaaggggctttagtgatcagttctcatctccatttggtgtagaaaactcctccccttatctctgatgagtggtccttctaccttgatgtgaacaagttcagagtgtgggatagtctttattattgagacaatgtgttccactattgggtagtgttttgtttgtttgtttgtttgtttttttgagatgaagtctcactctgtcacccaggctagcgcactgcaatctccgcctcctgggttcaagcaattctcccgcctcagcctccagagtagctgggattacaggcgcgtgccactatgcacaactaattttagtatttttagtagagatggggtttcaccatgttggccaggctggtcacattggtcttgaactcctgactgcaagttatctgcccgccttagcctcccaaagtgctgggattataggtgtgagtcactgcgcctggcctattgggcagttttattgttagcagttagaatattgaatcaaaatttgagtcttgtaacttgctttccctcattgtgctgagttttgtcctccaga

SEQ ID NO: 114021 - DNA, 1390 bp, Homo sapiens
ataatattccattatatgaataaagttttattttatttttttgagacagagtttctctcagtcgcccaggctggagtgcaatggtgcgatcttggctcactgcaacctctgcctcccgggttcaagtgattctcctgtctcagcctcccgagtagctgggattacaggcgcatgccaccacacccagctaatttttgtatttttagtaaagacagggttttgctatgttggtcaggctggtctcgaactcctgacctcaagcaatccatccaccttggcctctcaaagtgctgggattgtaggcgtgatccattgcgtccagccgtattttatttatccagtcatcagttggcagataattgtttttttgccactttttggctattatggataatgctgctgtgaacttacatgtacaagtgtttgtgtggacataggtttctatttctcttgggtatatgccttgaagtagaattgttggctcatgtggtaatttactgtgtattttttttttctttttaaaccttttttttttttttttttttttttttgagagaagtcttgctcttgtcccctaggtttgagtgcaatggcttgatctcggctcactgcaaactctgcctcctgggttcaaacgattgtcctgcctctgcctcccaaatagctgggattaaggcacctgccaccacacccggctaatttttgtattttttagtagagacagggtttcaccatgttggccaggctggtctcgaactcctgaactcaggtgatccacccacctccgcctcccaaagtgctgggattataggtgtgagccactcgcccagccttactggtttaattatttgtggagatctagcattgaccttccatatattaatatttatctgttatttgtatcttgagatagtattttcataaatgttttatgtaatttttctcattggcttttgttttatttcctttttattattgttaaacaaaagatttaaaaaaaataattgtgtttagccatctcgtttctgatggccaattccatttattagccatcatacacggttctagcagcatctgggattctgctttcctctgtgctttatgaaagttaaacaatgttttattctgaattctttgactatctatctggagttgacttcttgttttctttaaaggtggcttcagagatgaagtaggtgttgaggattttcagtaaggtggaagtggtagtcaggagagggatttccagaaggagcaagttgacagttgccctttattggcttgcttaaggagctccctgcaagacagtggagaaaatggtgaaaagggaaggcagtcattagtaaaataccattttgctcgttagaactttaatgttgcaagattcact

SEQ ID NO: 114022 - DNA, 1017 bp, Homo sapiens
agagctgtttattcaatatgagttgagaaatgactactgcccttctgccgttttcctaagtttgaactcatccagcaagtcaagcaattttatcttgactcataactttcataaaagcagaataaatattatatatatatatatagagagagagagagaaataaaaactaaccacacaatccaaacattgtaggatactcactagtataaataataatttacttattaaccatttattaaaggcctcccaagctgcaggccctgtgccaggttttgcacagacattacagcaaaacattatgtaaatcaggtggcagtttacttgcctctgtgttcttcagctaaagcatttgcccacgtcttttacctttcttgggtgaagatcaggatcagcacttgataaggtttgggttcagccagcagtgggatcattcaaacagattgaaggcaaaaagacatgcgtttgtttgagcccaaaagtgattagaaatggactgggtttgaagtgagggatgggagaaatcttagccgcctgtgattaaaagagaaaggaggggctgagacgtgcggatcacgaggtcaggagttcaagcctggccaacatggtgaaaccccgtctttaccaaaaatacaaaaattagccgggcatcgtggcgggtgcctgtaatcccagctacttgggaggctgaggcaggagaattacttgaacccaggaggcgtagtttgcagtgagctgagatcacgccactgcactccagcctgggcgacagaacaagactccatctaaaaaaaaaaaaaaaaaaaaaaaagagagagaaaggaggagaaactgcctgaaaagatgattgctggtatatgacagtcagcagtgaaataatcatccaactgagacaattccaaaccacttcctactctctgtttaacttatatgctatcattctttgatattttttctttctttttctcttttcacagaattgataaaaaaatgtctggaggccagagcgggtatgaact

SEQ ID NO: 114023 - DNA, 1053 bp, Homo sapiens
gtataaagtgtcagtgcaatgactgctcagtaaatggcttgtacaccagtcggggcactgatggggaggagactcacatgcagcttaaggagaatgtgaacgggagaaggccaagccctgccccttctctttggcaatgggggagccttgatggatcaacccctgactccctcccagggtcttgctctgtcacccaggcaggagtgcagtggcgcagttatggctcactgtggcctcaaactcctgggctcaagtgatctcaccttagcctcccaaggagcagggaccacaggcacacacatcaccacacctggctaatttttaaaatctttaaaatatttttggtagagacagggtctcgctatgttgcccaggctggtctcgaactcatggcctcacatgatcgtgctgcttgtcctcccaaagtgtcagattacaggcatgagccactgcacctggcccaactgctttcataccagttggccacaccactgctctctttgctgctctctccttccctgacttactaatgccctagtctctgtccagcctgccctggggttcccattttactagcggacagcatctaaaacacattggaataaaatgtatagtgatggcatctcagacatcattcacctcagtttttttaaagggaaccccccaggcatctttcctgtcacctacacaggcagtcacacgtcagagctggcctctcgtggcgcccagagcactcagcttttgaagcctctgtgtacttggccttcacccttttgtcaggtagctgggtatgctcactcacattttaaagatgggggaaagaagtgggtgacagctgagtgcagagacaggcccagagactggtgtgcaaggctgctgctcccactccggcctctcaccagtagaccacacctctttctggtaaggtcaagttaggaaaatctggacagcatgtcaacaccaaatttggcttaggctgtgtttacctttctcaggagttttaagtatgtgcatacctcttctatctttttttttttagtatggccaacttaa

SEQ ID NO: 114024 - DNA, 1019 bp, Homo sapiens
gctgattaatgaaaaagaagaacttttgaaagagcttcagttcgtcaccccacagaaacgtacccaagatgaattagaacgcctagaagctgaaaggcagcggctggaagaagagttgctgtctgtgaggggaacaccaagcagagctctggccgagaggtttgttttccttctggaaatagggcagcttaactcttgtgggggtgtcttaactggatactattttccctgggtttggaaatctcaattgcatctgttcttagtggactgagaaacagcacaaatggactttctgtagaacaataaagtgcaccatcctaatgcccgacaggataagttctgtgttttaggaacgtgcaaaacctgtgacagatgttgaataactaaggaatgctgacataaaaccaggaatgtacatcattgatgaagtctgataacaatagctataaactattgcactccgataagaaaaattatctagactgttagagcaactgaagcttcctattctgggttttattactcacaggaatgcaaaagtttattgctagtcatttcacgaggaaaagacagcttcctccctgtgataccctaacaggtcacaacgtactcacttgcattttgtttgtcagttgcatccctcccgtgaaacaggtgaaactgtaaaggaaaatactctaggcaattttcccatctttctctgggaaggtgtgagttgattattccatctaaaaaaatccagttctgcaaaacagatcagctggaatgttaagtgaagggacctctgtgtgtcagtttgacatgaacgcatctgcataagagcctgggtccaggccttgatggcagaatgggttggatacctgtttcaggacagaccagagagccgttgagaacgaccgcatgtacatcctttaggccagccagtaaacagcagtgcctgtttcagggtgatgggaaagaaattcacattgatataatttcaagtgacctggaagtaagtttaaaacacccagccataa

SEQ ID NO: 114025 - DNA, 1077 bp, Homo sapiens
tactcagcccaaccaatgagcagacatttgctcttcggctccccagctaatgtgcaggcacttgttgagttggtgcgaaccttcctgacatatatagcaatctttccttaaacccacatgtaaaagccttggcctaaataatgacactgctaaacatgacagctagtatgaaatattcttaaaattgttcttttttttcccaacctcaaaagttattttttgattattaattgtgacaagcagaaaagattttcttctgctgaatcttcggcctcccagggacagtgagctgtgtcttagtaaggctctttaatcaacagcagtgggcttcaggcccactaggttttcattgctgaatctccataattaatattgatatgaaatacaaaataatatgacattcctcagttctgcatttgaattacagtttttctaacggagaaaggcatgttttagaatctagattagacaagcctggaaatgggggtggaggggatagacttagcggtattctcttcctgggatttaaaggaagttacctcacgctctttctaagaattgtgggtcctcatacaatgtgtgctcagaagagtcactttaaggtagtattagaagttattgtttttctataactcttcctctgaattttacaaagcacgggactcttaaaacagtttgtcgtatctcagaatttggagatgctagacagtgatatttttgaaccgttgtttcatctgttttaaattttcttaacaatatgctactgagcctttctttttctctagtaggataatgtattccattcctgggaggtgatcatcagcatctcttgtttaatactcaggatgaggattctgtgagataaagtcaccagtatctacttagtgtgttcccaccttcccaggctcagaaataacttattttggaattggctgtccatggggcaggtgggacgttaaattcgtctgccctacggattttcttcctcttcactttcctatcatgtgcctttgctgcagtctcgtggtgagtggaggctgggccattgcatgctcaggggcgtagtcagctcgggtg

SEQ ID NO: 114026 - DNA, 1061 bp, Homo sapiens
gcacttcagcctgggagtcagagcaagactccatctcaaaaataataacaataatttcacatttacataaaaggcatgcttagtcattaggtcttcgcaaaatggtatctcacaaactaatcccaggattagcttttaggttgggggttatttcttacttagtcacagctgaaaatataacatatccccatgttttaaaaaatccagcaatgctttatgtcaggagaattgtgttttttttaccctaaaacaagctcattcaataatctttattatatcagaacaaatactaatttaaacattttattttctcttccttatttttttttctttgttttctttcacttacataggctggaactcagatcagcctggcagatttaccattttccagtgaggttttcactctatggtataacttgcttccttccaagcaaatgccttgcaaaaagaatgaagaaaatgaggactctgtatttcaaccaaaccagccgttagtagattctatagacttggtgagtcaaaattagagtataatatgaaagtaatgtgaaatacatatatgaaatacatatatgaaagtaatatgaaatatggaatgctacgagaccaacatgcttttatcactttcactgtccttccttttctcctttcacaactttgattttcccagcttcctaaaaaaaaagaaagttaatttccagctttgtttcaaatatggtttataaaaggagcactcttttctgctcacacttccttgtaaaaataaactgacataggggcttcactggttttaagtgatcatggaaaaaaccttttaatttaaatatatacttttcatgtattgtgttcacattgtttgattccactgtcaggttatacatttggcacttttatattttgcagatttgaaattattaagccaaaacagtgtgttagcttttcatttgtaacatcaatagccataagtattttctattaaatagttttgtgaaggccaggcgtggtggctcaggcctgtaatcccagcactttgggaagctgaggcaggcgaattgctt

SEQ ID NO: 114027 - DNA, 1029 bp, Homo sapiens
ctttatcatttcattcagttattttagcatattattcataaaaacttaaatttttctctcaatgcctttagtgtatggatcatctgtgggtttgccttatttagctattgtttttcttgactttcactctttagttcctaatgaaatactggatgttacgtatgagaataactgatatcttcctccagagaggattttctattcttctgaaaggcaaatgacaatatgggtagcttacctgaatcatgtggggatgtgaattccagttttactctccataagactgaatgggacaatggaaatatctgcttactattttagcctgatagcagctgtttttttttttttttttttttttttgctttgtttctcagcttcttgctctgcatataggcagcttaggaatggcaaatgccatgacaggaatatcatgtagaatattgagctcactttacagttcattttctctaacctcttgtgagttgactgccttggtagtcctgaactcaattttagtcttcatatcctactgacactgccactgttctaggcagccacagtctgtttagcccatgtacctcaccactagaattgacaaatacgctaagggaaaagagtggccatggctcaccttattatatttctgttctacctgggatcttggccctctagtcctgattgcctttgttgctcttcattgctttaaaacatctgagaggttttgcttgttttgggttctattttattcagctttcatatttgttttcagcaggagagttgagtcgtctttacagatagaagtgtaaattcccatctgctgagtttttaagtcattttttcaagtatattatgttaattgccgtatgctttacattcttcaggatgcagtgtcagccttacttgcaagaacatcagctgagttgttagctgtggaacaagaattagcacaagaagaagaagaagaatcaggacaagaagagccaaggggcccagatggagactggttaaacacttatttcctttgctgtt

SEQ ID NO: 114028 - DNA, 1262 bp, Homo sapiens
tgagtaattttccgtttcatttttgagagttcttaggttttcagatgtagtaaaattgtcacatattgcctgtgtaattagatttctaaaatgtgattaaaatgaacttaccccaaaatcaacatatgcacagcatgagttggtcatgtgggtgttggctcctgatgggtgataaaaaggacaccagcccactggctgccttgcttgccctcctgactttagtccacaatctttgaagcttcataggatgtctccagggatttctaatcagtgttttgtgtgtttcttacatttttattcccttttccaggctgaacagtccaaagaagagcagaagcaaggtctgaatgcagagaagttgatgaggcaagtctccaaggacgtgtgtcggctccgggagcagagccagaaggtgcctcggcaggtgcagtccttcaggtgaatagccccatccaggacagcttttgggttgccctcacggggtctgattgtgtaggaattcacctcagtgcagtgaaagttaatatgaggatccgagacagaagtcctctgttctctaccttgaatatataattttccatttgcacctgaggtgataaatgtgactggcagagttaaaggctgatgaaagcctaactccccacaagaacccagggtgtccccagctcttagtagctgttagcacatctcactgggctatcttgacacaggatacaaaggtacagaaaactcagacatctttgggattttgttcgctcattttacagacattccttgggcagccccagaaaccttacaccttgtcaggctctgagatgtggaggctaagaacatgtgcattcgttctgctcttctggggggctctaggctgtggcagggataggcgggtaaccaggtcattgcagtgcatgtggaaggagctaactaaagggataggtagggacctgtgagagatgtgggaggagcctcagtcagtatggggcaggtgctggggctgcgggcaccagcagaggagattataagagaacccatcatggaaggatggctgcaagctccttaggcacctaggggtggcagttttgagtgggacattgaggcgggaagaacagcatggacagaggcacagaccttagaagtcagtgccaagctctggcgcatggggagttgccagctggtgagcctgcccaggagaactgggctcaagttgcacaggccttggaagctgtgcagaaggcttccacccgtggtctctgacgggcggc

SEQ ID NO: 114029 - DNA, 1075 bp, Homo sapiens
caaagataagcatcccatccctgccagctgatgatgtgtgattacatgacttaagaaattattttttcatctgttcactttcttagggagggtaaaagactgaagatttgtgtttttgttttggtgtttggttttttttggtaacgtaactgtcaactcttgaagaacttttatttcacatcagattttcaacacattaatttgtaaagtaccttgagtgtaatttttatatgcttaaaaaagaaaaaatcatataagaaagatgggataacctggtacacaaatgttgcccagtatgtgcgcattgccagtggacttcattttgtaaaaatggaatagaggcagtaccccacatgtgtactgttgagccggctgttgagaaacaacttggttcagccggtggttttgcttctcctttgtgttcctgtgagtaggctgtgccgatggcagcagcgccacgtggtatctgtgcgctggcgaggagaggagcgctttccatttggaggcagtgtgagcacacgctggagtgcagcgttccaaagtccgcccgaaatggatgctgcgtccacggccatcacctgtgcgggaacacctggtttccttaagacaatttcctttttgtccttttatatttttctaaagaaaactaagatataaactaccaagtgctcttaagaataaaaataagaataagaatacaaaggagcactactcttggctacacgaaagatcttgggattcatgacactgagggcagggagaagaaagaacaccagccacgcagagatacaaataagctcatcaaatgagcagctggtttgtctcactcagcctgaatttgcattaagtgttcaaaagtgagtttctggcttgcactagtgttttgccctaaatctaaggatggtgcctagtggtggccctgtgttctgaggacagagagagctggaggggtggagggaaatgcatcggcactcatttggtgtaaccaagaagagggggaaagatgtcttgatagaatcaaagttgccaaaaacaaagaagagtttatcaagcagatttctaacatttagtagaa

SEQ ID NO: 114030 - DNA, 1041 bp, Homo sapiens
aactcactcctgcgtttcagaaattcctcaggctacatataccacatggcatatgaagcaatactgaactacagatctagtttatttatctgcatgcctttctgtcaaattcacgcttgtgtgcataaacacttttttttcttatatatgctttctgtgccgaggaaagttcagcatttggactctgcaggttggagtcagcatttctgtttattcaccactaaagtagatatccccatgttagcgatttttcattgaacaaaggaaaggttttattcaaatgacctgacaatatcaggatatcaagaaaaatgtctttggaattgtttttctttttttaatacgaaggttttgagggaaaggatgagagaagagattggccaccattttaaatctgagaggatcacaaggtactgaaaactcttcagcctcataaaatcttgccgcactgagtgcctggtaatatcctaaaaacaaaccacttctgttcaaagaagaaaaaggtcattgttgtggaaataacactttgaggttggcttagcatgtggttttgctaaagtagaacacttaaaattttcagattgttagtttttttctttaggaaacagaaactaaagatcatttctgactaccaacagcaacaacaaaaaaaagaaaaacagaaaaaagctttctaatatgaaatttacacattaaagcttgaaactgactgtattggacagccaccacattaatttcaataaccagatcaatgaagcttgtttcacttctacctgtataatgcttaccataatcattttcttttagataaaagatttttccttcattattcagattttagagggaagtgggtctacctactgtagaaaaatagtgaatgagaaaacgtgagcatcacaggtttagctacaaaacaaagaggtctttgtcatcacagttgatacaggatacatctctggccttgtcggagtcttacacttgaggatctgctgtcccatcttccaggtagggacactgagtttgcatttgcgccactgcata

SEQ ID NO: 114031 - DNA, 2410 bp, Homo sapiens
gatctctggtttccaaaagcacttccttagcaagtgtgtcccagttggcttctaagagtagttctcagactagcacctcacagttgccttctaaaagtacttcacagtcaagtgagagttctgtcaaattctcttgcaagttaaccaatgaagatgtgaaacagaagcaaccttttttcaatagactatataaaacggtggcatggaagttggtagctgttggtggctttagtcccaatgtgaatcatggagagctcctaaatgcagctattgaggctctgaaagcaacactggatgtattttttgtcccactaaaagaattggcagatctgcctcaaaataagagctctcaagaaagtattgtttgtgaattgaggtgcaagtctgtgtatttgggcactggctgtggaaaaagcaaagaaaatgcaaaagcagttgcatcaagagaagcattgaagttatttctcaagaaaaaggtggtggtaaaaatatgtaaaaggaaatacagaggcagtgaaatagaagatctagtactccttgatgaagaatcgaggcctgtaaacttacctccagcactaaaacatcctcaagaattactataatgtgtccaaaatatcactgcatacaatatctggtatttgaagagaaaaactgacttttgtatagtataaaacacaggctttcacaaattttgtattgctttttttccagttttgcagaaaatttacattctagttctcttcacacagtagcagttgtaaataatttatgaatgacagtacacattaaaaggtatgcattagcagcatattagtatgctgttttatttgctgaagaaaatactgtcttctatttttaatgatacattaggtacgatgtgtagttcggtagagtcctaaaatttttgtactactttcaatttggtgaaaatgtattaagttgtctaccatgttttcttttctagctgaataaaccacatcaaaggaaagggaccacagtatttgaatgtttgaaagtctgtaaagcttaaggttttaaaaatgttgcccgtaatgttgaacgtgtctgttaaaaaataaaagaaaaaatagttgcttcaaactatttttatgagaagttgtaagcattttttagatataaagcagtataaagtacttgttattttactctgaagttgtttaaaattcaccatgactttgaccgctgaagattctttaagcgggttaatttatgttttgaggtggaatacaatttacacttttttcttaaaaacatgaatgtgggtttctatattaagcatattttgtgactactattaacagattgatttgtttagatattaaatgctttaagctattttaccttttcaagaagttgtgttttttttctccaagtcagaaccaattcctgcaaataggcttcccatgacttgtcattataaattagacaaccaggtaattgtgtgatatacatctttatttaatttttttttttacagcaatcccctgagccagaatagattaaaagcgattcccttcaattttcaaatctagaactggatggtttttgtgtttatgcatcttttagaataccggaaagaacagagagccgtgttcagctcttgataatgagcctattcaatttaactacattcgttaaaatgaagtggaattttgttttcgtcttaggtgattctgcctgtttgtctgtcattgtatattctgtttactttgcttcaaactggccccaagatgttatttttgtggtttctggctttctagattctatttttagatactgcccattgagcaataatggtgataatatagagagaaaagaaagacctttcatgggccagttgtgttggaataggaaaatcaaacgtaagcacaatttaagtatgtagcagttattcctattttgtattctaggaataaaaagatactttaattttttatgctagaattacataattacataatcagatgttttaattttaccatataacctttaaaaatgattcatttttgaggatatttaattggataccaaagctaaaatccatatactgtaagtgggttgcctttatagattgcgggacacaataacatgaatgtattgtgaaagcacttttagttacctcactttcctcagtcttggaatgtgtattttgtgggataatgattatcagaaaagcaaaaaattacaacgaacaaataaatttatataatatatccaattaggtggtttggtaatttcctaaattggcttgtttcaagttactatgaaggttattgagaatgttttatagtgacttttgatgtggaggaagttgtttagtgtacatttatgataatcctatttaaaaacctagaaaaatgctcttggttaataacatttaaagaatcct

SEQ ID NO: 114032 - DNA, 1036 bp, Homo sapiens
ttagtgtctgtatttagaggatgggagagaagaggtatcatctagggttttggcttgggccacaggtagatcttgttaaggctgtacgaaatagaaaatccaggaggtaacgcaggtgtgtgggggaaatgatacaaatgtaaatcatacaaggatatgaaccctgtagattttacaactttgagctctatccttcttaggccttctcttctaagcagcataaactactgctgcctacatgttgcctgttcataaaggctgaggcaggggagtcgcttgaactcgggaggcggaggttgcagtgagccgagatcatgccatttccctccagcctggcgacagagcaagactccatctcaaaaaaaagaaaagagaagaaaaaaacaaagaactttatgcaccttctggaataacaaaatgcaaatgtaatgttatctaccaggatagaaattggaggctagaatatgttgggtagggtagagagactagagggaatgatttagcaataaaataggtttaaatatcttctcacgtgcccagacttaattagctttgtattattcctattagtaagccaggaattagtactaggtgataagcaaggatgtgcagggccttgtgaggaaaagagttactgtagcagttctggatgcttaccccttgcatgtctccaggggaaccatctttgaccttggccaacccctggattgcaatccttggagtgttctttatgttagtgatgatgattttgttgtatacacctggagcattggaccattccatactggctcgccaggttgcgttgcacaaacaccaagactgataaataggcacctggttttattattgggcccctgagttttggttgccgtagccaattccatagcagagtatgagtacatgaacagcctcccacaaaagccttaaaccctgagactcaagtgggattctgtgggcagagacattccacacgtgtctatagtttgctgagagagagacagaattcctgtgtagctgcagacaaaggacaacagaa

SEQ ID NO: 114033 - DNA, 1108 bp, Homo sapiens
aattttttaatgctgaagttatcttagatcaacgatttctccaaaggaaggaagagcaggcaacaggcagctcaactgggtagctggaggagccagtgttgctgatggtagtttatcctaaccatcatctatgtaaggatggggaagaggatggagatcactattacagatcacctacagaccagcttttttacaggtgatagtattgggacgcagagaagttagcttgcccagtgtcatataacaatccataaaataagtatatacctaaaagtttaagagttaaacaaataattatcttttttctggctgacaattattgaggggagaagcaggcccatgggaaaaaattaagaactcggatatcataaaatatttttctgtgaagtctcgcagcaaatttaacatctctgaaggaaaattagaatttcctggagaataatgtttcaagtaaccacccagtcaaaagtactagaaactgtgtatcctttattcttattttaaaggatcaatgccttatgctttcagcactagctaaagaatagtcttttaaaaatgaaactaatgctgtcggctaggtgctttttgctaaatctattgtttatttgaagtacttgattatttaatgaggtcttattggagctattgttacattaattgctcttagcatggttaatccaatatttgataggtattgattatctttcatgggtaacagattttttttttttttttgagacgagtctcgctctgtcaccagggtggagtgcagtagtgtgatctcagctcactgcaacctctgcctcctgggttgaagcaatactcctgcctcagcctcccaagtagctgggactacaggcgcacgccaccacacccagctaatttttgcattttttagtagagatgggttttcaccatgttgggcaggttggtctcgatctcttgacctcatgatctgcccgcctcagcctcccaaagtgctgggattataggcatgagccaccatgcccagtaagggtaacagatatttaaaaattatttatttccataaattgacattctctgactgttttatacatgaaaccagtatatctcactttacacaata

SEQ ID NO: 114034 - DNA, 1056 bp, Homo sapiens
tacaggcgcccgccactgcgcccggctaattttttttgtatttttagtagagacggggtttcaccgtggtctcgatctcctgacctcgtgatccacccgcctcggcctcccaaagtgctgggattacaagcgtgagccaccgcgcctggcctttttttttttttttttgagatggagttttgctctgtcgcccagaccggagtgcagcggtgcgatctcggctcacggcaacctccgccttccgggttcaagcagttctctgcctcagcctcccaagtagctgaaatgatgaggggcgcctgccaccatgcccggctaatttttgcatttttagtagagacagggtttcactatcttggccaggttggtcttgaactcctgacctcaggtgatccacctgcctcggcttcccaaagtgctgggattacaggcgtgagccaccgcgcccagcctctttttaatatagattaatgagtattagttttgtgttctttcttttcattactttatttctaactatactttcatattagataatgtggtctttgtatgaaatagtttttaatgtatatgtaccaaagaggagtatggtttcatggtttgagttctaatttcaattctgtaaaaaataactaccttggaaatgttgtgtctgctaacacatgataacgttctcatttttcttttcctttttttagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagcc

SEQ ID NO: 114035 - DNA, 2460 bp, Homo sapiens
attgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttgtctgtgaccttaattttctgcactgagttaccaaatatttccaaccaggtagtcttcagatcacctgatgaaaggagcagggaacaggaagagggtggtgtaaacattataaaaatttcacaaaccatgcctatttcattttcacttaaaactgcaatgttattttttgggtaaacacaaaagtttcactagcattttagttatacatgcttaaaaaaatgttagatgtagtgggatttctcttaagcatcaaatgatcttgggtactttaaaatacagacactatgccatttgagctgctttttccctagtcctatttatacgttggcttgttcatctctagtcttctaggagtttaaggaactggagataagagtaatttgggattccatgtggaataatgtgctcttatgagagtacgtgctgctgtcttttgcttagtagcattttgatccactgtcagtagcccatttgtcaatgccttgctgctgctttgtagatatacttagtctagtgcttaataagggagttgttttgtgttttcttttaattgggacaggtaagagtagttagcataccaaaaatatacattggcttacattggcaaactttgggttatatagtatcacggctcaaggttgaacaatttaaaaatacatcttaattaatagtattttccatgtgacctgctgccaggatgcgtagccacaggcctatcagtggaaaggggcatatagtagtctttaaatattgcctttatgtcagagagttgttttaaatggttttgctagtggttattgttcatttctgtcccaatcagtgactattttaaataatagtgtatttactgtcttaacttctagtattggtgctgtttgatgttttcacatttaattaacttatttcatcatcataatgcaattaatgtatttgtaaattgaattttccaagattctgatatttgaagggtaagcatcttgatggatatatgtccatatgtttagagaaggttttggttttgggggcagcagattgactagttctttaaatctgtgtgtaacgtatgttttattcctcatttcttcctaatctgatgatcttgattctttttgattaacatgaaaaatcctgtctgcttgttttgggaaaaaaaaatgctttttttctcttctagctctcctgtgtgacttttaggcatgtcatttcaccttgtctgggtgtcaggtcattcacctgtaaaatgagttggcttaaatatctccgagattccttggaaatttctactatttgcactatagtgaggattttaataatgacatgacttctcttttcattaattttgtccttcattctgaggtataaagatagtttaaaggtgagtttggagatgggtaaatgtgcaatatttgttagcttctgtcctaagaatatttggattcatgactagagctagttgattctattaccttttgagtgagaaatgttagacagcatgattaagaatttagcaaatcctttctcatcaccataacttagctgagttgtaaggaaatccttttgagaatatggcattttgttttagtgattacaaccttgttaccagaatggagctttttacttgacaccattaaaaatatcagtatggacaaaacccccaaagccttcagatgcgacttacatagaagtcaccactttttcatacgtaaatctgccttggcagatgggagaaaagaaacgacttcctaatagaaatgccaaagtttggattagacttgacgggaaaacgaacctggaaaatcctggaaggtgtgctctctttaagacctaatatctgaaacagttttatgacttttttgttttgttttctacacatcttggaaatagaagtcttaagcatgcgtagcattaggactggaatttcttttgttgagtattctggatctcatatcatggttaccaactcatactgtatacaccagtggttcccaaacttaacgttggaattacctgggagtttcaacaaatactgatatctgtgccccaccctcagcaattgtgatctaaattcatttggaatgtggcttaagcattagaatttttaaaagatccccattataatatatggaaatgttttggaaccactgccacatttcacagttttcaacttattgaaag

SEQ ID NO: 114036 - DNA, 1096 bp, Homo sapiens
gtggagcatcacctgggagagtaggagagtgaatggccccggaatgccaggactgtggccaagctgcaggtttgggtcaaaacttcacatgagctgactactcattttgttgcctggatgcagacatgaaaaaataaacaaaaaataacaaattttcgaaatctctacagtacaccagaaaaattgcatctccccagtccttttcatatacctattaggtggcttcctctggggttctgtcctcattccccctcctgaaatggaaggagcaaattttcaaggagcagttaatgtaagtaagctagacggctagacggctcttcagcgctgtctgaatcaagtacttagtagttttatgttgttcaaaatacattttaagtgaagttagttattttgggacttcctttactatattgcctaaactacatcaatcagagaaaccacagctccttcatcgtctcctatttcaatgcgagggaagtggtctggaccaagattccagagatgtggactcaacctgtgatcttggacaggtcacttgtcctctttggcctgcagtttgttcagctggaaaatggctgatttaatatatggttacctaaaagtgtggctgttattcatgtcttaacattagtccgaggaaagaggtctcctggtcacaaacttactaattgggtagtttataaaataacagctttaattcacgtgcgttgtaagtacactttaaagcagggctttctaaacttcagacaccacagacagatcttgatggattttgccatttctgcacaccattctaattttatatttaaaactactatgtgcttagtacttttaaagtcaactcactgtttgatgtaaatttattttaaaaaggaagcatatcactttggcaaatggaaaattagtatcactttctgcaactagaagactaccttaaaatgtaataaaaacagtgttattaaacactagctatgcagtatggccagtgaagagagcccaaagtctatcctttttttaattaaaaggtgtgataagtaagtaacgttaggtaagggtaaaagacacgtaaacaccaaattgagtctttctgcat

SEQ ID NO: 114037 - DNA, 1932 bp, Homo sapiens
atttgcagccatgcttagacctagtaagcattttacattttagctatcatataccctgactgcattaacccatgtgtcttaaaatttttcttccgggaaccaggatgttctaggtaggcacacgtgatttttctaaagacgtgtttaaattgtcaagtgttcacattgagaaaagctctgtaaagaaaaaaaaaggttttaattaaatttccaaataatagcaagttaactgaattgtaaacctaccttggaacctcagatcttcaacataaggctgataatcagatcttccttcccaggattttggttataacaattgaactaatattacgtcctttgatctgaacttttaaaagagtaaaaccaataatgtgttaagggcacttgattttaaaaatgaatcataataatataggattcttttatttcataagtgtaaaaattatcaacccacttcaggatatagctgtatttagtgtaacacaagttgtaaggtatgaggctgagaattatttctttttttttttagacatcgataagcaatatcatctcaattgaaactcctaatacagccccatcaagtaagaaaaaagacaaaaaagaacaactttcaaaagcccagaagcgtaagctggcagacaaaacaggtttgtgtgtgtttcttttcttttcttttcttttttttgacagagtctcactcttgttgcccaggctggagtgcagtggcatgatctcagctcactgcagcctccacctcccaggctcatgcgattctcctgcctcagcctcccgagtagttgggattataggcgcatgccaccacacctggctaatttttgtatttttagtagagacggggtttcaccatgttggccaggctggtctcgaactcctgacctcaggtgatccacctgcctctgcctcccaaagtgctgggattacaggcgtgagccaccacgcccagccgtttttttttcttttataacccagataaatggattgcttcttagtgtgatatggtggatatatttagattaattcttactctttcttcttggaacatttgggccagtgaacttttgggtcactgaccttttgggtcacatatgtatactgaaaatatttcgagaggctgaggcaggagaattgcttgaacccaggaggcagccgttgcagcaagccgagactgtgccactgcacttcagcctgggcaacaacagcaaaactctgtctcaaaaaaagaaaaaaaaaagaaaatatttactactacttcatcacaagaggtcaccatttgaaaaaaaaaggtaaccgagtggcaaagtaactataaatgagtctagagattgaggagcatttaaatagtctacaaaaacatgttctacctggagctctaacatgtttgggatttgtttacctctttagtagctgtgtgttattaaaaattttttgaaatacagttttcatttgaaatggataccagtataccattaggtcttagtgtgataagtaatttaacatttttgcctgtagttaattatacaacaataatatttaagaatagaattctcatatgttctaaacaagagttctttagaagaagataataaactctagctcatatcaacaataatatttgattgcttttctttatttaacctgaaaacttgcaaattgataacagtctgtaaactttttcacagttagggaaaatgaggacgtcatttgtgtacttgcacatttacacttatgtatgtatctatgcgtgtgctactatgtcaggttaaaaagtttctctttattgagaagaaccgacccttttattttggtgagggcctttttttttttttttcttttttcttttgagacggagtctcgctctgttgcccaggctggagtgcagtggcgcgatcactgcaacctccgcctcctggg

SEQ ID NO: 114038 - DNA, 1479 bp, Homo sapiens
atggtctcgatctcctgacctcgtgatctgcccaccttggcctcccaaagtgctgggattacaggcgtgagccaccgtgccaggcctacatgattatttttctttagtgtcatgtttgtgtcaagaaggcagggagcccagcacaagccctcttttctcttaatgctcgaattcaagctgcttttcatttctctattcccagcttttggctgagtccccatgttattttgtgtcagacttccttattgacctcatctttccttgctggaggtagacattggatcaccatgaagtggagtagtctgagccagcacagctgatttggaaggaatgtgaggtttcaactgcatccctcagggctaacactcaaatctacagcatcctcttcccactctgtggcactcagtgcccagactcaagtggctgctgtgaagcttctgtttaagaattgttctctgctttgtacttcatctacaagtgaggtgaaatgcatcacagcaatatgtctttgaaataaacaaagcctattggattttagataatattttatttgagcagttttacaagaacagaagctggaatggtgaagaatataagtagaatttacctggaaatgggctacttttttttttttttttttctttagcaaagtatttgagacccttgacatcattagacatgcatcatcgttttatgcattcagttatggggctgatagaaactctttggcttcagtcattctttaaatgggaagtatagcttctccagggttgagattccaccttcaacacttactagttcttactgaatctgtaagcctgagtttcctaatcaaaaatgggaggtgtgtatattgaatgagatcaatgcacataaagtgcttggcactcagtaacaggtggtttctgctcctgtcaggtaacttttcaatttctgccaatgtttgcagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggtatgatcttctgtgtcagggcagctatgtcagtttgcacatgtgtgttattcactaacattccttgaaggcaatggagtaccgttcagactgcagtggtcactttgcggattgacctccagtgaatcttgttcacttcctcacaggtagcataattattgactgtatataatgctgggtacgtgaagaaatttagaagactaattggtctgaatttccaaatgtttttcttgtattatcttttttggagacatagtaatttactgtttagtctcttaaaacgctttgctttatcactgtttaagtttcaaataattaattcttttggatgactactctgcagtgtatcaccataaagaa

SEQ ID NO: 114039 - DNA, 1059 bp, Homo sapiens
ccacctcagcctctcaaagtgctgggattacaggtgtgagccaccgtgcctggctgacctgtgctgtcttgataccacctttgctaataaaatttctatttgtttgagagcttgtaatggtactttaaaatacttatgttttttaacagaatgctgatttttctggacagttgtccaatttccttttttaagttatctgtttgttactgacagatgttaatgacaggaagaacaacgcacatgtcatggttctgttctttatgaaatcattgattcctctcatatatttaataactaatggctcatttatcaggaaatcagagattgacattattgagctgttgagcactaaaatgttgagtaaatattctttgttatttctagtgatttggttcttagaaatcgtttattaaactaatttatatcattaaccaccctcctcatttaggaattataggaccgcctataatcttgtacacgaattgagagcccatgaaactaatattctggaaattaagactatggcaggatttataaactacaaggtaataattctgcttccaaatacagggaatttgtgtttcaatattaaattatctttttaaaatttgaacatcaaaattaatttcttgctctgaaaagttagtatttgattaattatgatctccccttttatatcctttttctcagaagggcatcgattcttagcaggctatttatagtagttgtattttgaattgataagttctagaggttttaaaagtttggagggttttttggtttttgttttgtttttcagtgggagcaaggaggagttgagaagaaagctgcctgtattactgagttttaaaggataaaattattagaactatgtgacttcttcttggtttaatggcacagaaaagaagtgtctattcaccttagaggaaactttttttttttttttttgagacggagttttgctctgttgccaggctggagtgcagtggtgggatctcggctcactggaacctctgcctcctgggttcaagcaattcttctgcctcagccttctgagta

SEQ ID NO: 114040 - DNA, 1051 bp, Homo sapiens
cattcttaacagtgggagttggtagtaggtttataagtaatttagattttcatccttttggatgttttctgcatttttcatgtattacgttttggtttcagagggaaaagttaaaaagaagaaaaagcactgtaaatctgtcagttctggtgccaaaaatattcccccacaatagcaagatttaatacagaagtgataaagaaggaaaatagtgtcttctttgtagaactccttgtaacattgttttcatttacacaaagagcatgtatgcatgcggaataaatatagagcataatttgtaatatatttttactggtttattagagcaaagattaaaaaagtgaagaaattactgtgaaatcatttgtcagaatcagattgatttttatgagactacctaaatatgaaacatttttagcttaatttttgttaaaatttatgttaaaatattcacaaatttgataattgaatatatatttggtggttgtatttatgaaaacttttttgttcagtcaaaggttgggcaagagttgatttgcgatgagttccataaactattatttaggtttgtgttttaatttacaggcttctgtaatgtatcccaatcctgatcccttagaaacacaaacaggcgttcttgacttttatggacaaagatcatggcgacaaggaatactaagtaaataatttttccctctgtcctttcctctcaacctcaaaaggcaacaatagctataatagattttccattggctgcacatgcataagaaattatgttgaagtaaaaatgtgtgctttttaaacattgtttttgtttttagaatgctttgtatgtatcactgcatcttagagtgacttataattaaagttgctgttgtgattaaaacatgtatctgggtgtggtggcacatgcctgtagtcccagctacttgggagactgaggtggaaggatcacacctgtgaacagccactgcactccagcctgggcagcatagtgagacctcatctcaaaaaaaaaaaaaaaatacaacatttggacatctgttgtttt

SEQ ID NO: 114041 - DNA, 1087 bp, Homo sapiens
acctccacctcctgggttcaagtgattcttgtgcctcagcctccctagtagctgggattataggtgcacaccaccatgcccggctaatttttgtatttttagtatagataaggtttcaccgtgttggccaggctggtctcaaactcctgacctcaagtgatccgcctggcttggcctccccaagtgttgggattacaggcgtgagccactgtgctcagcctaaattttatttttataataaaaagttagctcatttgtctcttgaagtgccttaagtgcagaagtcagtaagaatggtcagtgcagatgtgtctttctgaagaatcaatttggttaacaggatgtgtgtgggtcgtgggtatctggttgtgcataacacagcccttttgttttatttctagtgcagtgcaaagccaagtttcatgccccaagttttcatgttgatgttcctgttcagtttgatatttatctgaaggctgattgtccacatcccattaggttttccaagctctgtgtcagctttaataatcaggtaatgatgccatgtcatgtgtttttaccacgtttatcttattgtagcttatgttaaactagataaaatgagcttagtgaattttatgtcttaatggtttcatagtaacaaatgaactttggtaaggtctattcaaaaatatatctccagggccgggcacagtggctcacgcctgtaatctcagcactttgggaggccgaggcaggcagatcacaaggtcaagagatcgagaccagcctggccaacatggtgaaaccccgtctctactaaaaatacaaaaaaatctgctgggtgtggtggcacgtgcctgtagtcccagctacttgggaggctgaggcaggagaatcacttgaactcgggagatggaggttgcagtgagctgagatcgtgccactgcactccagcctggtgacagagcaagatctgtgtcaaaaaatatatatatatatatgtttctaaacttctagcaattcaagtttacactttgcttactccaatttttgttttcactccatgtttataaagtcttaagaattctctgtgtgtgtgtgtata

SEQ ID NO: 114042 - DNA, 1342 bp, Homo sapiens
ttaaattttttttataatgtatacttgaattccaaataaggtatattcagaatgaatagaattaaaaaaacatttggtttatattttacttcaacattattagttaatgttattagtttatgattatggaactaatttatgtttgacatttaaaaaattgaaatggaatagatggatataatgtgaaaagtaaatgtgtgtcttctttcttctccattctcccacacaccctctacgttaacttcttgaataacctagacattttctgcacatgaatatataagcaactttttttcttgcagaattgggatcatatttcctgcatttgaatatatttgaagcattatatagtatatagtcaagtacttcattacaactctattataaactcacttagtagataatcatcttttgattacccagaaagtatagtgagtctttcaccaacaagcatttattgagagttacgatattcttaacatgctgaatctgagtatagcatatgtcgacctcattaaaatttaggcattttggggacaagggccaggacagaatcaaagattgcccaaataggtaatgaagactaaattacgtagtgtaggctagaaagagggacagctgtagtaggcatgccagaaaaaagggagggagttccaagaatgaagatgaaattacgataggtcgaaaagatggagggggagaacatgtttggcaatgagaaaacactgcatggaaacagaagcgcacaatctgtgtttctgggaaagtcacacctcactagaacagagggtttataatgctgggtggtgggaaataaggccaggtggcttaaaggaacctggaagagttaagcggggataggctagtaaacagatgtctttgaagatttatttgttcttttgtctgtgttctatttattggatggtgataaagaaacgttatctgttttattaggatttgattcataagaaaagagaaatatctctgtaatagaaatgattagatgaagctgggtcacctgaagatcagtatgttctattcaacttcagacccttgcccagggatttcctctaatccgtttgagaattttattttagtgtgtgtgcgtgtgtgtgtgtgtgtttgtgtgtgttttgagacaaggctgcactctatctcccaggctggagtgcagtggcaccatcttgagttactgcagccttagtctcccaggctcaagtgatcctcccacctcagcctcctctgagtagctgggactacaggcacatgccaccatgcccagctaatttttgtatttttttatagagatggagtgttgctcaggctggtcttgaactgctgg

SEQ ID NO: 114043 - DNA, 1328 bp, Homo sapiens
aggcgctacccttgccttccccagtagttgggactacagccaggtgccaccatgcctgactaatttttgtattttttctagagatgagggtcttactatgctgcccagccttgtttcaaactcctgggctcaagcgatcctcctgcctcagtctcccaaaatgctgggattacaggcctgagcctctgcacccagcctcttatttcttttaaatactttatttgaataatttatttgctttttttttgatcagttacttagctaaggtttcttttcaaaggatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggtaagcattcctttttgtaagtttgatcagtattaatccaacattaaataagcatcagtgatgtcaactctaggacttttgtttacaagagggtatggcatagtgctcttcacacagtattgattattgggataatgtttgaattctttgttttgaagaaccaatattaactcttttaggacaggatgccaatttaactcagaagactcacgtgactcttcatggaacagaactgtgtgatgaatcctacccggctttactcactgacattcctgttggagacttacatccaggggaacaggtaaacttggtcaactgggattgaagaggaaatcaattagtttgtagttttaaatatatagtgagtttttaacagttcagagcgttttaacgcatattctaggactgaaaaagtgatttaactaatgaacatttcatacacattttacatacgtaaatgtgtaaaatgtcttaagcagtttttctacaagggaatttagaaaacatgcttaacatgaattagtgggctaataaaatacccattgtttgtaacttagtgcagttaacttctcagtcaacttctgcttccaaactagatagaaaaatattttggaagttaaagaacaataatttctaaaagatgcagtagtaatgatcccacccttatactgtggccacagtgtaatcagagtactctactacagtgggagcattgatgagttacattgtaacattctgtaaaagtgataaagaatttagccagttggtataaataaactctagaaggtgggaacattatcctagaatatatatcaagaagaaatgtctgtaatactaattaaattacaacatttattttgttacagctggaaaaaatgttgtatgttcgctgtggaaca

SEQ ID NO: 114044 - DNA, 1053 bp, Homo sapiens
taattaatatatatgagaacatatgaaatagctcagtgctcattttctaacagctcaataaaagcttgttatttgtccattcttgctgattccttttctttcagtgttggtcatttccagtatcctgacgttggttctcttgttctttctctacaagtcttcagctgccacacgaccttaggctgcctgcattccctcgtccagttggaggggttgtctggttgtaagggttgttgtacgtacacttgatccaagctggaaactgcagagaaaaactacactccttcacacgcacatctatccttcacacccacatccaaacatttttttaatccagcttttcatctccatcctcagtgccatcctcaccatttctctcacctggtctatagaagtaggtccttaactgttttcttccttggcagtcattctcttccctatcctgcctttcatattgccactagactttgtgacacactggacctcacctggtcaggctctggctgaccttcccagctgcctctaccccaggctgtctactgccctttgctctctcccaggtttcaaccaagacaaacttagggcattcatccaacattgcccccagctacttttgaacatatctttggaacttttgtgtaaaaccttcatctttttcaacctgttgaactctggcttgctcttcagggctcttgtaaacttgaacttcttgttcctcccaagcaggactaagtactcttccttctttattcccatggtgttttgtacacacctacattgtaacacttaccatattatattgcaatttcgtatttgtaaatatggctcccttactagactgtgtgttcccttagaacctgagttgtgtcttattcatcttcatatcgctagcatcatagtacttagctaataagtgtttactaaattaaggaataatctgtggcttgaacttctagtatattagtttcttactgctgctgtaacaaactaccacaaagttagtggcttaaaatgacacagattcaactgtattaaagttctacaggttagaag

SEQ ID NO: 114045 - DNA, 1027 bp, Homo sapiens
tttatttttttgtttgtaggtgtcaaaatagcattttaaaggcactgctgaattattccatcatactacagtatgaatttgtgcttgtcataatttgtgacttatatgctattgaaattttagccaaactaaatctgtacacaaagggtgtgtgtataagaatgttcatgggctgggcacagtggctcacacctgtaatcccagcactttcatagacctaggtgggaggatcgctggagctcaggaggtatattcatttcttattgatgagggcttagatgctttgcctgttgcttttgctctgtgatagtttgcacatcatgtcagctgctccacccttaggctcaaaagggatttccctggcaccacccttatagttcccactttagctgtaccacagggaaaatatttaacagtttcataatgttacttcagctccataaatattggaacaccactatgtttgttgatagtaaaatacttttagttcttcagtttctactgtatacgtgtagtgagttacaatagtgctcttcaaagtggtctggggcccacctgtaaaccatcctcagtgagttaaggaatttatgtcatgatgtaaatcactgcactgttcctgaattgagaaagtcttgctaccaaaacactgtattaaatcgtgtgcatcatgattgacagtctgacacacctcctcacttatcccccactggtaacatgcagcagccctgggttataacagtttgttaattggaaatactcagaagtgtgattttaaaagctcttaacttcacaaaatatttccattaataatgttttgggaggcctggtgcggtggctcacgcctgtaatcccagcactttgggaagctgaggcaggtggatcacctgaggtcaggagtttgagaccagcctggccaacatggcagaacctcgtctctgctaaaaatacaaaaattagctgggcgtggcttcacgcgcctgtaatcccagctactcgggaggctgaggcaggagaatcacttgaaccc

SEQ ID NO: 114046 - DNA, 1020 bp, Homo sapiens
gcattttggtgcctgtaattccaaaagtatatggttctaaccaactgtaaaacttcaggtgagggttggacaacaaggagataattactggattcaacaagaagcagggtgttaagccactcaaaggaaaagtggttttgacttggcatcttccaattcactacttagaaataacctactagaatttgcaagtccattcttagaaataacctactgtgggcatatagaaaaaaagtttggacttttgattttcagaacccttcaaagggtatacaggatgctggtaatgttttaaaattgtgctatgtattttgagtaaatcacagtaaattaaagcccatacatgtttattgagtgctttctagcgccagcctctgtgtcactcctgcaaataggaagactgatgggacatgccatcttttggggtattctgacataagaaattgagagtgtgctaaatgctttgaggactctttgttttgagtgaacgagaagcagttacttctgtcttgtgagctggtaggggaggtttcccaggtatgaggcttgaacttgatcttgtgcagatggagatgggggtggggcgggagttcctgcagagcaggagaactttccctgctggggaaggaggtgcccggagcttgagtgaaggcttggggttggagagttcctgatgtgtttggaaactggctggggtgataagacaatggaaaggtgggagagggccagatgtgaagatctagaagccactggaggcttctaagcaagggtgggaatgaagtgatttgatctgtgttacaatgagaattccatgccagtgagggtgaagggtgggactgggaggggattagaaagaaataggagcactagctaggcctattgaaacagagggagaaatgccaagtgcttctttagagtgtttgctctccttcggtacacttgcacaggccacggttagtacccgaagaaagacaccattagtctggttgaggctggagggccttctagcctcggccacaa

SEQ ID NO: 114047 - DNA, 1079 bp, Homo sapiens
cttggcagtctgtatgagaaagccatctaaatgttcatatagtttgatgtagtaattttatttctggggctatctctaagataatattgcaaaattttggaatatttgtaatattgtcttagagatagtcctagaaatagagttactgcatcttacattttgtagagagctatatgtaggaagctattcattacacaatttttaaggaagaaaaattgcatataatctaaatgccacgaatggaaaatattaggtaaattatggttctttatattggatggaatagtatatagccgttaaaatatctatgaaggttatgaagcaacatagaaaagtgcttatgatatataatgtcacttagaaacacatggaatatttcacaacaatacaaattagaacagaatcttaaaccagatgcttagggaagatgggaaagaataacaataattactgtatattgagtaattattatgttttagggactttgccgagtaattttctcacttaatttttataaatggctcttggtttgttcattttgcggacaaagacactgagcttagagaggttgtgtaatcttgctcagccatgttgagtgatgggactgcatcgggaccaggtctgcctgtgggatccagggtccgtgcttgaaactggtaatttgcaaatttttctgtgtgtcagaatcatctgagaactttaaatagataaatgagtgagcaaacaaatacatgccccgtggcccacctcctgaattagtcacctggcagacaaccagagcctggcacggtttacaccaagccagggtctagtgccagcctgtggccagcatttaggaccctctgcacattccgtttgttgggtacaacacaaatattaaaatacatacaaaaatacacaaatattaatactgtgaatattaatagtggttggatttgggttagagaactaagtgattttagtcttttttcttcattttcagattttctttagcgataaatgatgttactttgagtataaagatttagtaaaaagaaaattgaataaaagatttgatttagagtccttcttttgggggg

SEQ ID NO: 114048 - DNA, 1054 bp, Homo sapiens
actggtgggattgtgagttgcagtagtagcagaaagaaaagacagaacgtggaaaaaagccgtttcctttctctttttgttgcaacttctagtcccttgtcatttgtttgtctttgtcacacttgcaggcctttccaacccccagaatctagggtactgttatacataactagaagacttctatgcgccagattatttaatgctcctcattccctttgcatttggtggcacgtctccctcatgtctttgtattaaactgtcagtcaccagcataggtaacacagtacactttaaatttcttgtgaaaatcagcccttggtcacattgtcttagccatgggccaaggccttcaattccagccccacctcaggagttcacagatagtgagtcaatacgttccctgtaattttaagccagctcgacttgcggtttctgttacttgcaaccagatgcacctaatggatcctgattgtaatgaactttataattagattttctgttatgtgttggaaatgaaacagagtaattctcctctcctggccaaggaacttacactcccaaagagacacgaagaaaagtgaacacttactgagcatctgctgtgtgtgctgggtgtttcagagacatttcctcatggaatgctgaagatggccattactgggcctgctccctcttcttgcaggtatgagtgatggggtagaatcggcgaatcctttagatctttactgcattgttgctgaagttatgctgattgtgactatttctgggctgtcaatggatttttatgtggccctgagcacagtgtctcagggaggtagggctatttccagtgtctgagcagaactaatttcacatcccccccaacaaggtatctagggtcacctggtgcgttgttacttgcttttctgctaacctgctttccttgcacacagtagaaaattgggctaggagtaacatactgttctaactataattaaaagaattccccctcattggccaagtgcaagcacatggggtttttacactctcagtcgactgaattacattctaggtg

SEQ ID NO: 114049 - DNA, 1051 bp, Homo sapiens
tggaggcaaattattacaatagaaagaacactagaattggctctgccaccagcctactgtgtgactccagggatgcagagctagtcacacctccctgtagacctcctgtgggatctgtgaggggaaagatctgggttgacttgtttccagtttttggctattaagagtaatgcagctacaaacattccctacaagtctttgtgtgacatatgttttcatttctcttgggtatacacctaggagtggaattgctgggtcgtatggtaactccatgtttaaccttctgaaggacttccaggctgttctcacatggctgtaccattttacaatctcaccagcattgtgtaagggttctgattcctctccatcctcaccaacacttgttactgccatttttttttttatctgagccatcctagtgggtggaaagtggtatccactgcagttttgatttgcgatctcctggtgactaatgatgttgaacgtcttttcatgtgctttttggctgtttatcatagcctttggagaaatgtctgttcaaatcctttgcccattgtgagagtcattgactttggtatttgttgtttggactctccttctcctggcttgtggagattgctttatcctctgaggttgcaccgcagatcctcttctgcaagtcaatgggtatggttgtggtgtagcgggtttcagcagcaacagtggtctgaggaccactaaaaataaacataaggagtgtcactacgttagcagcataggctgttttatgctgaaataacgtctcagtggcttaacacattaagcctcatttcttcttctgcaaagtctatgctccaggctgctgcaatcttagggcacgactctactttctatgaatgtgaacaatgtgaggggactcaggggctttttgatgcctcagccattatccagaccccatcacatggccccatacaatgggaagggatctgggaagtgcagtcttccatgtcctgggaaggggtgacctggtattagtgagcatcagcagtgtccatcgcagtcaccgtctccc

SEQ ID NO: 114050 - DNA, 1002 bp, Homo sapiens
cactctgggcatgtacacagtcttgcaggggctagtagattccaagcatcaaactagagatgggagaaggacaatttagggccaagtggggaaattggcaagagtcccaggcccaggagcagccagatttcctgggcagttaccaaaattggagcttggaaacaaggcttaagaggtgaaactctgttatttagggttggaggcaggctggagttggggaattaggagctctttgactaaaattgagactttagggtggaactagcagccactgctactgggtgcaagaccccagagtgggctgaagtcaaaggcctcatgcctcagtatgggcttgatcctgagcattggaaattagcctcagcctactacatatggatcaggggtttcctgttggggtgggagaaggaaggatgtagcttcgtaggagatacatacaagaactcttttggagatagcatttacagggcttggaaagaagacaatgctggagggtgagcctagctggctggctttatctaaaatgtggaatacagaaatagtaataattgttgacgttaaacgtctgagcctatgagtacatagggcatctagggagagatgtcagtaattgattatatgagattgggatgtgggagatctctaccaagatctctacagccagaaataaagactggagccatccacacatcgggatcaggatggagtgagattgcgaagggagagggcgttgggagttcggcacatcgtttttgtgtatgcaccatgaaggagaagccactccaagggttgtatttatttccatttcattttattgccccatgatttttttcccagattcctccaatttctggttgattcttctttcctaatgtttttcagatataaccagtttctcccaaatagctgcattttcttttttcttttctttttctttctttctttttttttgagatggagtttcactcttgttgtccaggctgtagtgcagtggcaagatct

SEQ ID NO: 114051 - DNA, 2408 bp, Homo sapiens
ggtgtgttgttagatggaggaaactcagaaattggtctgaatttttaaacacaatgcttcataaaacctgactattctgttctggcgatgttagaacttgtctataatctgaaacagcagatttatttggaggggttatttgcatgtctcatgtgggatatcccattgtttcaaacctttactataccaggccttcatacttccacgatttctctgtaaatgtagaattatctgtaaattgctctctgatttcagattgttcttatgtgatgggttgtgtgttctttcctgaagcttgtggaaaggtcatcgtcaaacacatataagtgtcttgaataatgaattggttcatcactaccatagatcacttagcttggacttttctattattcttgagaaggtactttctcatgaacctccattaaatatcagtagaagaaggttttgcccagtgtttatttgacattataacttgggccaatggttagattctctgcagttgaaactcatagatagagactaaacataaaacatgcaagtttcacatcagatgtttttgtgtgtgtctgtgtgttttaatcagggcttatatttgctcagagatattagacctgaactcctaaactctagcccttgaaaaactagattcatggcagggggcaggggggatggtgagtttattattttttataaaaagtaaaagtgttttaaaatagcaagtagtgaataagagaggcccatttacctaaaatgtttacataaaaatagagttacatccatgtaaatgggactgttaggtaaattatttgacatctcatggagaaatagaaactttctcataaatgattttgatatagagcactgaaaatacaatttaatggaatcatttcaacttaaaaatgacaattaatgacagattggagaagtcagccaattatcgcttagtgcttttctatccaacacatatggaagattgcttataaacagggaatgttttttttaacatgcatatgaatttagtataatatttgtcaattcttagctagtttggcaacattaaaatcttagatctttgatacttagactagtgtcccgaatatgaaatgttccatggatagatttgttcattctttgcaacccctgaaatattaatgtttaagcaagaaactcttcaccccaatatttttctttggtaacctaagattcacagagtgatgtaatagagtatttggccaaattaaaatgagggaaggtgcaaataacagaattaattcccacagctgtcgaatacgaggttagcaagtaagtgaaatcacacgcattactttgggtgtttaattctgaaaactactcatccaagtgttcactttgaaatttaattgtgtgtatttgtgtctcttctcctgaagggtgctcttctgttagggcagcccatgccgttttttaaattaatggtgcagattcttttagttcataggctcgtcttgggggagtaatgcaggcatgtgtgaaaggggccgtgagcctttctggactcttgggtcctatctgataaatgattgcttcaatacactaaatgggccccagtgtcctagaaacgttcatatcatttccacatgttcacttccttttcctggaaagtgtaacttatgacaagggtaacttggaaatccaagctcattattggagaaaaacgaatggtcgtctatttggcatatgttttgaaaataacctcagtgtgggaaaatcttttgtgaagtttattatgaatctgtttatagtatacttttcaaaatgtgtatgtaagcatcttaaggcttaagaaaagaaagcgctaagtaggcatagttgatttctcctattgcaaaaatacaagtgagcaaggaagaagactatgcagcggaaggtatggttggaatgatgtgttgaggaatgttaatgattcgtctggaagcgtgcaaatgtggggcaagtgcaggcccttcacttccatcctggcttctttttgaagtgacatttggcattttagctgcctcacgatgctactctgataggaatcttctgcctatggtgcacattcggagaatgctctggccacagctgctctggtttgggtcaggagtagggcaagctttgctgaaggtggcagctgccctggcctgtctcctctgagttcgcttccagcctaggtctcattcctggcctggtggtagcatcttgctgcagggatggacctctcagaaacatcctaagtgcgcaccctggggtctcgaataggctggtcacagatttctaggacactgaggcccatttagtgtattgaagcaatcatttatcagataggacccaagagtccagaaaggctcacggcccctttcacacatgtcgacattactcccccaagacga

SEQ ID NO: 114052 - DNA, 1051 bp, Homo sapiens
tttcccttcagatccttacccagtcagccacccacccggcagctcttctgctgtcgttgcgctcagctctgcttccgactttccattcctgttgcctctgcccacggccggagcctccctgcctcattcgtgcactgtttcgtatttatagatggggtatttacttcctcagagatttaaaaaagttacccaagtggttcatgttcatggtggaaaataattagaaaatagagaaaaagagaaagaaggaaggaaggaaggaaggaaggaagggagggacgggaaaaccacacatttcaccattcagataatgtccctattgagctgtgatagttatccctctagactttttcccgtgtatctatcaaaatatcctcatctatccaaatgtgaaacatgtcttacaaatcatgattatgttatctatattgttttgtagtcgacttctttatacttagcttctatgattgcttttctggatctagaaatataatacttttttttcatggctgtataattattggaagcaatttgccccttcatctctacgtcatttcagtgtactgtacacaccgcccctaagtcattctcacacttgattggtcttgctgcccttctgctgaaaagcacaggcagcttcctatggccctctgccacccgccccacattcctcttctataggaaaggttttatgcctttctcagtcttcaggattctttctctcctctgaataagatctattatttggaccaagcttggtggctgtcataggctacaccttgggattaggaggggcagttcctgggatcccacggtgccttgctcatcgctgtgcccctgctctggcccattctctctctccctcttcccagtgttgtagggtgtcacatgctgccaggtcttgggactgaagaggtgaccaaagtgcctccgaactccagctcctaccgcagtagggcagatacagccatgaaaacagacaaatgcaacagggcaagatcacgacgctggggaggaagaaagggtgtccatcgggtgacattggagctgg

SEQ ID NO: 114053 - DNA, 1821 bp, Homo sapiens
agggacttctcactgggtccagcctcatcattatacagaaaaggaaacgggccctcaaaagtgaagcaatttgcctaaaatgacgtagctaattagtggcccagccaaaaccccaatccaggacttctggctttcagtgctgtgaccttcccactattccatgctgccagctggcttaaaacaaaacaaaacaaacaaaaaacaaaaaacaaaaaaaaaaaaaaaagaagaaaaagaagaaaaaattggagaattgagttgacacattgcttgaattcccctacctctttatagagtgtgaaaaatcctgatatgctttaaaagaaacacttaaaaatgtatcgggacttgtaaagaaaatcaggaatatttgtgatatgctaattagaaagtatctcattatgcgagagacaggaaacgtggcagagggagatgctattcagagtaacttaaggaaacttcaaaggtaagacaaaaggccgttctttttatttatttgataatgtttgtggctgtcatcaaagttctgatggggcctgacacctttatgaaaaaccccctgtatgaaaaacactgggggaatctctcagacacacggaaggaaaagcaaacgattccatttccatccgagtttccgtaggtggaagacagcctttcccacagtgctcgcctgccaagcatcttcctgtaggaacttgtcagtgccgccattagttgtttgcaaagggattacgctttggcagccatgctaatcgctccaaggtgaccctttatttggagaaacaaatccttttcagttgttgttacggtacactaatccaaccatgcaagtagctgtttgggaaaaaaattatcaaagtgcattttctccccactacttctttctctccagatcgctcctaactaaaagtgctgtttcttccaaagaagttcaaaatgacagggagaaaaacacagaacctggtcagatttcaaattcaggagcagacaggaccccctagatctcagaaggagctgccccccaccactgaggttcaacaaaacccccaggtgggagtggactgtcccgttaccttgggggggtcctcaccctgctgcagtggggcccctgtctttgtctggccattgctgctgtttgccgccatggtgaagtttgttgcactgtaatgttcatagatacccaggaagagggagaaccggggagctttcagcctctcagcctgcgagagcctctagggagagacaaggacacctcaaaataccagttctgacgtgagaagcgactttcaggcagggttttgtagatcgtgtggattttggagttggaacacactggcttgggattgcagttttgcatcttagctgtgtgaccgtgaacaagtcacctggtccctgggcgccgcagcttcttcatctgtaaaatgggttgtggtgattaccggtagggatgtttggaagacacaatgcgacaatatatgtaaagtgcctcgcagggcgtagggctcattgtgggtcctcaaaaatagtagcagttatcatttttcctatatttatgattatctaaacgctaatataccaacaactattttagtttaaattaggacccggaagagcccaaatattaatttacagctcagtggatgattcaaagtgcaaagccccacgtaaccaccatccaggtggtaactagaacattacaggatcacaggagcctcatccctccccgtccacacgatttccccttcccttcttaccgaatgtagccattttcctaaacttctaacactcaacagatacttcgtgagggtttcctagatccca

SEQ ID NO: 114054 - DNA, 1010 bp, Homo sapiens
agtagctgggattacaggcgcccaccaccatgcctggctaatttttgtatttttagtagagatggggtttctccatgttggccaggctggtctcgaactcctgacctcaagtgatccatgcacctctgcctcccaacgtgctgggattacagacaagagccactgcgcccggccaaatggactctttttatgtaaatatatatccttgtagataacaatccaaatccaagtaggattgatgctgaagtaagatcaaacccaaacctctcaacttggattttcctcaaccactcctctagcaatgtgtcccactaccacttcacttatccgtcccagcaaaactaattgttttataatcttcccaaaaaacttcaggtttctctacttttaaatctcttcttatgatactctctttctctcctccattcttacccagcaaatctaaaatgcttttctttcttctgctccggtatgaaagatcacagttctccaaatcccagttaccctgggaacaccttcctgaccatcacaatccacaaagaatctctcttagagctgttatcatctgtaccctgccttagcccgtattatgaatatttgctgcctatggtttatcacatatgtactgtctctgctacttgaggctcacacctgtatgtgcatttgtgtgcccatgtgtttaatccttgttaggctttgtacacagcacaaactccattgaatgaaaaaaatagtttatattttgttttgaaatctgattatttattctctctcttcttagatactcggttttaaagtgactggggtgggtgggattgctgttttacctgtcttttggttcatgagttaggcagagactatagaaaaggcatgaacaattactatagaaactgccacaaacatattaagcacatagagggtgtcagcatctatgaataaaaagcccgtattttctctaaatgagcttacggtctgtttggggagataagtattataatacaatttaataa

SEQ ID NO: 114055 - DNA, 1240 bp, Homo sapiens
tcacttttagtctattagtattaatcgtgctcccttgctgctccaggctctgtgctgggctcaagagacacaaaggttgagtagcttctcctgaaaggtacctcacagccccaagggggaagcagacaggaatgcaattcactacaagtgccaagagctagaatagagcaccggtatggctcaggggatgcagaagaaggaagaactgattgctggggacagtcagaattttccctctgcttttttattcctgtagtgtaaaatttgcataataaagaagcaagttaacatgttgtgtcaacctatgcctctcgaacattagagtgtgttctggatctggggcttgaccacttgctcagcaagtctgtaattgtcctgaaagcctttctgaagccatgactgaagcctctcggtggcatctgaggagaaatgttaggaaaacatttagatggcagttcagtggatcatagaaactactttgctaatacagtttagtgacatttttagaaaggaggccagaataccagagagccatggacaaccatttctttacattgtttctagggccagcactgtggctcacacctgtaaccgcagcactgtgggaggccgaggagggaggattgcttgagctcaggaggttgagcctgcagtgagctatgattgtgccattgcacttcagcctgggcaacagatggagactcagtttctttaaaaaagaaaaaaaaattgtttctctatgtatgagttggataatggaagttacctagatcttcctcaggtcatctgggcatgctggtgaggtggcagaacctgccccaaagacgaatgtcccgacttgagtgaaggttgctcaggtggacttgaaaagtctggggaaaccaggaacagctgattaagcccgaggaggcataatatagcagcactgtgaccctgacggctggaaaaatttagatgctcagtttttctcctgagtgcaacaattctcatgtcttactcgaattcaagacttcatggaatgcagcaagctgtgtatagctcctcgtagcaaaacctcaaatgggtggaaataagatgtccggcttaactgaatgttctagtttattaaaagtaaacccttctgttaagagtaagcccttttattaaaaaagaaaaagggtaagtcactccccacttttcttttgataaaaatatgtctttaatacaatacagtgagtatatccttgaacctttttggttt

SEQ ID NO: 114056 - DNA, 1100 bp, Homo sapiens
ttgatccccatgagttctccaagaggtgcagatctcttgatgacccaagctctgcgtcttgcagacacctgaaccctgtgtctggcccacacagttctctgacagagactgtctacaatttgaacttcaaggggcgactcccaggcggtctgatgcattacccctgacttggccaggtcccaagctcttggcagcctcccagactgcaaaggctgtgcgtaatggctttccagagagtgtgcagcaggcccgggaggcctgggctcctttcctttgggggagatgccagctttggctcagcctcctggttggctctgaccaggaggtcagataagtggatgacgtaagtggatgacggataggcttcttggtattccttgtttatggtattaataaccagacatggaactgcaccagaaaggaggtttttaaaagtgaaagtagttagtcatgttgagccgggatggcaaggagaggttgccagcgccagtggtttgaaaggtgctgaggccccacctgtatggaggcagccgctcagggtgcctgctgagctgtcagtagttctcattgtcccgtaggggacccagcacctcccctcctctctgctgcccagccctgtggcctgagccaagtcgttcacggctgcgcctcccactttcttgtctgcagagcgagtggggttgccaggaaggtcatgtaaaccagtgaagtgggccaagcgggcattctattctgacgtttcttgaaacgtgcacaaagccctgtgagttccattgtgagtgcgaatggagaagcgttttctagactgagaacggttgacagtagttcctgcatcctggaacatggccgtgccgttcagtctttgtgttggggagggtcttggagaatgtgtggcccctctatagggccaccactcggcttcaggaaaaaaggcccatactatgagactgtgttttttgggtttttttaatgctataaatctgtaaaacttacccaatttcaaaaaatatgatgaggaccaaaactaaaaaaattatatgtgggcagaatttgctgagtcttccatctttgggataaaaacaatctcttttagctctaag

SEQ ID NO: 114057 - DNA, 1030 bp, Homo sapiens
aacgacctcttcaatttagtatttaacatttcaaaggactttgaaggactctgccttctcaaaagttgtcaaagattttagctattgtcatcattagacttcaaagcagaaactgcaggctattttaatgccaatgcttttaatcctaacctttgtattgagattaggagcacaaaggatggcccgtaaggggtgagctgagtttttctattttgttttctttttcttttccctaaagatttacagtgaaagctctgctctctagaattgttctttactcatggatagtttttttttttttttaggtctaaactattttgaaatctgcacaatggtgtctgttattaaaaaagaacagccacagtaatgaaaggacttggcacttacagatcaatttcatgtgcccacagcctgtttctgtaaaagatcaagagccataaatctctcccaaattatctgtgtttgttattattttagtgtttgaagattagacgtgtgtatggggtgaaggagttggtgagaattatgtgtagagaccccaggcagcctcaggccagcctcgcgaaggcatgtccccgggctcactgccaccctctctctcaccatctcatccttcttcacctccatgagccctacacacatcccttgtacgcctttctgctctcggcccatacatcaagcatggacatatttgtgcagtgtcctcacggagcaaaaacagaagcacacggtggctctatgctggcctcactctggaggaaaccacagagctccggcaatgaatagtttctcgggtgtttgtgcatcgcacgagttcacaatgcggctgggcgctgggatacagtgagtgactttctcttctcatgggccctaacatcaggtaggcttgtgtagccgtaagttaagtgagccgcatctccatgatctcttctgtccctggcaatgtcagatgcctcgcgttggtgtggcacctttcaccatttctccacggacaactccatctattaatttcttggagaaatctggagcc

SEQ ID NO: 114058 - DNA, 1044 bp, Homo sapiens
ctttactagagatgcaaattgaaaaatcaaaatttccttaaggttttacattcaatttattctatttgtaaattttgtatttttaagtaaaaaataaaaaccataactcttggggtctttgaaaatcatttgatcaacttgaatggaagactaaatcccttttacttaacaattagccctacttagaaacatctttaaatacattcccttaaacatttaaagtgcatctataaatttcatttatttaatttttaaaatttattactatttttattgaggtaaaatacacataacgtaaaatttaccatcttaatcatttttaagtgtatatagtccagttaagttaaatacatatataacattatgcatccattacgaccatctatctccgtaattcttttccttttgtaaaatggaaactctctaccaattaaacaacaactcaaacaacaacccctcctttcacctttcctccagcccctggccaccaccattctcctttgtgtcattatgattttgactattctaagtactttgtataagtggaattatgcattatttttctttctgtgactgacttctttcacttagcattctgttttcaaggttcatccctgttgtagcattggacaagatttcctctctttagaatgctgaatagattccattatatgtatatattgcattttgcttatccactcatccctcaatgggtacttgggttgcgcccatgttttaactattgtgaataatgttgctatgaacatgggggtggtccagatatctcttcgagtccctgctttcacttcttttcgggtatatctagaagtggaattgctggatcatatggtaactctatttttaagtttttgaggagttgccatactgttttccacagtagctgtaccattttgcttgcctaccaacagtgcacaaaggttccagtttctccacataattgccaatgtttgttattttctggtttttgggtattttttttttttttttgatagtagccgtcctaatgggtgtgagttggtatct

SEQ ID NO: 114059 - DNA, 1039 bp, Homo sapiens
ggagttctctgcatactctggatatcaatcccttatcagatatatgctttataaatattttctcccattctgtggattgtcttttctctgttgacagtgtcttctgatgcacacattttaaaaatttcatgaagtcagtttttctgttttttcttttgtggcttgtgtctttgatgtcatatacttggtacacttgatttttaaaaagtagttaatatatctgacgaggaaggcttcaacccaaattttccccagtactctattgggcctttagtagtcatcaaatatgtgccaaccattgctagccattggggatatagctctgaacaaaacagaacaatgagcaacaatgaataagacagaaaatatccctcatccttatggagtttacattcttctaactctaaattcattcaactgtagcaaagctgataaactaaagttttaaatgaagaggatttcaagtcaaaatttgtatacctttcaatttaagattacaagtctaaaatcaattatacatttgaattagagtcacaaagcaaatctgtgtaattagtgtctctaatctgtctgatatgaaaataccaaatatacacattttaaaagcccgattaaataatactaatgctataaaatcgatttgctttatcattcatttaattctaactttcctaatattgaatactggcttacaaaaccgagcttgcttgatggacaactcatgacccaggtacatgattgtctgaggtaggtttagagatctgaaactgggcccagggacataggggttgtatatgaccagagtgactctttccatcataacacagatggacagactgagtctgattttaatagtggctatagtaacagggaactccatttttcttcagattggactggtttcacaatacgctgtttgctagatttaagccttcccttcatagcactattcagcattgtccccagtttggatggataaattactacaccacccatacctactttgccatctgatccgattcagctaactcagcctatg

SEQ ID NO: 114060 - DNA, 1040 bp, Homo sapiens
aaatatgtaaatatccaagcgctggctccaggctggggcagctgccaaggtccccgcgccgccgccgggtgttttacatgaaaatgagaagcctgatgggaaccgcgttctaacttaaggcagcctggtgattagcatgagactgggcggctgtcctgcttcctgcccttcaatagccgttccgcgcgctcgcgccggagcagcgctgccgccgcgcgggggtcgatcgcaggctcggcgtccttggcagccatggctccggcgccgcctcggccagtaagtaggagcatgcatgtgtagggggcacatgcgtgtcggcgcacccacccagccatccacccgcgcgcacgcacagcgcccggagcctcggcaaggggaagattgacgaggcgctgcagtcgcggggacgacgcgggctcttcctggattccgcaggagcccgcccgccgcagctgctgtctgcagagcctgctcggatcctgtgcacacgcgccccccgctcgagcctctgtgatgaagactgtctcccggggactgcagcggaggcagagccagccagcgccggggactgcgggccgtgcggctgataggcccgcggggacacgactcggacactgtcatccccacgcctcgcgctgagctgcccggcgcggagggtctgccgccgcccctccggcctcccgcacgcccgatcccgggtcagccccggaggcctcggctgcctcatttgtttgggtcttttgtgccgtggctcccagttggccaagcactcctgcgctgaatcgggccattgtctgcgctcccattgccttcacgctgcaagtctcggcgcccccaccccgcccgccccctccccgcctcctcccggccggggagcctcctaacgtgcctttccccccaggaatctggaagctataagccgggcggattgcaaatgaagtgtaatgcattgtgggacgtgtgtaaaatcggagccttcgccgtgggggtgtgggggggcgtggggagggccggacccgccgctggcggtgtagacgccg

SEQ ID NO: 114061 - DNA, 2055 bp, Homo sapiens
tcggtacgccgcggcccgggtgcttggaggagaggacgggcagtgatggatgcgataagttatggggaaagcaggaaaaaattagctcccatccaccattttgtacctcccaagatccacagcaggccctctcaatatggggttggagagctattagttaggtaaaacgagggaggggggacgagccgggcgttttggctgcagggagataaatgactgcaagccccggcgctgcagcctcctcgagctttgtggaggatcctgcgcccagggttgcctgcagtgccaggcttgctggctgctgcattgtggccggttatctgagtgggtatttccagcagccccctgttctccaaaaggaacaggttccatgcgcagctctggatgggctgagtcaggggagagtcctgcagacatcccaggctggtctgatttgcacgcagagaactgtgttggagcttactgaacgcgttctgtgggggtaatggtgtggatgcggattgaatgctcacatgattctgtgtggatttaacatatgttgctttgaattaggctgtatggaaagaatggaggctgtatcatgtgtttgcatgtcagacaggagggacaaacaaaacggtaaatggaaagggaaggcttcaaaaaagatttccgcttaaaatgcagtgctgtgaaaagccttcctgaaggagccagttctttttttggaaatacaacggaatggctttggtttgatttgggaacccagggatgaaattcttgagggaaatgctgaaggaggaaaagcctggaaaccttccgttgccttctccttacttctccttaaccacttggatgtaatgatgtgtaaggcatcggttcttatttatttttcattcagagaaaaatttagattttcttctaagcacactgtaatggaagaaccgagattttattttaaaccacatactgtaccaaatcactctgagccctgtcttaactgggaagatcattttaagcttgtggttggtacttacagtctagctttactctttttctcctaaaacagcaagtcctttttaactggggtcagcatctcatgcttcaaaaatgccttgcgaccgcatttccacgaacataaagccgaaataaaagaaccatcttttttattgcaaagtcaggcgacataaggatgttgtactattttggcaataaggctcccttgattttccctttcatgaaaagccaaattcgtaaagaaagtgacaactacagtttatacttcagtcatttaagtcgctgctgtggttgctacactcttcagacttgtggcagtaaattttgaaacacacctaaatgcaaacctaacctcaaaacacatatgtacataaacccattgctgcactaagtgttcagataatcctgggtttcatgtacttagggtttgaatgtcttcattccacacttcacagttcccctttcttatgcctcctaaggaaccggtcctgacaccaactgtgaagctataggagggttggtggccatcatttcatcgacaaacctgcaacactctgtttcatgattcaggcacatttccaggcagccagttttttttttttttttttttaatctatcttggcattacctcattatcacatttgcattctttgcaaaagaacttgtctgctattgcaggtgctgcgaggcgtttttgagggcttgaggaagaagcttttaattgtacttgattcccttattttatttcttgatctacaaatggtaagatggtcctatggtgataatgaaggataacctgtttcaggttggcggttttctgttcagattcaatgttaggttactgctgagaaacctgaagaccaaaagatggaagaaaagtgctgtcattcattcagcatttttatggcgtgcccccaaagagcgaagtgccttgctggattctcatggggttatagggttggatataatacggttcttgcccagggagggaggcttatcatttattctttattttaactgttagctaatacatggaataagaagcaggtgttgctgcta

SEQ ID NO: 114062 - DNA, 1479 bp, Homo sapiens
tagagaatgctgaaactttaagtctcgaagactatgccttatgtgactgtttaagctcccaactcatgctaccaaatctgaagaaatcctaagaattcatgagcttcctagcaaccagtaagttcacaggccatgagatgacttcattgttcatcttgaatattaatttcccagtggtggtttctgggcagaaaggggaagatcttgccttttgttcaaatcaagatgaataataaaaagtgcatggcgttatcttaagaagaaaagggattggaccaaatggatgtgggatcattcttgggcattttctaaaagtagaagttacgatattaatgaactagagataaaagcaaaactccccacaaaggagcaaatctgtataatgaacgcttagtactttatgtatgaaaacatgctcatttgtctctgtgaaatgattttcaaggccccaaaccttttgttgatgaagttgtgagagctttctctgttagaattatgtgaactgtaagctcttcacacgaatgatgctgctaacttttaatttccttccctctcccctcccccagccctggggatgggcgcctctttatattccatgtataatgccagcaaagttttgggggacatccttattgatcaagcatggaaagtaattttttcattatacaggttctacagcacatgatccttaaaagctttgtttctgcatgagaaagcgaagtcctggcccatttgagtttgatgcttatcattttgataacatctttaaggagtaaagcgtgcgtttttaatactacggttttaaagcctttgaaaagaaagataaaacaaaagccctaaactgacattgcaagaaatttgaaagcagttttgtctgctggggaagaatggccagctcatcaccttgattagtttattagttttcattttatagaaactaattctggggcacgtttgactgtgtgttccagttccttatgttctgttattttaagagacatgagggttttctgggagtgaaggatggacactggaggttccaatctgggcctgccacaaaccagctgtgtccctggcgagtaatatgacctccctccatctgtaatgagtcccccacttccatgctgccattacagaattgggctgtgcagtggctctgtcttgagcaagtgcaagacttctgaacacttacacataaattgttagacaaaacttctctgccctcttctactttttggagtcaggtgcctcctgtttgtgggaatagtgctcattttgcgatacaatcctattccctatcatcctgaaatgttacattaaaggtatgcgttttaggactcgccctgatgaccagagtaatgaggggggaagaaataaatgaagacctggcaagttataatcatatgcaagttttaataaagagcgtcctgtcacgtccctttccctctttgccgagatccattttcagcctagccgctc

SEQ ID NO: 114063 - DNA, 1703 bp, Homo sapiens
gaagtaggaaaaggctagtcttctttaacatcagaaggcgtgtgcaaccagtcagtcagaagattctatttgttcctcccacttaaatatttctaaaacctgtctcttcctcttcatctctgttgctgaacccttcttctgttctattacactatctaccaaacagacctctcttctggttccatctatcctccttatgtccccagagggctttgatggttttgttttggttttgttattttaaaatctctcctaaagcaaaatcacttgtgttgcttcccttcccagtgttcccatccatcacgcctgtggatgaaatcatagaccagggcacatcacagtataacctccctcacttttccacctcttcttctctttcccccactgttcacctcaccctgtgctctgggctctgggagctctttacctgcatcagcgcctgtcaccttgtgtacctgttgtagtttatgtgactttgcccagaatgcgttctccatccttacaggtctgatagaatcctctttagccttccagaaccagctcctatgcccccttctcttgcatcgtctctcagatcctttccagagtgattcgctcccacgacgtttgttttgtacttgtgttacagcaacacggtcacattgtgccacatcacgagtttacaacccatgtgtgtctccggtctggatggtgaaatcctcactgatagtacctgccttattcacatctctattttgccagcaaccacagagcttggcatgtatccggcacacagtaaatgtgtatgggatgagtgactaaaacatgacttcttagaaagttgaatgaggtctcgaagtcctaatgtgagtcacctttttgtaactgcagaaattataagtatgtatgctaagatcctacttttgaaaagatctcccattgtgattggtagacaggaccaacaagctatgagtggatgattagaaagtactaaataataggatacaatcaagagtcaagttggggtggttgatgtggttgctgcaagtgaaactggagttccgagaacagaaggacgttgcttagaaaaggctgcctggagggaggacttacttgggtcttgaagaagtgggtcgatttgaagagatggagaaggagaaggatttggggaaggttgaggaagcggtacaaaccaaggcatgaagctggaaatgaaaatgggtgtgtgaaatttgtcttactgtaactctgggatgtaaccagaaataatgtgtgggatcttgaaatttgggcggattcagagtttatggggtaggtaacacatttgtgatttggggagagaaatggtggaagcagcctttttaaagaggtgtcagatcgtggcttgcaggatagatgcatgttgtgaacgtctagaggctgggagaccagaggggaggtgtgtgggggttgatgtggtgatcaagcagtaagacgacggccatagaacagtgtgtcctgggccaggcgtggtggttcgcgcctataatcccagcactttgggagggcgaggcgggcagattacagagccaagagttcgagaccagcctggacaacatggtgaaaccccgtctctactaagaatacaaaaattagctgggcatggtggcgcgtgcctgtaatcccagctactcgggaggctgaggcaggagaatctcttgaaccctggaggtggaggttgcagt

SEQ ID NO: 114064 - DNA, 1008 bp, Homo sapiens
ggatgggacaaggtggaaagggttatgaagaggaaagggagaatctgggagaacaaaggaactggccgttctttgtaagtggttgggtttaagaggtggaagaaaataaaggtgaacatggcgaaaccccgtctctacaaaagatacaaaaattagccacacttgatggcatgtgcctgtagtcccagctactcgggaggctgagcggaaggatcacctgagcctggggaggttgaggcctcagcgagccgagattgtgccactgcactccagcctggttgacagaaggagaccttgtctcaaaaataaaaataaaaataaaaattaaaaagctgcaactgattttgttgttgttggaagaatgcagtaaatgaccaggaacctgcagaaagtgagcagagaatgagttccattttgggctaatggtttggtattccaactacagagggctttcaggtgaacaataaaggcgtataagttgcaggtcatttgtgcggcagtgttcgttgtgaacacgagaatagcttggctttctgtgctttctgttccccttcttggaggggagcaggtgactgatttttatttccagcagaaggaggttcagttggattccatgaactcagagccctccttgggtttctgaaacctggaaactcgaggttaggattgcttggagattgtccgctttcctgttcctgaaagtaaagtgccctttaattcttggatttgttttattagtgttctcatctattcagaagccattgcattgttgatagaagggatatgtttttgatgtctatagtcaggtctgaaaacagagctctgcaagtagccgcacaaaagactaggccagctatgtaaataatgtatatttcaaacatctgtcatatacctatcccgttgaaaaattacggcttaggtaactcatacacacagtcaaagtctccatttatctttctactttaatccgtgatggcccctccaggccaagttttctttttctgaaga

SEQ ID NO: 114065 - DNA, 1572 bp, Homo sapiens
agaaatcacttattttctcaggacctcggcttccttacctgcaacatgggaataataatggtacctaccccttgggctttgggtgaattaatatgtgtaaagctcttagaaccaagcttggtacaatggaagcattatatccctatgactgattttgtcattaaaagtaatggccaaaactgcaatgacttttgcaccaacgtaatattaaaagagccagcatgggtataaaactgtagaatcccatcagacacatatatagaatcacaacaggatctcgatcgttgtcacttcaaagtattgatataaagagtgacttgcacagaagctacacaaaaaagtacagttgagttttactttgcaaccgtgtcgtcttcctacggtgacctttccagaacgcttttgttttcccctttccaataacaccctcttccctctacttcctatctgcttcctcctagagtttagaacttagttccttgaggaaacctgatggagtgtgaccgagccgctccttctctgtgctccggcagcacttcttgcgcacctctgaaataaccgacacatctgccattttcttgtctgaccctctgtctagactggaagctctttcaggccgtggctcgggtctgacgtggctttgtactcccagtgtctagcgagtgccagatgtgtagcaggtacacagcagtttaaatgtatagatacggggacacatggtcttgctggcattcccagtggcttcagtggactctgtatttcacatctttctctaaccatatgcgtggttgatgccccaggggttgatggaaggaagccaccagggtgattgtggtggatcggtaatcgtgacccactcacaggggcccgaaggagcaaactgaaggaaactggggtagtttagctgtaaccaccgggttgtagagatgtgaactttggttttaggatttttaagaattccggcatggatctttggtgaaattataaaacagtgtcttctgaattcaccaaacgtctaagataaaacttccatttagattagatgctagagcttgtgattggaatgtgcgttctgttaacctagtgaactcatttggattttcatttccattggttttcaaataactgaaagaagtatttggacatattttccccacacttgcaaactggctgtttataatgtagacaaggggcagatgtggataactttttaacagtgcttttaaaaagactgcttagccagagagtgaacacgtcccagagagcagaacagtgaagatggccatagtgtcaagtggatttttccttatttgtgagagtggcttctgtctatgttcatcaaatgcctttatgtggtaaggcagcgctgtgatttagggctgtgaaatcagacattcatacattggtgctggcacccacttgctggctgtgaaatcctaacaatctatgttatcagtctatcctctgttttcttatatttaagatgaggataaaatagtatctaatttatagttgttaaacgtggattaaatgagcaaatgcaatcaaaataattagcatagtgcctgacac

SEQ ID NO: 114066 - DNA, 1030 bp, Homo sapiens
tacctgtgtaagtgtcaccttgtttagtcctcacagcaatcctgcaagggtgccactgattaatattttagcaacacaaatgtaaaaaaatttcagaaaactgagatttcacatactcatcggtatacttttaatcatgttcagtgttagtaaaataacttcttatttttatttatttttatttttattttgagacagggtcttgctctgtcacccaggctggagcacagtggcaccatctcggctcactgcaacctccgcctcctgggttcaagcaattctcctgcctccgcctcctgagtagctgggatggcctgccaccacggccagctaatttttgtatttttagtagagatgatttcaccatattggccaggctgatcttgaactcctgacctcaagtgatctgcccgccttggcctcccgaagtgctgggattacaggtgtgagtcaccagacccagccttcttatttttaagtaaagtattgaatactgtttcattcccccagtggttcatcttgcacttcctctaagtggaccccactgtagaagcctgtgctgtaatgagagagcagattttagggctccttgcatattctaacaagtctaaccctaaatatttgggtatgttatttaaaaataatctcttcttagccagctgaggttcttctgagaattatcttgccttacccaaagaacaataaagcctcctaagatctggtaaggggcaggctgggggatttgctgagtgtttccctgctgctatttcttcctcttcctctttttagcaccttagagtgggtttcaaatgccattgtaatgccgttgtgagctccttagtcgtcttaattggcttagtgttatcatgagctgccaatcatgtagtgaacatccctgattcctggagaagatgagatagctgggaccaaacaactcctaggtcttaacgcatttagtgcaaaggtacctgacaacaaaatttgaaacatcaaatgaaaagaagtctcaaacataaacataatttcgttc

SEQ ID NO: 114067 - DNA, 1518 bp, Homo sapiens
atgtgtgttcttagtcatgtatgttatgaagtacactcatagctccatgctgtggatgatctgtcttctctgagaagttagaagaaaactggagtgatctctgtgttgtctgctgcacagagaaacatgatcagctggagtctttcttagaaggccgctgtcacttgattaataaccaacacggaaggcagaggcagagcagaccaacaaacgtgctcctggtttcttgtgcttgtatttgaatactgttttcttatttttttccaagcgagggaaatatttaaacacaggcaaagtacacttgtgattctttaagttttatccctgtttgcagtgtgtgctatgaggtagtgctgtgggatgtaaccatatgggcccttcccaagttgcttaaaatgtagtgaagagcttagaatatctttaggggtgagctgcagaaagtgaggtgtcagatgagtccttacctggggctgtgaggggtgtggcatggagttgtcaggctgcattcggcagggtcagcattgagttgactctgtccttgtgttctagatataccctccggaaggtaggaacactctgtagactgtggttcctagacaccatctgtggaccagcattgagttggttccttctgcagaatcatctggggaacttaagcagatacacatgttagcctcattccaaagtatttgtagcttgggatggggtccagaactttatattttcaaagctctcgaggtgattctgatgtacagttaggtttggtagccactgatttggaattgcctgtccaggacagcagcctctcagctccttccttcaaatcctcactgcttcctcacaccttcagcaaaccagcgttgcctgttcgtgtcagggccttgacacgtatgcttgtcttattaaagagtcaggatccattcttgccttgaaggcccccacagttggctggagatatacaggaaaccactgcgggacagtgggatgagggtgatgatgggggctgagtaaggggggctggacccccacagagactaggacatgggaaaggacttctgaggaggcacaggagccccgtgtctgcccttggaggggcaggcagcccagcaggaaaggacaagagaggctggagacaggaggagtcccccaggcagtgccctctctctggaggccagcagatgagagagacaaggcaagagagaggaggggctgggacccaggaggaccttatgtttcgagctgaggagctgtcgggttattctgagcttaatgagtcccagacagacttgaggtaggggagtgacatgttgggatttgcatgagagggagatcgccctggctcagggtggaaaatggattgtagggcctagaggaagaaactgataggccggcagtggatagagataggctcgcaagggtgacagggccagaatgttgaggaattccatgcctggcggtgcctgtctctaccttgaagcaggaagttggctgcaagagttggaagaggtcatgggcaag

SEQ ID NO: 114068 - DNA, 1049 bp, Homo sapiens
gtggaagatgtgggtgtttctgcagctttagaactaaagaaatgtcctacatgacagctcctcctcatctgaacaatatttatagcctcttgcagaatacgacttcaaaaataactagtatttataaggcacttattctgcagagcttgcctctatttttccatttttccttagaatccatacggagttgtcgagaggcagattcacatgctaaatgaccatgaaaaatatataaatatgacattgctttctgaatggtttattagttaatgttcgtattagccagtgtttacatttttaatgtgcatcaatagaaaaatttctctttaagctcctggataatttccgaagcagattatctggctcacgtacaacatttattggagtttgtggacagacacaaataccgtgcctttccccagtatattttaagtgataccgatttactttaatactgcagatttagccaaagacgtaattgggaatggcttttcctaagcctgtctagttcttattgaaattaaagcatttgcataaaaagctatacagtaaaccccagaagttgttgttgttgttgttgttgttgttgagacagtttcactcttgtcgccctggctagagtgcaatggcatgatctcggctcactgcaacctccacctcctgggttcaagggattctccagcctcagcctcctgagtagctgggattacaggcgcccgccaccatgccaggctaacttttgtatttttagtagagacggggtttcgccatgttggccgggctggcctcgaactcctgacctcaggtgatccacccgcctcatcctcccaaagtgctaggattacaggtgtgagccactgcacctggctgaaactcagaagtattaagacattgtaaattatgcccaacttgagtattgctaacaattacatttatgaggtaattagaattgtagtatctcctgttttaaagagcatttattatttatactcagcttcatcctgcctccctgcaaaagtatttaagatgtgttagggagacacatagct

SEQ ID NO: 114069 - DNA, 1012 bp, Homo sapiens
taaaatatgggctaactactgtttcagcttgagaaaacaaatggcagacaggaactgcaaatctggtatagggtcctaggagaatggaggcaggccatatttataaagattttctatatcatgtgctttaaaaaaaaacttttttaatggtttgaaaccaattcttacggctctgaaataagaagtctttattactgtcttgtcagatgttttcattttgtaaagtaaatggcttttgattttgtattgctacataatcatttcttatcagttcatctaattgctggggctttgaattccaactctggcagtggtgagtttcaacttttctggaagactgtttgaatctgggatacagtcagctttcagaatggcaatagaaaagaaaccttgagattcctaactttaaaagatttattaattcagataaaagtttaggctggaagagaacactgacataattaaatatatttagtcatttaattctcattaattttggggataggatattatgggacagtgaccgtgtgtttgcaacttggcaatccaggaatactctcttctggtagctagttgcccagtgaataaacttaactaaagcagagaattatttgttaaaaatctaaaatactttattttaacagaaaacacctttttcatgtagaggcaaggactatgaatttgcatagtttttctagaataaatcatacctattatgtatccagatgtatgatttccagtttcattttccacagagaaacaaaaatgagttaattcttgaagctgagtgataggtatgtggaggttttaggatactgttctgctaactgttgaatgtatttggaactttccattttaaaatgttttttaaataaaatatagagaaataaagtgatcaagaatttcaaacgtacgagaagaaatagaagtgcagaatcattcttgagttttatgatttaaaaaagaaatctcaggccaaggcaggcaaatcacgaggtcaggagttcgagac

SEQ ID NO: 114070 - DNA, 1028 bp, Homo sapiens
actgtgtaagttgtgtggtgttctggacacaggaaggggaacatcacacagtgttgtggggtgggggtggggggagggatagcattaggagatatacctaatgtaaatgatgagttaatgggtgcagcacaccaacatggcacatgtatacatatgtaacaaacctgcatgttgtacacatgtaccctaaaacttaaagtataataataataataataataataataataataataaaagaaaaaacactgggaggcacgtggtggctttttgtctcattgatgatactaagtttgatcatttggttatggtggtggcagcctgatttctccattgtctttttctttttgtaattaaaaataatctgttgatattttgaggctgtatgaatagcttgttttccaacagcctttgaccctgtggttttatcatgcatcagtaattcttgctttaatcacttgttgcaatggtggttacaaatgtgatattcgaattcgatagtttcttctaaagttatgaattgatgttcatttgttgaacgaaaataagcactgtcctttctaagcactctataattttttgtttgtttttgtgccataatggactcatggatttctttttattcagtgggttatagtcttttgcaggcatggtattctatgctgaactggttcccgatttgaccacagaaatcctttcaatcttgtccccgtgtcttttgaggtgtcctcatcagtttttgagccttttctgacactaaatgatgttccatgttcacctatgtttttcctgccttggacctatttgtgatgatcaattatttctctaaggcaccgtggtttccttcagggcggatggtagaatggtatttagaacccaatatcgtgaataaggcaccctggtttctttcaggggggatgataaaatggtatttagaacccaagagagtgaataaggcaccctggtttctttcaggggggatggtagaatggtatttagaacccactatcgtgaatgaggcaccctgg

SEQ ID NO: 114071 - DNA, 1027 bp, Homo sapiens
ttttggtgagagttggggagacactgtttgcagtctgccatgtttaactgaaaagcccatcttagatcttccgtctgttggttacttgaagtaagaagacagagaataagcagtatttacctttaacaccccaagtagctctgctcatgatgtctgcctcggtgtcccgggcccgcactcctccagtatccctcactggcaattagaactctgtacggcttccttgaagtttctcttcctaactctctcagtgggtgggactccttttcagtgatattgacggtagacctgaaaattcagggatgtgggcagttctggagagaataggccaggctctctgtggatacatttgcactgtgcttgaggactgaatgctacaaatcagacagtcctggattatttcagactgaaaaaaattaggagactaacctgggaagaggcagaaggcacgccagctctctcagcatgtttttgatgtctcggtgttctcatttcattgaaattagtgcagacctctcccctcagctgtaacacttggattttctaagccactttgatgtctcctatctctgcttatttacaatgaacatagcttcgaattttcattttctttctactctgttaaatgtgttatgtggaaatctgaaatctgaagacaaatttttaccttagaattctaagaatgcctttggtatcaacgccagttaggaaggtctaactcagggcggaagggggggttttcaaaaaggtgatattcgtgaggcagccatcgccttcgaaacactttgagaggtttaatttatttctcatgctttggtaaacaaaagctggcattttctttccatggtttttccactgcaaggctgccgttcctccccttcccccgcagtggtgcattttggtgatcaaatctaaaacatgtgtcaggtttgcgggcatgctttttaccaggaacctcctttaatacttgccatattggcagttttcacaagatcttctcgctgtgctttatttatttatttattta

SEQ ID NO: 114072 - DNA, 1028 bp, Homo sapiens
tgcgttaattaccgactgtaacatgttaggaagttttacagctgcctttattcaatcttttatatgtgcatgtgtatattatagataacttaacacgtgtgtatgctgcatagagaatctcaagcgtattctaaaaaaagagataaccctccatattagtcattctgctcagagtcaacatttcatttgattgctggcatcagtgacaatatctattggtggataaatgatacattaaagtgcatttacattgggtaagcaaacttgttcatttctagaggatattttggcattgattactttttaaagccttttatctataatgagtcgtaagggccataaagggggatgtaaagagtgtcggatttgcttggtcaggaggtttagttcatttttagattccttgaaattggctggtttatatcctaatattgatattatagtctttcattaattgaccataatatctgattgctccaaaactatctgctgaataatgctctgacagtttcaacttaaagctgtaaagggaagctgtgtttacagacgcaaagatctggaaatgtttatggtggtttgtgaaacaaatacatcaaggtgctgatgtgacagagacacatgagctacacccctcagccctacccctggttctctgtgacacagcgacttggatgctctccagggttttgtcggttggttagagaatgttttatcacattcataaatagtaacccaatgccctggaaaggttaaggcagtgtctccaactaaggtatgtgtcgctaggggggacacataccatagttgagttgggctatctggttcatcgtgtcacaaatgggaagcatgtgagcaagcttttggacagagctcaccgagctgtcatattgccaccccaatgtatttacccctcaaacagttcataaaaatttataagcctttaaaagcataaacaaagaataaaaacacatcgaacgacaagtgatggttgctgctgctgctgctgctgctgctgctgcatagaacgg

SEQ ID NO: 114073 - DNA, 1037 bp, Homo sapiens
ttacaaacgctttgagagctgaaatatgaactagatcatacaggtcccaggctgaccactgcatggtatacatgtaagacagatccaaatagcactgcaaaagctttctgcactgaagtgacattcagctgacaggaggtggtttggaaatcgcagcctgaacttaacaatgttgatcacgtgcttaaaaaaaaattcaacattgtccttaggatttaaagactcggactctcatgatataataatcaacattactaaaaattagccagcatatgaagaattaggataatctcaatttgtatgtgaaagaacaagtaacagttgcaaatactgaggtgtcacagatgttggaattatcaaagatttaaatcagttattctaatcatggccccagaagtgtgggaatagattatgtaatgcagaagtgagtggtaattttagaactgaaatatataataatcaaaaataaaaattcatgggtgggctcaacaacagaataaagataatagaaagagaagagacagtggacttgaagatagagcaatagaaatttttcaatctcaacaacagagaaaaagattgaaaaaaaaataagtaaacagagcttcaaggatgtgtgagaccataccaaaaatgtccaacatttgtgtaatcaaagttcctaaaagagtgtgatttgaagaaataatggttggcaactaaatttggtcaaagacgtaagcttttaaatttaagaagctgaacaaacctaaacaggctaaaatcaaagaaatgcatgccctgacacatcataaactgttgaaaactaaagagagaaaaatattgaaagcaaatagggaaaaatgctacataacatataatagagcaagttgaattactgcagatttaattggtatgtttagacataccaatgatacataacatataatagaacaagttgaatgactgaagattttctgttagaaaccacaaaggccaaagtaaagtggaacactatttttaaaataaccagggaacatattatttatatacgaagg

SEQ ID NO: 114074 - DNA, 1591 bp, Homo sapiens
ctgccttgtatttttgcactttttatatgtgagtatcttacctcctcaagtacatttgaagcttcttgagggcagacaccatgtcatttgtccatgagagagtgtgcaccaaggtttgtatactccatatgtacacaaccttaaagattaaaatttaaattcctgaactgaccataggactttgcagttaggcacctgataaatatttttaattgatttaatggtatttattgctgtctgctttttcaagtggagcagctctaagagcatgcgagaccattagccatcaagcgtttattaagatcctccccgtgtccctatgtgacgctgctatttaatctgctgccaaggacgcaggcgagtgccaagcacagcctctgcccacacttcatcaactgagcaaatcacctctgcggtcctctgtgtgatgttcgtaaagctttactgtaacaccgaagctgttatccaaagatgtaagaggcacggggccaggaggaggactgctaatgatggctgcatgtgattcttgagctcatcttgccatcagacgccgagatttaaagcatcagcagaccgttcttgtctttgtttctcagtggaggccaatggtgtccattatgaaacccaccgtactctcggtagggcagcaagatgagcttgtggtggttttgcctgaccgtgtatattcttttccatggtccttcaataaaagtctactcaggggcagtcgttaggggtcatagaccccagcagaagcaacttctacgggagaccccacttgtgaccttgacctcattggtccatgtgccaagtaagcagattgtgttcaatctaaatttaaaaattgacatataggttttgacatttttttgtttacagtggcttttttattttaattatcaagaggtaacacgtgttgttgaaagaacagactttcaacagcaatggttgttgaagatgattcatgtaggaagtctgtagaacagcatacataaacgtgtaaaaggtaaaattgactttcagtggctgaaagaacagactcgagagccagctgccttgggttgaaatcccatctctgccgttcaccagctctgtgagcttcaggaagagagttcccctctttaagtggggctcacaccagtacttaactttcagagtccttgtgaagatgatgtgagtttctaagtacagacatactaggcccatatatagatgaaaacatgcatgcttggatattagaaattatgactacatttttatttgtacattctcatcccttcgagtatttggattttttttctttctccacatatttaacctttcatagatcatagaagaaacttgtgtctttaactgtcaggaggtggtacagtgacccagggcttcccagaaggctcttacactgccaggactacagatatgtctgtttagatatgaatttgtaatacatttgttatatgcttccatcattgcattcttaaggtgcgtgtgcttattaggcaccctgtctgaccttacagtgatcagaccacgcccgacaggaatgggctggattacatgggtttgggtggatttatatccaacaacacag

SEQ ID NO: 114075 - DNA, 1006 bp, Homo sapiens
ctgggccctaggctcagtctgtggcatgcatgagaagctagtggcttatcaacgaggagagaaaatcataccctagaagggaaaatcaagaccgtatttggttaagtatgtggagaaagaaaaaaaaaacaaatacttgaagaaaagggatgagaatgtataaataaaaatgtagtcataatttctaatatccaaacatgtatgttttcatctgtatatggcctattaggtccttatatgcttctgatcaagcatacaaggtaaaattgatgaggctgttaaaaagtgcatcagtagcagttggtgtggaacacattctcaagggggtcacagggtgacagatagtccaggacagggaggagacagtgccacggggaggactcagcaggaggatgccacgtcgtcagagggaaatggatacgccagaccagagcaaaggggggaccccaggagggcagaggatgtgaaaagcgttaggtggttgagggcatggaagacgttttatttaataacattcaaagcaagcatctcaatggatcagtagatgaatatatagtctgcatgcctgctgagtgtcccagactctaggcagctagagaagagctgatctgggcacagggacctggttagtgtttgtagctatcggatgggtgatggcgcagaagcgggttatacgttttgtagcctcccgaggacagaatggatgtcactgtgcaggggtgacaagagacgctgatttgaactcaactcacaggggggcctttgccagagcctgagctctgttgggggaggttctggaggacaggctgaatcaccggagtcaggagaggataggacgctttcaggattttagccgggagacccacgtggggacccctgtaactctgagtttcgggggcgccttatgaagagcttcagtgcatttcccatctttgctggcaccccacattttgtgcccctggtagctgagctgctgggttcatgaggatgtgggagaatttgctgc

SEQ ID NO: 114076 - DNA, 1035 bp, Homo sapiens
acgtcaggaatcacctctggcggtggggaaggtggctcttggccagggcgctctcacccacccctgcccacgaggatggcccctttctgcccgatgctctaccctttctgccttatctgtctctatttattctgtgataagcttttacctgtagtcaaatctcagtaacaagagcaatagctaatgtgactaacgaaaggttgcggactgggaggatcatgagcttcttctgtagaccaatgagccaattaattcgttacttcacatagtggcattagacagactggtcagcacaaaggcccgggtgacgtgggggatgttaactcattcttttgggtgcccttggccaccgtgttactctcgtttaactttattcccattagaagtttcttagtaagtaatagctaatggacaccagtatttcagtatgattaatgagtgtcttctgtttacgctctcttgattaaaatgatttactcaaataatagcttaggaattggacctgctttaagatacccattaagtgttgaagtaaagcattaggaaacatttttaaagttgttatagaatctctaaatattctaaaattccttttttatgctgtttccttcagttgactattgccatcgggctcagccttcaacttttgaaatcagtggcatttgaaacaaacctacagtaaactagtaaaagtgccttttcattgccagttttcttctgaatgtcaaatacaaacattcgaaagtcaagaatagtcatctggtttcaaaggaaagctgcttaaaacgcaggagcatgtgaggtaatgggagccgtctgctctgcccccaccagatgggtgctgtggtcttcaagagagcgcataggaaagaagtatgtgggtttttttagaacagctttttaaaaaatactgtagtaggccttctgttaaaagagccaaacagcattaatacataaaattggggttaataaattgaattaaattgtaaaacacaagatttgtctgaggcgctgcatccgagaagttgttcactt

SEQ ID NO: 114077 - DNA, 1514 bp, Homo sapiens
gttcccccagcagacacgtaaacgcgttcaatgtgtgaatgaatgaatcatcaagttacacaaatgcaatttgtcgggatatgaatggcagttattaaataaatcagctccaagttaataaaaacggaaataaaagcctgttgttgcaagactttcagtactaggactatttaaatgagatctcggatgttaaagggaagttttatttgttgaggcagtaggagcttccactgcgtgtggaagtctttccacctgagtggaattggctgtggcttctgtgttcagagtggaattggcaagcagctgctatgttcggagctgactgtgttcgtcagaccagggccagatggacgcgtgaaggcgtgtgtctgacagatgaccgggtcttttaatgaaccactcacttgaaaattgtctttctgcaggtgatgtatcacccatcagtatgtctcccatcagtcagtctcagtttattccactcggggagatcctctgcttggccatctcagcaatgaactcggcaagaaagcctgtcacccaagaagcactgatggagcacctgaccacgtgcttcccaggtaacgaggcgggaacgtagcactttccaggtggcggtgtgctgtggtcgctctaggactcacgtggactgttctgcccatgtttaaagagaataggaaaacattcttccccaaaactgacccgaagctttccttacttctgtaattaaaaattcaggcacctgcatgacatcaaaaaataacttaactgcttcagctgtaatactttttaaattggcaccgagaggaagaaattaattcagaatccatgaagaatctggcaagaatgaccaggactccagtcagtctttgcaaactaatctttaaatacatgaacgtgagggttcaacggctgaaaactttagtcctagggagttaaactacagaaagggtcatgtcaaaaattaacatatcttacatatttgtatcatggcttgatgagttttaagaaaataatattgataaattaggatttcattttaaaaaataaaatacttacttttctcttaaatgttataaaaaggaggcaacagcccagctgctgtgtgagaggcatttgacgctttcagtgctggaaggcattaggaagggtgacaagctgcagaatgcaggaccctctttcaagagagccagtgtattgtcaccccacccccaaatggagatcctgccagagttgccaatctcatgtttcaagacaatctggaaatttggtcttatgtgaaatctctgcatttccttaaatattgacaattgtgtgtgtgtatatgttttaatgtctgtgtgccagcaacatgcaagtcaaatgaaatacattatcgggctaccagtttgccaacttggtgtggactcagcctgtttctaggttgaaatagagattatattaaaagggaacgtttgctatatttctcattcaacttagaagagatctgagtaaatataagctgttaattgtatcag

SEQ ID NO: 114078 - DNA, 1047 bp, Homo sapiens
tctgccaaggactgcaaagacccttactgtcccccttctctgtgccaggtgccacccactgaaaagagcaaaagtactgtaaatttttcctataagacagaaactctctcaaaacctaaagatagtgaaaagcagtcaaaaaaattcgggctaaagttattccggttaagttttaaaaaagacaagaccaaacagctggccaatttttctgcccagtttcctcctgaagagtggcccctgcgagacgaggacacgccagctacgatccctcgggaagtagagatggaaatcattaggcgcattaacccagacctgaccgtggaaaatgtcatgcggcacaccgcgctcatgaagaaactggaagaagaaaaggcccagaggagtaaagccgggtcctctgcccatcacagcggaaggagtaaaaagagtaggactcatcggaagtcccatggaaagtctcggtctcacagcaagacacgggtgtctaaaggagacccttccgacggttcacatctggatatcccagctgaaagagagtatgacttttgtgatcctcttaccagggtgcccagggagggctgcttcatcattgaacacaaaggagataacttcatcatgcacagcaacacaaacgtgctcgagtcccacttccccatgacaccagaatgggatgtgtctggtgaattggctaaaaggagaactgagatgccttttcctgaaccttctaggggaagctcccactcaaaagtgcaccgaagccacagccatacacaggaccggaggtccaggaatgagagatccaacaaagccaaggagagatccaggtcgatggataactccaaaggccctctgggtgcttcttctctagggacgccggaagaccttgctgaaggctgcagccaagacgaccagacccccagccaatcctacattgacgacagtactttaaggcctgcacagaccgttagtctccaaagggctcacatttcgtccacaagctataaagaggtgtgtattccagagatagtcagtggcagcaaggaaccg

SEQ ID NO: 114079 - DNA, 1032 bp, Homo sapiens
aagccatgcctgcttcccagcgtcagcaggagtcaggagggaaccaggaagcctcttttgactattacaacgtctctgatgatgacgactctgaggaaggggcaaacaagaacacagaggaggagaaaaatagagaggacgtaggcaccatgcagtggctcctcgagcgggagaaggaaagagacttgcagaggaaatttgaaaagaacctcacccttcttgctccaaaagaaaccgacagcagcagcaaccagagagccacccattcagcccggctcgacagcatggacagcagcagcatcacagtggacagtggattcaactccccacggtagggagaggtgtctctgtgcacacacatgcgcctagcggggcctggggctttatgcacgtaacttgacaagtttctgatttcgtagtctcagttctatggatgagggttaagagttgtatgagttgtattgttaacaatctgtttctgacttctttttcaggaattgaaaaaaatgtttctgcacctgtagagatcaccaatctggactggtgggttggctcctcccctcaaacttgcatcagtctgatctaactaaaaccaatatttccagtattttttctgctacgttcatattgccacccatgctaagagaaggatgttttttaagtccttcaaaaatagtaactttttgagtagaataaatagtctgggggcgggggaggaagataggggttgggagtaaactgattgatgctaagataggggtccctgtagtgaaaatataatagcagatctcaaaacctctccaatggatctagaagcttgttgccatttggatcccactattctgtgcagcctgtccctctggctcacacaccttcctttcactgccaagaaatggaatatttcttccctcacagcgagggcaggggcctgtgctctgttagatcaaagcatgtgccatgtttatttctcctcctgcagaaatgacggagcccatttgggcagtctaattgtagttccttcttgttaatagg

SEQ ID NO: 114080 - DNA, 2486 bp, Homo sapiens
agagcaacatgggacctaattctctttctaacttctactccagattggtgactctgagatgcagaaatactactgagagattgacatttctcatcagctatgattcccaagattttataatacttataattttaacatggattcagataggattatgtacttcatatatttaattattaagaattaaaattaattccgttgtgatcttttcactatatccctggataattttggaagtgagcatcacacagctggaactgggaatcattaattgctttgtcccatattaggcctttgtgatttattaaagggctggttcattattattattattatcatcattattattttggtcttggagcctttcttccaagttaacacgtgtgtggaagtctaaatgtctgcacagagctgagagatggccgtggtgacagtggagactatgggccccagtccctctccccatccctcgaggagcctctgacacctcagggagccatgggcctcagcctgaaaaccactagtctactaagtggcttttctaagaaatcatttttgctaaataattttttatctcaaatcagatattattttctgatttattttaactatccttttttttcttcattttcctgttctactcttttttcctcttgagttcccggtagtggataccagattagcaaaacagaaggtctgtaatccgtggtagaagttgagaacaatttttggtggtaggtgtggtgtatttgcctgtgtctttctgttctactgtttctcattatgtagcctctgcctcctacctgcttttcacatgctcgttttaaacctttctcctttccctctgggcccctgggcttccacagacaggaagctgccgtactaaagagatagttgctaaggagacattgggagtagtttaatgagttctaactagaaaaccttccactgcataatattgaaagttttttgtttgtttgaaggtaaacagagatattcatgaaatggttgaaccagtatctctacagaatatattttactatctctaaacttggggtgcagaatatagaatttatgactgggattatttcttgaagtaagttgattttcagttgtttcattatgtgcttaaagttaagtgttttgtcatggcagaaggtaaagactgttctaaagagacaaccttcacacaatagccgcatgtctccccactaatattaagtagaattttctctacatgaaaacgtgtatcacctatacatgttatacagttagagaatctacagaacaattgctaattttacccctttcatatttactacccttcgattagaagctaggtgacaaactattttctacacaccttaataaagtcactgagttgtctcgctgatccaggagtaatgttctgcaaaggaaagtatttgactactagaaactttgctctgcagtctggggagtattttagccagatagcattatcatgcgcctacattaccattgctgcgagacatgggaatcgttttaaattttttttagagatagagtctcactctgttgcccaggctggagtgcagtggtgattgtagctcactgccgcctggaactcctgggctcaagcaatcctcccacttcagccttctgagtagctgggactacaggtgtgtgaaaccacacctggtaatttttaaaaaaatttttgtagatccttctgccttggcctcccaaagtgctagacttataggcatgagccaccatgcccagccctgacatgaaaatcttaagcaggccatttattaaaatctttcagtaaataattcaccgagcagctaagccccaaccaaaaaaaaaaaaaaaaaaaaaaaacagaaaaagaccccaaaaagtgacttttctccacactccagggtttcagtgctggcttagaagtcatgttcagccacatttccaaaattcttcagtcccttttgttgggaattaaagggtatgtagaaggaaaaagggtagaaacttgaactatgctatgagatctaatattgaaaatgaaaagtcttgacgtgagaagcctgtgatttcaaatatgaggcctaaagctggttgataaacacaatatgaaaatcagagaccaaaggctgccaggggtatatctgcttaatgtattgcaagaacgtgtgctgtagacgcctggggccaggggaagacatgtgtacagaaggatgaacaacagaaccgcttggtccatttctcctgcctataaaatcctgaaatcctgtttttcaggttgtactccattagctctctttaaaaaaaaaaaacaaaaaacaaaaaaccaacttttaaatttgaggaatatttttactgctaacattctatctcctttaactttttcatcagcacatccggagcccgcagcttgaatgtcacagactgtaatcattattgcaacaataatgaaatacattctttaccacaatttaccactatta

SEQ ID NO: 114081 - DNA, 1045 bp, Homo sapiens
cagtcactatttatttcattatatgctaggtatacaatgaaataatccacattttctaccttattagtgtacagattcttccttgatgcttacttcttcttcacagtcaccctaggagtaggtacatcccatcataactctctatattttagagatgaggaagtcagatactgtaaaaagttactttagtgattaagaacaaaaccaaaggaatgtgtcttgaaatctttggggttttgcatctttcctgaccctcctcttcctccacctgctccatgcctcagtggtagctctggcaaagccactggtgagttttcctgggggagacgtcatgtaggcaagtctcacactttcccttttagtgatgacattttggagtgtcttttaggtatgctcagatttaccataagcataatgaaaaacttgacttctccctataaatggattacctttctggaggtaccctcgacattcaagaaagtccgagggtttgtttgtttgtttgtttgtttttttggttgtcagtgaacaaactgccttttaaacaattaactcttggcttcttggtgagaagcaaactcaaagccacaaggagttaggcttaaataacctgttggaaagggctgtcagagtacaggattcaaagatgctatcagccgaggatgggaatgaaagagaggagaggatgtcttcgctgtagtagtttgacttgttaactagctctagcaggcttaagtcagttgtggggaccaactctcagagactatttcctaaatgttgactctgcctcatgcagtggatgttttgagaatgcttctggcttcctcaatctctgtagctgatacatttcttgtagccacattgaggccctggcacaggaaagctactcagttcttctcaatctggcccagtcatcttatttctgccattgccctatacatttgaaatcttaaatgttctaaatatcttaaagcaatgaaatagattcaagtgtttctaacttagaaaaagtaaaagagagagcaaaataatacagcttttaaat

SEQ ID NO: 114082 - DNA, 1043 bp, Homo sapiens
gggctcaatttataattatttatgttccaaacaaaacaaaacaaaccctttttgctcttttagtactcgggagagcctggcttccaacacatcaagcattgttgaaagtaaccgtcgtcagaaccccgctttgagcccggcccatggtggagctggtccagccttcaacttccgagcgagcgcggagcccccgacaaatgaagctgagaagctacagaaaccttccaactgcttgcaagcttctgttactagcgtgtgattgtccttctgcctcagatcttctgtctcattcgatacagcaaagtttacgacactgggactgatgtttacatctttggaaagacaagcatctcaaccacagtttttgtgtttacttaaactgtgctgctaagtagggctagggcaaaaaaacaaaaaatctttatttcagagtattgcttttcacatttatggctctgtagcaactgagtaacagtaggggtgatatgtatacttttgcttcactaattgtatctgagcacacataggaaagtctagacactgtaagtgtaatacgcattttcaatgtcatgcagttgccaattccattttaaaatgccacagatgcgtgttgctcccagtctgtggttaaacggtgccacagaactgatccttgacacttccaaaaaaaaaaaaacaaaacaaaacaaaaaaaatttaaaaaaaaaaaacaaaaaacaaaactaagctaccacgaaatgtcaaatgcaagggtccaccttgagggaaatagatgccaaactaactagaagggaccccggccctttgtgtgtgaattgtttatgcaccagtcatttttcactgtgagttttcgtgacactattttgcaggagcccatggaagtgtgtgagaaggggtcgcaatggagatcactgggagtgaatgttttcagggttttgttttgaagtgtcacagatgcttgtctgatttttttaaccttccgtgatcacaaacaggaatataggcctttgaatctgaagtggacaaaggaaagcaatttccag

SEQ ID NO: 114083 - DNA, 1041 bp, Homo sapiens
gaacacaaagaagacccagcagcaaagggatgaccaataatttcatcttatagcaaggagacattccaacgttcccatgttttattttctgagaacagtgggacagatctgtagtaatggaatattatttgcaaaagggttacatatgacacaagtaagtgttctgacataaagttttatttagttcagtggcatgtgctgttgggagccatacaccataaaatatatatatcccaaaataaatctagaatattttcacctccaatttcagtaattggcatatgatttgtgagacgcatctgtttttgtatgaggtttaatcactagcaatctgtttaaagaatccagtcctatacacagttggactcattcttgaaacctttaaatgctccctcatagtttttcagttatttggaagttgcattgggtcaaactgaactccttgagtttggtgtaaattccttttttctgcttattatagtgaaacttcagcatgtttcttagtaaactcccataccattgaaatgcttaagccagttggctttcagtctcatgccttatttcctccaaggcatgcctcaacgcattgtttgtctcattgcttaaatatgtccagaaggaatgatcatgtatctaatagactacatagttggttcccttggggagttatatatcatacagttactaaatatttgtctaaattcattttttccaaaaacctgctctcaaatttttcttctactctcagttcataaataatataaccattgaaacaacacatcagcctctagctgatcctctgaaagtagccattgaaataatcgaatactgtgtgaacaggaaaggaaagcgttacctttaagagaagctttaaaataggaatttattgatatttcacaagatataggtttacagaagacattattcaaataaatatgtacactatttgcctgatgctatggggtacataattttttaaaaactcccttagaccagcagccattagtgtagaaatgatggactttaaaggtgataccatgt

SEQ ID NO: 114084 - DNA, 1102 bp, Homo sapiens
ccatctcccccaggaccatcccgcccattgtcaacgtcatccagggctcttctggtagtgagtgacttttctgcacatgtttagggcttgggggagctagaacacaggaaacatgaatgcaaaaggcatggaaaacactgttttgctttgggttagtaaaatgtgggcaggacaaagattactattggtctgagctttgccaagtgagatagaatcaactgtcaccccattcctttcccagaaggtcttatggtattaaggatacatccagtattttcccacagatttttattcaggcgatgtttcataaattacatatatgaaaacattcattattacatttccttgtgtgtttcaaacagacattggcaccttcctattgagttaattctctgcatcttttgcagcagcagcccacaaggagattcccagagatggctcccctaacacacagtcctgtgattttacagttctatgacttacagttgatgattcacaagattcaggattctacaagactcaagggggaactaaactttcttacgattgtacatgatcagttatagggctgtaatcattaattgttggcttcaaatgtggacacacacacacacacatcatgccaaggagggaatggggtgtttcaagtcaggcagcgatgattctggaaggttggaaatgtaaggttagaagcttggctggtcttagtaaacttgttcccttgctcccaccaagaagaggtaccaaatgtgagacctgagatctcctccaatatctgtcctctgcagttccgggaaactaatcatgaagtacacatgcagcagctcctccacttcctttcctccgaggtcctcctttccattctcccacctagatactgacacaccgccacggtttccacattggaagggcagaacactgtgcagtatcgtgcacacttgctgggttaggaatagagctgccctagggtcaccttcatgcaagtattgacagctacaaattaaagtccttagagcagttgacacagatactacgttctagaagagaattaaatttaaacgtcaagtttaaagggatcataattctgcaggtatctttctct

SEQ ID NO: 114085 - DNA, 1046 bp, Homo sapiens
ggattgttctgaagaatgtgaggttcagagggaggaggggcactattaattttatttaagatgtgtacttccttatgctgcactgttagaacttggaaagaagcgacgttgacttagcagtacagactaaatgtctggtgaaccgctacttccttctccccacttctaatctctgaatattgacctaaatttttaccatatttcaaggtccagatcaaatgctgtctctttcacaaggccttctctgagtgcccttctccacttccatgccctgagaagatggcttcttttcctctcttatagtacagcattcatcatttccaatcctgtgttctcatgttttgccttaaagacagaccctgcccaagaccatcccctcagctagacagtttataccactttaatattattcccttgatttcctggctgggggagcctctgcttgtcattgtttctaggtggcccttatgagctttgaaatcttcagcaagaaatgggctgggtgtggtggcttcaagcagggtttgaaaaacgctgcgtgctgtggtcagggctccttctcactaagaaacctctcaggaatgtgctcccagctactgcatcctttttgcttccatgcgtctaccttatcaccaaaaaacctcaacacaaaccgaaaccaaagaacaccgggaacaggaactgagctttggcttttgagatgtcgagaagttgttataagatgagaagctgagcgggaggcttccagcccttcctgttgcaagcacctgtgctgcagaagcctggccctttgctcttgggttgtgacggagccgctgtgtttctccacagcacccttcagtctgtgtgtgcagcaccaagtcggggggaagttagaagaggtgggaagagccaccgagcaggcagctcaggagaagccaaaccttgcacagtggaacggaacgggcagtccatttgtggggaaaacacgagacggaggtccagtgctctgtggtgcggcaggcaagggggaggctcttccccaaagtggttggagtgtgtatggc

SEQ ID NO: 114086 - DNA, 1026 bp, Homo sapiens
ctcactcaagttcaaggaccaacaagggcagtggaggtgctgcattgcctgcggtcaaggccagcaaggtggagtggatgcctcagaacggacgagataatgtgaactagctggaattttttattcttgtgaatatgtacataggcagcactagcgacattgcagtctgcttctgcaccttatcttaaagcacttacagataggccttcttgtgatcttgctctatctcacagcacactcagcacccccttctctgcccattccccagcctctcttcctatcccatcccatcccatcccatcccatcccatcccatcccgctcttttcctacttttccttccctcaaagcttccattccacatccggaggagaagaaggaaatgaatttctctacagatgtcccattttcagactgctttaaaaaaaatccttctaatctgctatgcttgaatgccacgcggtacaaaggaaaaagtatcatggaaatattatgcaaattcccagatttgaagacaaaaatactctaattctaaccagagcaagcttttttattttttatacaggggaatattttattcaaggtaaaattctaaataaaatataattgttttttatcttttctacagcaaatttataattttaagattccttttcttgtttatcagcagttgttattacatccttgtggcacatttttttttttaattttgtaaaggtgaaaaaagcttttatgagctcatgtagcaatcagattttcctgtggattgataataaatgaatatgatatatagttaaatttttaaggggcatcactcctggctttgtctgtgtctgctttaaaagagcataatcacggaataggactgacaaaggattgtttctttttggggaccaaaatgttttcccttgttgaccacaagaaaccgtggaggttcttactgtgaggcttcagttgacttcttctcttgagtgctcgcctgagcaggggcccgtgctgagcgttttgcatgacttcccgtcttcat

SEQ ID NO: 114087 - DNA, 1022 bp, Homo sapiens
tccctgcactttttctcaaagtgtttagtacatgggaaaccactaattcaaacaaccatgagcttccctctctcttgctccctccctctctctctctcattcactcaagcgcagacccccagcaggtggccagcaggaatgctttccatctccattccagccactttctgccattgtgcacgccccatctatgggagggagaggggacgggacccactcggaatcgagatggggcacacaaccagctctgggcacgggtcacagcgggagggaacccacgcacacgtggaagaggcttttgcttagcattttgtgacgtgtactggtcactgcttttggctgggaaggctgctctatttttgccggtgaagtaggatgtttaagtggtaagagcatcggcatttcccagcctccacttcaattcccttttcctgctatcacagcttctctacctgatggtaacatttaactccctttcctcctttcagttccaacgccgaattttataaccccaaacccaaaagtatggtaaattctggtgatgcatatttcaccacacaagaaaatcccaaagtgaagcttgtgatctaaaggaaaggtgcataaccagcagcaaggaaagcccggagctggtcgggaggcttttccttggcagcatcgtgggcaggctgggcagtggcttacctcggcactctcttcatcgctgggcacactatcagtcgtttcgctttctgttcacagagagaaaaacacagggccatcattcctgtccctcaagctgtccccaggctcaggcagtgtttataaaaaggagactgagtaactaaacgcatcacctccctccctttgtaaagcgaaacattctacatgggagaagctagagtgaatttcaactctgtaatcttcggagaaaccaggcttgagagctgtgaggaggctcccttggccagggccgggctgtgtatacactgggcactacctcccaggaaggggcgctggtccctggggccctcctcactgca

SEQ ID NO: 114088 - DNA, 1029 bp, Homo sapiens
tagcctgggtgacagagcgagactccatctcaaaaaacccgaaaaacaaaaaattagctgggtgtagtggatgcacctgtagtcctgggtacttgagaggctgaggtgagaggctctcttgaacccaggaagtcaggactgtagtgagctaggattgcaccactgcactctagtctgggtgacagagtgagacctgtctcaaaaataaaatgaaaaaataaaatggggatactagtatttaactggttagagctgttatgagagttaaagatgattgatgtgaaatacccagtgcttgcttctcacacaccagtgactcttatgaagacacccctgttggtgcataagacagttgctctgctcacatcagcaaacacatcttcagtcctgctttggccgccgataccaaccttttacctcccctggcttgcctgccaccttctccctgcctagacagcacctccccatccattaaggtcttcctttaccataaagctttcctttgccataaagctttctcttatatgcccatttaacaatgatttatgtattccttatgaactacctaacttagttggcaattaataatacactaccttctgatctttattgcatagtcttttattattataattataggattattagttagctttatgtgatttatctctcacatcctcagttaacttatttgttccttgagggtagtgatcatgtcttaccgtctttgaatcccccacagcactcagcacagttccttgtaacaatgtgtgtttaatgaatttttgctgatccattgggtgactgggtaataagaaaaggcgttccatggccgggcgcagtggctcacgcctgtaatcccagcactttgggaggccaaagtgggcggatcacgaggtcaagagattgagatcatcctggccaacatgatgaaaccctgtctctactgagaatacaaaaattagctgggcatggtggtgggcacctgtagtcccagctactccggaggctgaggcaggagaattgctt

SEQ ID NO: 114089 - DNA, 1059 bp, Homo sapiens
ttcaataattcagtgttcgtgaagctggtccccggccagctttgctgaaagcagggggtgtacgcatagcacacattcgtccttcagcatcatttcttctgaaaccaaaggtgtctttttttttttatttgtatgactaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattg

SEQ ID NO: 114090 - DNA, 1038 bp, Homo sapiens
tatattatgaagtatcttataagctacaaaattgaagaaattttgttcaccatgttcaaaatagttagaattctcttaccatttaaaaggaagaatttattgtggacttctgaattgctgagtagttaatttcatttcaaagtagttattctttgttttccatacaattaaaagtaattctttctgttccaaggaatgacatctcggtctggtacagatgtcgatgcagcaaacctcagggaaacattcagaaacttgaaatatgaagtcaggaataaaaatgatcttacacgtgaagaaattgtggaattgatgcgtgatggtaagaagaaacaattagaatgaacttcattgtacaattaattttatactatggtctagcaataattatatgtataataaaatatgagaattgtggaattatactgtacataaccctaatcttacatactttagtaagaagtttaaaaaaagttatttatgccaacttcctaaaatggtttgagatgtgttgccgtgccccaggttaggttaagatgacctcttagttttagtctcagtttcttcatcatgttcccatacagtatatctgaagttgttgaataaagtcatggattttttttccttttatttgcaaatgtctttacagtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggtaatgtctaactgagtgatttggttattgacgattaagcaggggttactattctcaactgtaaattatccaaaggataatttttttcctgaagctaatgaactattgttacttttcatttatttaccacttaaaagatatagagtaaattttaattttatacttatatcaaaaagactcagcataattaacatccttttttttttttttttt

SEQ ID NO: 114091 - DNA, 1027 bp, Homo sapiens
tagctcatggggtttaaggaataatttatgaattgtgataaatattgtgctttgagttatatttgcattttgttgatttcccatcatttcagggtaatttttaagatttttactcttacctcaaaggataaaatatttcacaaagttaataagtaatttttaaattataaaggtatttgatgaaattttgaagaatttagaggaaaatgtaaaacatggaagttaaaagcctgaactctgaagtccaacagatgctttccttccttcttggctgtgacacaatatttgcataacctttagcacattacttagcctcacgtcaggtcattttctcatctgtataactgttgatgtgaaattgaaatgaagacagcctggtttataacattcaacaagtgttaactgttactgtgagttataaaaattgcactaatataaacagaaggcgtggtcatttctacctttgtaaagctattatttgatttctaaacagaaagatcatacatggaagcgaatcaatggactctggaatatccctggacaacagttataaaatggattatcctgagatgggtttatgtataataattaataataagaattttcataaaagcactggtatgtgtcttacataatttttaatccttttcaaatgtttgtgccatttacatttgatataatattaaaagcagtattattgaggtattagacagtaaaccgtgacacagactagctgtgaagtagagattgggcaggacctacaggtcctctgatacactgtgaacgcgtcactcttctgcccaacttcatagcctcctcttgctggcctcctatctgtatgcttggttgcctctgccctgacttctctgtagcccttgcttctttttcttctttctgcttcctctttgatcccaatggaaggttctcaaaaaaacagttaagtggtagtatttattttttccccagaaactgcaagagatatcacaagcattgccttatttaatttatgacaacctggaaagtaacg

SEQ ID NO: 114092 - DNA, 1611 bp, Homo sapiens
tcctgggatggattccaacagtgtaactgtactcaatgccactgagctgtacgcttaagagtggtaaattttatgtctatttcaccacagttttaaagattaaaatttttaaaagtgggggaagttacctaggactttctagaaggacttttgagggtgagcaagttctgttataggcttgtgtattattttggtatttctgattttatcataggagtgaggttaaagttgtattttgactggaatttttgacattgtcagggtttctagagtgtggagaaggtcactcagtattttttgtttttgttttttgttttgcctttgttcttgttttcctctatttagggaggtggattgccatgggaagtacctttgcttcgaaaagccagaaaatgcctggtagaactccagaaaagtagtaaggagctggcttcttcagaggcagcatagcagagtgggaagagggccctgtcacttagattgtgactgtcgacaaagtcacttaaccaccagaagttgggttttctgacgtttagaattttgaaaagattaaaactgagtgccttgcaaagtacctggtatatattaagtgctcaataagtgatagttgctttgattctaagaactggttcaccttgtgagatataattgtgtaatggaagaatgaaagcagaaactttagtttctacttttacatttcctgggccattttactaccctaaatgagaagctgggcttccaaaacccactttaaaagtaaagactaggccgggtgcggtggctcttgcctgtaatcccagcactttaggaggcctaggtgggcagatcacttgaactcaggagtttgagaccagcctgggcaatacagcgagaccgtatgtctacaaaaaatacaaaaattagccagacatggtggtgcatgcctgtaatcccagctactcgggaggctgaggcgggagaatttgagtccaggagatcgaagctgcagtgagccgtgattgcgccgctgccctccagcctgggtgacagagtgagaccctgcctcaaaagaaaaaaaaaaaaagaataaagattaatggagatttggaacatcttgatactgtatcttgggaatctaagcattgtagaattgtgttatgtgagttataccattgtggtgggaagtttttgatttttgttttaactgtgttgagttgcagttcttagaaatgacccgaggtgttgtcttacaaaagaaataaactgtaatctgtatcttgatctgatgagggtatgtaaatataaaaaatcgagctgtatactttctatatgctttatgtagttcactatatataattcatagctcaattaaaaagagagagagaggctaaattgtatgtaccattgcaaagaaatcattatccccagaactgactcacatacacctttaacagtagagggagaactgaggtattaatttggaaaaataatcactgggataattaatataatgcagtggttttatgactgattttttattaacttctattttctttgtattctagttaataaaggtatccatggagaacactgaaaactcagtggattcaaaatccattaaaaatttggaac

SEQ ID NO: 114093 - DNA, 1058 bp, Homo sapiens
gaaaaagcggatgatgacaagtagagagcaaatgtgcgcatgtctgatgctgtaaggatttcctttaccatcatataaatttttaaagtatatcaaaataaactgataactgagaaaatatatgttgttcagatactaataatgaagttaatgaagtccactatagtatttgtccctgagaaatctttatcaaatattttaaatcctattgtaaaataatgtattttttctttcagttttagagactggcaatcctaatttaacatctccttttgaattccccaccacaggcacactttcacacattcactctttaataacaggttgtttcaaattgttaatactttatagcttaatatagaaatttcactttagaaattaatttttatttctctgccttaatgctatagatgttgtagtctgctttacttcagtattgtaatgagtagttggctaaccaccatgtaaatagggagaacattctagttttttacttgtgtaggaaaacacagcttgaaatgtctaagtatctattttagagtgaagtaaatttatactgacaatatttttttgtgtttgaagacctgactgttacagcgttggtggcaagtgttaagggatccaggaactagacaagtgattctgagacctgagttccaggtttctaagtaatatcagttggtctactgagaactttgccataaacatatgtgttcagaaatttcctttcttagcagcagcatcctgaattgaacagaattacacacacatcagcccagtaagaaacaattcatgttaagtccattgctatgccaggataaatcttttaaatcacaattatttttcctatttatattttgtcaaataagaatgttctaaaaaccaaaatttctgttttcttttttttttttttttttttttgagacggagtctcactctgtcgcccaggctggagtgcagtggcgcgatctcggctcacggcaagctccacctcccgggttcacgccattctcctgcctcagcctcctgagtagctgggactacaggcacccaccacc

SEQ ID NO: 114094 - DNA, 1088 bp, Homo sapiens
tgtatttttagtagagacggggtttcaccatattggtcaggctggtctcgaactcctgacctcaggtaatccgccctcctctgcctcccaaagtgctgggattacaggcatgaaccacggcgcctggtctaccctctcgtaatctttttttttttttttttgagatggagtcttgccctgtcacccaggctggagtgcagtggtgcgatctcggctcactggcacctccactcctggttcaaactattctcttgcctcagcctcccgagtagttgggattataggtgcccaccaccatgcccagctaatttttgtatttttagtagagacggggtttcaccatcttggtcaggctggtctcgaactcatgacctcatgatccacccgcctcagcgtcccaaagtgctgggaatacaggcaggagccaccgcgcctggccccctttcttaatcttttagggagattctggttttccttccaggaaatactcatttgccaatgagtttgtgttgctgcaaagttttctgctaaaattcaagacaatgtttatcaactcaataagcacaaatgtgttaccaaagaaataggacttcactgttaaatgatttagtacatattatttcacttcaaaaaagccccaatatatctgttttccacataggtaaattatggcagagatgatattaatgaagagaggaactctattaattacctatttctatgtcaaagccagccccaaacttactggcttaaaaaagacaaaacaaccaaatttatttttttcttatagctctgtgggttggctgggcagtttgataggtctctctgggactcaggcttactaatgcgttgaattcagatgacggctggatgtccggaatggcccagctcacatatcagactgcttatgctggctgttggctgcaattccttggttcttttccatgtgggctttcatcctctatgaggctagagttatggcatggcaatctcagggcaggactctgggataaccaagtctgctgcaaaggcactcgttaaacctctgcttgcttcacttttgtcaatgtgatgttggcccaaaacaa

SEQ ID NO: 114095 - DNA, 1017 bp, Homo sapiens
aatactgtagttctttatttttgatttagctgtgtcaaccaggaagttactaataaaaggaatagcatggacttgtgcagctaagttctattaggattatttcaaaaaaaattttcagattgtatcacaggaagttgtgttaaaattgtattgactattattcagcctaagtgtaggtactgacacttactgactagctatttttcttttaaatgttaactgaataataatgttatagattacccattttataacttttaaaatatatccagattaaaatgtttttgataaagaatatctgctagtattctctgttggacctctacatgcttgattttaaatctttgtgaaaatgtatgtgaatgctatttaaaaaatatatagaatgttagctttatcctggctttgaagcagaagaaatatatataaagtcccccaccacccccaaaaaaaaccccaaattatatttttcttcaaatagccattgaacccttaaaaataaatttagatgcttatttcattacagctggtaaattctgtttaattttaaacctttattattattattattattattattattattattattatttctgagacagagtctagctctgtcacccagactggagtgcagtggtgtgatctcagctcactgcaatctctgcctcccaggttcaagcagttctcctgcctcagcctcccgagtagctgggattacaggtgtgtgccaccatacctggctaatttttgtatttttagtagagatagggttttgccatgttggccaggctgttcttgaactcctggcctcaagtgatacacccatctccgcctcccaaagtgctgggattataggcgcgagccattgtgcctggcctaattatgtttttagtaattcataagtattgactttcttctacagtctaaagtaagatttcttgtgtagtttctccatgggctacaaggaacctcgattcagagattttcactgccacttaacattgcatattagca

SEQ ID NO: 114096 - DNA, 1023 bp, Homo sapiens
ttctgcttctacagagggagagaacaaatatggaggaagagcccctgtaatacagaggaaacatgtcaaactaatcacataaatcaacctaaaattgtaagtctataaagagaaaaagagtatgtagggggaatttgatgtagagagggaaatcaaggaagccctctctgagaaagaatttacagaagagtaaagccagagggcatgaggacagtgtggtgttagaagaatcccaaaatatcattaaaaatacagtttattgcgtaactttgaggtatctaaactgacggcagttcataaacatttttgctcatgtcaagataatattgcatggtagttcttagtagcttcattttgcaaatgagaaaattgaagctttagggacttgtcctaaggctgcacaaccaaggcttttttaagcagttacatgtgctaaaaatttccattttcttttttattccttaaagcaactccaaaaggtagctgctattattattcctgtttagcagctgggaaatgttaaggtttagatttgaccaaagccatagagctggcagatggcaaagccaaaactgacactgacctgtctctgactccagcccccgtgcttgctgcctttctattgtgcatggccttcatgcccagtgccttgtagtctcagaggctgtattcttagagctggagtcaggctcaatatgaactagacactttctggtaattaaaaccattaaaaaaaatgaattaatgactttttttttttttttttttgagatggagtctcacactgtcacccagactggagtgcagtggcaccatcttggctgactgcaatctccgcctcctgggttcaggtgatcttcctgcctcggcctcctgagtagctgggacttatagacacctgccaccacgcctggctaatttttatggttttagtagagactgggttttaccatgttggctaggctggtctcaaacttctgacttcaagtaatctgcccgccttggcctcccaaagtgctggga

SEQ ID NO: 114097 - DNA, 1063 bp, Homo sapiens
tctcctagcacgcaagtccctcccccagttcctcattggctgagtactatggggttaacaatctttccagacatcacctaagtttcattatcccccttataaggttataccccatccccttccccacttgagttttgattttccaataacaaactttcttcctttttatgggctgacccctcctctacattctgttcacttattaagactttctaggtgcatgagccgtgtggtttgttacatttgcaggctggctgccggtacttagatttatcatggcttgaaaatgaaccatttaaaatgttttctcacaatccttcagatattagtaatggtagagtccatctttgaccctcttcccactctatcctcacccttgatgatcagccaccatcatggctttgatatgcatctatgttgatgactctgaaatctttatcttcagcccagattgttctagacgtcagacccatccagccaactgcctctaaacactccccacacagatggttccaacttggcatgtcctgtgctgagctcctcatccttccccagagtcacatcttctccgtgatgtgtgtatcagtgagtggtgtcaccagttacccaagtagacacgttggtatcatccttgccctctctgtgcctctcgccctacttagccagtcagctggctagagtgcgctgattctgccacctgtgtgcctcaaaccctccagtgattattcgctgccttcaggcaaaagcatggatgccgtagcttgcaaagcgaggcccgctgtgctccagcctcatcttctgccaccctgccctttgcattcagctcctgtcctgggccacatttcctctagtccatgggcctttgaaccttttgatgctgctgtctaaaccgttgtgcctccagattcacctggcctgttaggattctgtagacgtcaagctatgtgagaagctgtttctgtcatatctcaaaccctaagccttacttggattagtgttcctctgggttgcagagaacgtccagggcttatggtgtcaaagcatttaccacttcctgaggtca

SEQ ID NO: 114098 - DNA, 1049 bp, Homo sapiens
acaagagtgagactccatctcaaaaaaaaaaaaaaagtattattcactaatttcactaattttcattttatggtgtttttcaaaaaactacaaaaataatgtaggttaacaaaatgaaaatgtaaagttctttttcactcttctgtccatgatcaaaggcaggtaaccactgcaatcatttgctatttaacctagaagagcgtttcctatatttcctatatatagagagagatcttcctcagtcttttaatggttgtatagtttttcatggtatagctctgtcataacttacccattcctctactgaagaacatagagtgtttttttcaaagatttcttacataagccctccagtaaacatttttatacacatattttcatatattgttatttataatagcaaaaaactgacagcaatctaaatgtacaacaaaattgaattggttatatactatgaaatcctctagctgttaaatttaaatttgtgaagcctgtataatgtggaaaacacccatttgtgatgttaaaagaaaaactagtctctaaaattatgtgtatggtatgattacaagctttaaaatatggataaattttcttatgtttattttcttgtcttatatgtatttatagacattgatttagagtctgcctctcacatttccacattaatatatttttcaatatttctccaattatatatattattttagtaagtgaaacataaacttcatttaaagcaaactagattcttgtccttaaaaattaaatgatactggctgggtacggtggctcacgcctgtaatcccagcactttgggaggccaaggcaggcggatcatgaggtcaggagttcaagaccagcctgaccaatgcagtgaaaccccgtctctactaaaaatacaaaaattagcaaggcgtggtgttgcacgcctgtaatcccagctactcaggaggctgaggcaggagaatcgcttgaacccagaaggccgagcttgcagtgagccgagatcgcgccactgcactccagcctgggcaacagagcaagactct

SEQ ID NO: 114099 - DNA, 1050 bp, Homo sapiens
aagacctggctgatggagctaggcctgttatggacgtgagggactgcctttctctttgccaaaatgaagacagcagttgaaattatttcaaacgctttttatgaaattagttaacatttgacctaattgagaggtttgaatcttacctgcttccttgtagtgtcacaaacatgaattgactgaaattgcaaagagtgagggaaggctgagagattgcaaaacccgtaattgtgctcaacaacatttaatcaaaatttaacttctcaactttcagctattgtaatttataaaccattctctctgttgcagtagaaaccattgaaggttttcagtgttctccctatcctgaagttgatcattttgttctttctttggtgaataaagatggcattaaaggaggtaaagttaatctcatcctttgttaactgttatatgatagagtgatagtagctttagaaacattatttgcattttaggaattcggcgttggaactactttttcccagaagaattactggtttatgatatttgtaaatatcggtggtgtgaaaacattggaagagcccataagagtaataatataatgtaagtaatattaatgatttgtgtgtatttaaccaatattatattttaaatatttataacttttaaagttgcgaatatgaaaactattttgttttaaaaataaatttagttgtattaaatttcttttttttttccaagacgaaatcttgctctgtcgcccaggctggagtacagtggcgcgatcgcggctcagtgcaacctccgcctcctgggttctagcaattctcctgcctcagcctcctaagtagctgggattacaggcgcctgccactacacccagctaatttttgtatttttagtagagacaaggtttcaccatgttggccaggctggtctcgaactcctgaccttgtgatccacccacctcagcctcccaaagtcctgggattacaggtgtgagccactgcactcagctgttgtattaaatttctatttgttgtatatggttagcattacataatattt

SEQ ID NO: 114100 - DNA, 1099 bp, Homo sapiens
tgtgtgctatcacttcaaaaaaaaagaaaatgagcatacataaattctcgaaggtacgtgccaaaacgtgtatcatttatttctggtcaaatgagtaaggaagattctttcctctttgcttcttgtgtatttcctaattttatgtattttctttcttttttttttttttttttttttgaggcagagtcgctctgtctcccaggctggagtgtaatggcgtgatatcagctcactgcaacctccacctcccaggttcaagggattctcctgcctcagcctcctgagtagctgggattataggcataggccaccacacctggctaatttttgtgtttttagtagagatggggtttctccatgttggccaggccggtctcaaactcatgacctcaagtgatctgcctgcctcagcctctcaaagtgctgggattacaggcctgagccactgtgcctgacctaattttatgtattttcaattcattctacaatgcacgttaattatttgggtaaataaaaaatctttaagagaaaaatgttggtttgacaacctggtaatacctaccaaaattaaaactgaatatgccctttgacacaattctacttctagaaattcatcctacagatacagatgttcaaagaaatacaaagatgggtattttgttactttgaaaagcaaaatatgggaaacttcttaaatgtctgggactgattaaactgtacacctcaagcagcagtaaaaaaaaaaaaaaaaggtttgtattatcagatatgtgctgaaatgggaaaatcactacaatatattcctataatacagtcataagtgaaaacaaggtagcaaatgggtttcaatgctatttggacactactcatggctcaggtatactattgtaccaagaactccctggtaaggagaaagacactaaaatctgtacttacctctttgaaaagaaacaggagacatacttcagcaggtaatgggaaacctgaatcagaaagatagcaaaactattacatattacagttatctaatttttactttgtggtaaatgtaaaaattagtaacttacagtcagatttgaagttttctgctttacataca

SEQ ID NO: 114101 - DNA, 1026 bp, Homo sapiens
gggctggtctcaaactcctggcctcaagcagtcctcccgtctcagcctccccagtagctgggattacaggcacgtgccactgcactgaataaggacattctttacataaataatgtattgggcggatcaactaaatgtctatactgaagacattctatggtaaaataattgatacaatactattatgtaatatacaatccagtcatattttggcaactgtttttaatcttttttcaatccatgtttacgatttgctaaatactttaaaatttaaagcatgggtactaagtccattgtcaagatagcaaatttatcttctgatttgtcttcagctggactgtccacttgttaaaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggtgagatatcggagacagcattcctcctgcatattcactttagtatctgtcacttaataccttacttcaacatagagtataaggttaaatcacatatcctgagtaaatattttcctatcccactctctatcccttcaccactgaaataaaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttg

SEQ ID NO: 114102 - DNA, 1054 bp, Homo sapiens
agctttggtgtaaattcaggagaaatcgccttattaattaatcaaaattatgttcacatcaacttaattttacaagtttattatagctcatacctgggaccgattaaggtgtcaacattttaaaattactcaagatattaaccagaaaagatgattatggcctttaaaactattggacaaactgatgctatttaacattgttcacagccatttaatttgaataacaaattttagattctaagtaggccataacttctttgcaaaacaattgatttataaaggtacagtttcagaaggtaacagcatgagactagtcttcctataggcacattttagtagactgctcttctcatccctggtcaaggagcttctctaactgatggttgatatttcgcagatggctttcggctcccagaagtgttcttgctttaaataacagagctggaaggctggatgaatcatactgttgaaagaaaattatataattagcaatatcaaaaactcataaccttgtccttagatagcccaatcttatgactaatgcaaattttgattgagctttccattaactactcctcctctcatttttaactaggaccattaagacaattggttttaatccatttcccttagaatataattgatcacaaagttgctagggagctgctctgcaaagcttgaactgatcttcttatcccagaagaccagctgattcaaagaattgtatcatctctattactggagacaggaaatcacatctgggacatgtcaaggcttggtttgggcaggtctgctcgtgctgtgtagaatctgcttgatatcatgtctattttaaaacacagaaaactgtaagacaggttttactttaactgaaataactaatggaatgagaacaccagatccataaaagttcttaaggaaaaaagaaaacccaaatctatcatctcaagaaattatttattgggagaatcaattaaatgtctcaaaggctgccaatccaaatgttcttaatgattcatgttaaaattagaatacaaacccaacataaaataca

SEQ ID NO: 114103 - DNA, 1024 bp, Homo sapiens
cagccatgttcgaaagaccagcctcttctgtttggtctagcccatgttcacggcatcttttgcatatgaaaaacaagctattttcccgtataagtggtaggtaggattttagaagttaagaaacaggccgggtgtgatagctctcacctgtaatcatagcacttcgggaggctgaggcaagtagatcccttgagcccaggagttcaagaccagccttgggcgatatggtgaaaccccatctctactaaaaatacaaaaactagccaggtgtggtggtgtatgcctgtagtcccagctactcaggaggctgaggtggcaagatcgcttgagccctggaggtccaggctgcactgagctgtgatcgcactactgcactccagcctgggtgacagagcaagactttgcctcaaaaaaaaaaaaaaagttaaggaacattaaaaaggaatataatgggaaaacaagtttattgttttaatacattttgtagttgcttctggatttttactgcagactttgctactgttatgccatctgcctcagattaatagaaatgtttaagttctaggaaagaaatttgtatttgtatgccctaatataattttatataatatatatatatgtaatgtatacatattttatgatcagatttgtattcacttctaaattcaatgttaaggttttgacactgatctaaattaattttcctgagcctaaggtttgtgtatatattagagatccagaaatagaatgcttttaaaggtatttttttaattacctaagtagtccaaagcttatgatttggagtttgttactaaatttgggcaagttatctgtagcattgattcagcttgaacataatactttggttaaaagcgaggtttagtgtctctgccttgtttggaacacaccacctgatgagcgtcctgttcttagagtgagctcaatgccttcttgcactcctcttgtattaactgtcccttttgccttattaagtgtagatatttgggcatatgtcttactctaa

SEQ ID NO: 114104 - DNA, 1040 bp, Homo sapiens
gcaaagtctgcagtaaaaatccagaagcaactacaaaatgtattaaaacaataaacttgttttcccattatattcctttttaatgttccttaactttttttttttttttgaggcaaagtcttgctctgtcacccaggctggagtgcagtagtgcgatcacagctcagtgcagcctggacctccagggctcaagcgatcttgccacctcagcctcctgagtagctgggactacaggcatacaccaccacacctggctagtttttgtatttttagtagagatggggtttcaccatatcgcccaaggctggtcttgaactcctgggctcaagggatctacttgcctcagcctcccgaagtgctatgattacaggtgagagctatcacacccggcctgtttcttaacttctaaaatcctacctaccacttatacgggaaaatagcttgtttttcatatgcaaaagatgccgtgaacatgggctagaccaaacagaagaggctggtctttcgaacatggctgagtggtcttacatgaatgaaaactgtaatacagcagagtgtgatttttcaattgagatttatacacagaataaaaacttcccttgatgaaattcagctgtccgagtgaaaataccttacacaatcagcaattctagacattactcctccagccttcattaagtagctaagaaaagtgctgatataatgaagtttcactggcttatagtgatactattttaggtggactctgtaattctgtatctgcatttgtctttccccaaagcttctgatactctagcatgaaaatgccctcccacaatcatcttctgaagcatggtaaaaagtaaaattggagttaccgtttcctttacgtttggttcttgagcttgaacatctgaataatcttgataaagctgttttaaattagataagaaatatgctgcattcctaagggaagactttctctctttaagttcatcatattttgtttgtagttgtttcagctgtggctctaacctaaaacaaaaataagtgacaaataa

SEQ ID NO: 114105 - DNA, 1029 bp, Homo sapiens
tttaatctcttattggtcatttctgcattgcttattacggagtgggaacattatgaatgtctaacaatggagaattaggtagtcactaaaagtgactgaatgtccgagataataaaatatgaaatatttcttttaaaatacagagtggatcacaacactcccctgctttgatagtttcctagtatgcctagataaaatctcctcactttacaggtcacagggtccagtaaagacctggcccctgctttccttcctctggtcattctgaagtagatacccctgcttttcttttccagagttctctcttcttttcctacatatcacaagctgtaaatacatactgtttctatgtaatgtctgtcttccccattagaccaaagtctgtgatggtaagaactgggtctgtcttgttttccactgcacttcattacctggcagcttatgtggcagtgctcaaacagttacaaattaattttaacacaaatgattgtgttacttagatgatttcagatatcgaaaagaaaaggcagcgtatgattgaagtccaggatgaactgcttcggtaagatactgtcaaatcctgtttgagcacttacctaaaaggatgtaatgatggtgtgtcatttaggggagtgacacttgctgctgtgatgtattaaagccccaggttatcttcaagctccgatactcagtgaaggcagggtatgctgcttagttgccccaccttttgacaaaggagaattccacactgatctatctccacagatttctcagctctggccttaagagatataatgcctagattctagaattcagctgcctgggttgaattctagaatctacacattaaactgcttgaactgcttgggttgaacccaagctctgccacttactggctgcgcaacattgaccaagttatttaatgtcccagtgtctcagttccctcttttgtatataggcataataataatcatacctatacttcacagagtgttgtggaaattaaataagtacatatatagaaagtgc

SEQ ID NO: 114106 - DNA, 1356 bp, Homo sapiens
catatagaccatggaatactacacagctataaaaaagaacaaaatcatgtcctttgcagcaatatggatgcagctggaggtcattatcccaagtgaattattgcaggaacagaaagccaaataccgcgtgttcttacttataagtgggagctaaacactgggtgcacatggacataaagatggcaacaatagacactggggactcctagagggaagagagacagagggattcaaggactgaaaacaacctgtttgctactatgctcgctacctgagtggtggggtcagttgtaccccaaacgtcagtgtcatgcagtatgcccatataacaaaccccttaatctaaaacattgagattattaaaaataagagattaaagatatttttaaaataaaaaaaggtatatgccaaattgtatgtgtatgtttgtttgtatgctaagcaaatgaaacacctttcaaaatccatcatggtacttagacttttttttaattcctctacagacaaagaatagaatctaaagtttgtaaggcagccatcgccacattttatgttaatgttaaagaacaattcatcaaaatggtaagctcacggacatgcatttgttggtctaaggtttttttcactaatcctgtagcagcatattgttgtcttagaaaagcttgcatttgctggcagtatggtaataaactcattagaactattcatattccacataactgtttttaaactaaatgtgacacatgtgaaactaattaacatttacttttggaaactgatgtacatgtgtattttttgttttgtgtagcttaaagaaagccagatgttgacaaatctgaaaaggaagaatgctaaggtaaattatttatgtgattagagtcatagagtcaaacacaatactaatgtagagttatgcgaagacttgactctgggtttacagcctttagagtgtgagtagatttcataatcttgtcaggcttttatttggttgatcttgtggttgatacggttggtattattaatgcaaggtaaggaatggggatcctagtcacttttgtttcctaaggctgcacgagtgtcaaaataattgtttttataattaaagacagaaatttaagccttttattaatgtcacaaaggtagctttaaaaaaactacccagtccaaaatgaccacttacatggataaatattaatatatatttattgcttttgtggatgtcgaaaagcacaaccttttagaataaagaactgtcccaggtaggacagcctgggaagaatactgggttaagggtcaggagacctcatgtctagtcctggttctgctgcttcattgctataccacctataagctgta

SEQ ID NO: 114107 - DNA, 1079 bp, Homo sapiens
atagcaatgaagcagcagaaccaggactagacatgaggtctcctgacccttaacccagtattcttcccaggctgtcctacctgggacagttctttattctaaaaggttgtgcttttcgacatccacaaaagcaataaatatatattaatatttatccatgtaagtggtcattttggactgggtagtttttttaaagctacctttgtgacattaataaaaggcttaaatttctgtctttaattataaaaacaattattttgacactcgtgcagccttaggaaacaaaagtgactaggatccccattccttaccttgcattaataataccaaccgtatcaaccacaagatcaaccaaataaaagcctgacaagattatgaaatctactcacactctaaaggctgtaaacccagagtcaagtcttcgcataactctacattagtattgtgtttgactctatgactctaatcacataaataatttaccttagcattcttccttttcagatttgtcaacatctggctttctttaagctacacaaaacaaaaaatacacatgtacatcagtttccaaaagtaaatgttaattagtttcacatgtgtcacatttagtttaaaaacagttatgtggaatatgaatagttctaatgagtttattaccatactgccagcaaatgcaagcttttctaagacaacaatatgctgctacaggattagtgaaaaaaaccttagaccaacaaatgcatgtccgtgagcttaccattttgatgaattgttctttaacattaacataaaatgtggcgatggctgccttacaaactttagattctattctttgtctgtagaggaattaaaaaaaagtctaagtaccatgatggattttgaaaggtgtttcatttgcttagcatacaaacaaacatacacatacaatttggcatatacctttttttattttaaaaatatctttaatctcttatttttaataatctcaatgttttagattaaggggtttgttatatgggcatactgcatgacactgacgtttggggtacaactgaccccaccactcaggtagcgagcat

SEQ ID NO: 114108 - DNA, 1038 bp, Homo sapiens
tagctgggaccgcaggcatgtgccaccatgcccggctaatttctgtattttttgtagagatggggtcttaccatgttggccacactggactcaaactcctgagctcaggagatctgcccacctcagcctcccaaagtgctgggaatacaagcgtgggccaccgcacctggcctacacattcctactcgatgggcatttggggatgtatgtgtccattgctcctgggtgtataccgaggtgtggaattgctgtcctgtgctgaccatgtggggccgttagaggaccggccaggctgtcagagcagctgtgccattttgtgttccccagctgtgtgtgagggttctgatttctccacactctttgactctggccatcctagtaggtgtgaaaactttctcatgtcttgcctcattagattttcggacaagcaaacaccacgctgaagcgatggctcttggactttgcctccaagaggaaagaagcagagcttcgcagcggcatcatcagaaacaacagcctgtgggaccggctgatcttccacaaagtacaggtaacacgtgactcacagccactgctcccatggaaaccgacttcgcttttcagagttctgggagggccttttttgtgagagggagagatgaaggtaagggagagaataacatgtttttgttaattctggcacacatttaaaaactaaggcaaagccattaaggaggcctcagtttctaagatcaatagtattgcagccatctagggggaaaaggagtcagggtagtggagcctttctcattctccattttgttgcgtttttccggaacaagcgtgtcactcttgaggtaatttttcaagcatgagtgataacgtgtaacaatatcatgccccccagaaggccagaattgtggtagttgccacagatctgcccagttgtgttctaattccctgaaatagcttctgcagaggtggggctgacttccatccccattgggagggaacagggcagtcacgggtggaaacaaaccgtagccctgtgctgccatc

SEQ ID NO: 114109 - DNA, 1029 bp, Homo sapiens
actatgggcacccgccaccaagcccggctaatttttgttttagtagagatggggtttcaccgtaacgtggccaggctcgactggaactcctgacctcaagtgatccacctgcctcggcctcccaaagtgctgggattataggtgtaagccaccgcgcccagccactaaaaatatttagaatatgtaataccatgtcattcattgaacagatacttaccaccgcactaaaagagtagaacctctgtggtcatcactaaaaacaacatagcctggttttttactgagtcccatatcttcaggataaccaagagaaataccacatttccatgttgtacaatgactagtaaatgcacattttttttaagttacctatatttaggaaatttaagatttctggaaactggcctgaaatgctaaaactgaaatgttggatgttgtccatatgttgtgtaacccctgctgtggtgataaaatgtttgttttttccattacccctatagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgcttcctcatgtgtaacacggactgtttacctcttctctcctactgtttgtctccaaaagttgctaatgggatcacgtaagaatagtaactatgaaatggttttcttcat

SEQ ID NO: 114110 - DNA, 1021 bp, Homo sapiens
actcctgacctcaagtgatctgcctgccttggcctcccaaagtgctgggattacaggcgtgagccaccatgccccttgtttttcattttattctttggtgagaagaaattgcagaccataagcaaaagccgtttctcctcagtgttgaggtactatgtgctcagaaataaaatggaagtttactcggagtcttttttttttaattttattattattatactttaagttttagggtgcatgtgcacaacgtgcaggtgtgttacatatgtgtacatgtgccatgctggtgtgctgcacccataaacttgtcatttagcattaggtatatctcctaatgctatccctcccccctccccctaccccacaaccgtccctggtgtgcgatgttccccttcactgggagtcttaatgcttttctgccttgctggtgtctttgcttacagaatacagtcaatccttgcccagatgatactttgatatctttcttgcctctcgcccatatgtttgagagagttgtagaggtaggcatttaattttgttttccttgcttgtttgtgtatgttctgctaagttgttgtgttttacagaaagcacttcccttgagtgccagtgacacacacatttcatatttaccacttgctcacatttatgaacagttattgaaggtaagtgtggcgtgcggactgtcatccctatagagaattctctgctcagccccgttttagaaatggtgcagattatttgaaagaatataaattctttttctgagtatgaacaggatactggaatttaatcactcattttaaaattaggagttcagacttttgaaggatactaatgtggacatgagtccagaaaaaccaactataaaggtaaagtcattattaattcagttctacaaagcccagcgaggcttccgttctgtgagaagtctctatttttgattgtgcttgttcctaatgcacaagttggcttgcgactaattttttcagcaatattctaagtgcccttggagaaagag

SEQ ID NO: 114111 - DNA, 1005 bp, Homo sapiens
ctcctgagtttgaattgtttcctaagaatacgttctcaagaatggaactgtagaacttaaggataagagcttgctcttattttttataggtctctcaaaagttgctgtttctgtgtttataccaaataaacaagttttggctgctttataaataaaacaaatccatctctctatcatttttaaaattgtataaaactaaaatagaaaaaaatgtataaatagccctgccatataattgtctgtgacctgcagccattgggataagattaattttctttgcagaaggaaccctgcggtcagttctcttaattctgatttcttgtgaataaaaccttgtgttttaccaaaaaatctatcaataaaggaatacctgcatgttccctctccgtttctgtgtgcagcattgcttgctggctgagatacaagcctgccgtctggtcagctttgtttctggagttggggcccaatgctgcttctgactttttcctctccattttaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattctcagatataagagcctaacttctgctagagaccagattttgtagtctgatttctactaaaagtatagctttacgttacaccttagaaagttacacatatgaaaacctcaaccagggccgctgggcacagtggctcacgcctgtaatcccagcactttgtgaggccaaggcgggtgggtcaccagaggtcgggagttccagaccagcctgaccaacatggagaaaccccatctctactaaaaatacaaaattagccaggcctggtggcacacatctgtaatcccagctactcgggaggctgaggcaggagaatcgcttgaatccgggaggcagaggttgcggtgagccaagattgtgccatt

SEQ ID NO: 114112 - DNA, 1021 bp, Homo sapiens
tttggacacataaagaattatattttcctttccgtattctgaattagaatgctttagacttcttgaaaagttttgatgaatacctcttctgaaaaggtatctgtttaccactacagcaggttctctttaccactcatctgctgactcctggtctaaaccagtagggtgttaaagaggaatcacaaattaagtgcccttaagagttggatattgccttttctcccctctgtccccctctcctgccccacttaaacaaaacagaaataaacaagcaaagaaaaaatcagaccaaaactgagggagaaaacatttccaatctgaagccaccatttcttatctgaggactaaagtagagtctagctgatgtttagtattagagtgcggttgggatacaaattaaaatctaggaatatttatgtacgttcagcccatctgttgttttttctctttttttagataatggcccttgtttaggctctcggaaaccagaccaaccctatgaatggctttcatataaacaggtgagtttgtatgagacaggctctgtggactcctcttgcaagcaggggtgcttctgtatgtgcattcttggagccggaaggtttctccagagtgtatgtgctggaccagctcagagccttgccgtaagcatggggcatccaaggagaaacttgacacaaaggtttggggagaacaagttaaggaatttaacaggtggttcaaagcattgtatttcaaagctgatgtggatacattgtgaagtcaagtataatttttaagataaaattctagaaactctcccggtccccctggcggcatagcattatttctctccacttgaggggtactagaaaaactcagaagctggaacgtgggaatacatcttcatttcacagatgaggaggacctgtctcaggaaaagaggtgactcacccaaggttatagctggttagtggcagaaccaggaccagaagcaaggcctgcagcctcttgtgtaggctttcctagtgcatgctgctga

SEQ ID NO: 114113 - DNA, 1062 bp, Homo sapiens
gtctattgaacattgccagacattttttccttgtcattattccctgaacaatacggtataacagctacttatttacatcatattaggtattgtgagtaatatagagaccatttagagtatacagaaagatgtgcataggttatatgcaaatactatgccattttatatcagggacttgagcatctggatttgggtatcctgaaggggaacagctgtatagaccacatgttaggtattagaaggaacaaaaaggaatcatttttacccccggactgtggttctacatgctcctttgcaccctagagatggatcccgcattagaacccagccacgtctttggcagtctctttagaagttacttggctctgcctctcccccttctactccttgccctcctctctctcactctcccttctcactttcgccctgcgtccacctccctatccctctcctgcataaacagtagcaacacaaggggcatttaactgctatggctggcagatgcccatttggagatggagatgaatgagtctatgagtggtaaagcttgggcttctctacccctaagaaatcctcaacggcatcatttgcttttgcacttaaataggagagtggcacaaaataactggccatcgcgttcctgttagtcaaatattggtgagagttctggcctcggaaacctttgatatgcagatgttcacggttttcctgcccttcctgcccccaagggggacttgaacttgtttcctaattcagcccttgtggggagactgacctcaggaggaacctgagcttgtagagatgttgcggaatatactcatgaccaccgatttcactgtagtgggtttgactcactatcttttttttttttttttttaactgggaacactatgtaaccacattaaagaggtctatagcaggaggaataaaagactcctaaagcctgctgactcactggctcatgactgatttcctacacattcagctggggttgtctgctttgcttgccctgtttcttgagcccaagcgacccacacacactgcctgctgatcagtaggtta

SEQ ID NO: 114114 - DNA, 1007 bp, Homo sapiens
tacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaatgtaagtaaaagtttgcagagttgcaggggcagtgtgtgtgtgtgtgtgtgtatgtttgtgtatgtgtatcttcaagagaatgatgtccttgtgagtcacctctggccctgagccactattttcatggtacaaataaaatggtgaagaggtgaacctttgtgtatagtgggccttgaactcaccacgtgttcagaggccagggtgatacaataaatgctaacgtttttgtaagacattgagcatttaggtggacctcaggagggagctgtcataatacctgggagtgtgagtactggaaggactttagaaacctgacctcatggttcctaacctgggttgggctaaaggagacttgtgatagttatgtgtgttctcaggggagagggtcagtggcttagcatagttaagaattattagcataggttggatttagagtcacattggttggtgtcccgttcttgactaacatcctggggaaggcttataagtctctggccttggtttcttcctcatcagtttgcttttgtgatgttcagataagacactggatatgaaagcctttccaaaacactaagtaaatgctaattgcatttttagttctatccaaagtttgggtagacgggtaccaggattttggtttctgacagtccgtgcagttcagtttccatcaccctgcctcgctatgcctgtctctgcccaggtctatttaaaggaatctcctgtgctggatctttac

SEQ ID NO: 114115 - DNA, 1020 bp, Homo sapiens
acttgcatatcctcaatatttgcaaattgaatatatgggcgtttttcttgcatgataattaagtattatgctgagttggatgcttcaagtcaatattcaggttgcctccttttgtttaaacctttgggcagttggcaagatgcagcctacatgccagtcagttttactgtcctgcacatgatacccccacgcggtagaaccatagagccgtggaggcctcagaaatgtcacctgagagacagggtgttgggatgtaacttaaagtaattttttaagaagtgggtataatgaaacagcaaaacgttgatcattactgaagctgaagttggagtcacgggtacataaaatatagttttattatacttctgtgtctacttttgaatagatttgaattttcataataaattttaagtgaaacataaagggaatatagagaccccaaactagtatcacccattccgagcaggtaatggccgaactgcatagtctctttttctttctgtcttttaaacactggtcattattctataatcttctgcaacttgttaggtttgttttgattttggcttccccagagccagtcacctctttttatagttacctgagctctttgtgtaattttagctcatgtctcgtggttgtcaccagtacctctcttctccttcccaatacgatgagctaaatcctggttaaccttttccctatttcacttgttgcttcctccaacaccactgaggtcttccacatgacaggcacaattcagaggccagaacagggtcccatgttttttgcaggctgcgtccagtcctggggaacctcatagcctgtgattatcttctagattccattcatgtctgcttttttttttttcttttggatggcgtctctgttgtccaggctggagcgcagtggtgccatcttggctcactgccgctgcgccccccacaggttcaatcgactctcctgcctcagcctccgagtagccgggactacaggtgtgtgccatcacgcctggctaat

SEQ ID NO: 114116 - DNA, 1044 bp, Homo sapiens
tggaaagagaaatggaaagaagttagggcatcagaggaggaaacggggcctgcctgtagaccatttcctcattctggaggggacttctgataaatgtaggctctatccattagcacagctttggctgctatagaaatgggcactttccccttaggtttgttgtgggagaaatgtccatataagaaggactgaaacactctgaatactatttattcctttattaagcagagtcatgagaaagtgcttccggagctagtttctccttcagggtccaggtgtctgccacaaagcagggctgtggtagctgaccgaggtggtagccacagcctggacacggccaggcttaggaacagagcagtgatgagagcagcagacagagccaggtgctgctaagcttctgatgggttaactcattagtaccttcagcaaccctgtaaggtaggtcctgctgctatccttactgtacacaagataaaggaacaggtgcaaagattaagttccccataccagaatttgaacctaggcagtctggcttcagggtctgtgctcctaattgctgggctctactgcccctccagagctagaagttctcactccaggagggcctagaaagttccaggttaggccaggtgcggtggctcacgcctgtaatcccagcattttgggaggccgaggcgggtggatcaccctgaccaatatggtgaaaccccgtctctactaaaaatacaaaaattaactgggcgtggtggtacgtgcctgtagtctcagctgctcgggaggttgaggcaggagaatcgcatgaacccaggaggcggaggctgcagtgagccaagattgcgccacagcactccagcctgggtgacagagtgagactctgtctccaaaagaaaaaaaaagaaagttccaggttatacagctggcagtaagacaggaaggacagagctgggtctccttcggtgtcactgctccttgattttacccccatctcatttacactctgccttgaattatctctttataccactagagtgctgaaagagacca

SEQ ID NO: 114117 - DNA, 1928 bp, Homo sapiens
aaaggtcttccggccagggagcgtgggggaaaccctgtggggccgcgcccgtcagtgtcaaggaaaaacggagaggaaggcccttgcctccagggccctcgcagcagaattctgcccggcctgccaggaggccagcggggcacgggctgagggtgcaggatccggagggcgccgcccgcccctcgggcatcgcggggcccagggtccgcggggcctctgagctgaggcggtccaatgtaccctttgtccttcctcagattcattatgaaatccgaggcagtctgggcgactccagcggcgttcgcccgccgcagcctctcgaccgccggccacccgccagccacgcgcgcccagacaggagggcggccgggcgctcggcggggcggggcctgccgggggcggggcctgcgggcggggcggggccgcgggagggcggggccggcgcggcgagcgcaccagcagcatcctggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggaggtgagtgcgcccgccgtgcggagccgcgcctgctcccgcggcggtgcccgggccccggccgaggcgccggctgacgttgcccttcagggccgagcccggagcagcggccgccgcggaggcgcgtgagccaccccaggctcgtggggccgcgccgcctttccggcctcctgcccgcggccccgcttccctcggcagccggaggcctccggggtgcccgtgctgccgcagcttcctgtgtctgagtcgcgggcggcgcgggcgcggggctggtgcgcggccggggatgcgcgcgggaccgacccttgtgtgtgcggcggcggggaccggcccggcgaagcagccggaggccgcgcttcggctgggaggaggtggcccagctgggccgctgacgttgccctcgtccgcggcccccgcctgcccagaggccgggctcgcgggcgttcggaccgcgcgtggggcgagactgcactcgcgcccgctgagatgccggccccacgcagcgcggcggcacgaggcccacaggcagctcagaggccgctgccagaggcagacattctctcggtgactccagaggagtgcccgtggcccttgcacttggccgtggagtcattgatctaaggagtgctggcattttttgaaattgagaagcaaagatgatgtctgtcacctggcagcgtagacggagagtggcggtagatgacttgaatggacacgtggattcgagtctggggacaggcgttcccccagtcggtgcgttgtgagagtgtggaaaccccttccccactcagtccaatttcaaggttatggagcataattaagagtgaccattctaaaagcgttctctagtgccctggctaagacttttaagcttcttggtgcaggagtgtctaaagtcccgcgactctcactgccctgtcttttattttcttgacctttgattagcgttgagagaaactggttaaatcttgcagtttctgccacccatttcacaacttaacctgtgattgtcccaaagaaaacaattattggcttcttgctagcaaaaaaatcaaaggcttccggttgattgtttctttcttttttttcttttttcaagtggacgtggaaggttaggctggctaaaacttaaagtttgagttgtaggtctgtgctgggtaggcttgagaagatggagctttttaaggaaccattgctcgccatcagattggagccagacagtgcagtgtgatatagtggaaaaggaccaggtcttgggagacttactttcttgttctgactcaactcggaaaacacctccctagtctgaggcccccct

SEQ ID NO: 114118 - DNA, 1005 bp, Homo sapiens
gatgggattgggtggtggtgatcatgggggaagaagagtaggaaactagaggactcaagaatgacttctaggtatttgccctgaaaaaaaacagatggatcatggcgccatctattaagatgaaaaagacttaggtaggagccagtttgcggggaaaataaaaaattctgctttggagatgtgaagtttgagatgtctattactcatctaagtggagtttgcaagtaggcagtcagatatacatctcaggggagttcagggctgaagattcaaatttgggagatggatttttgtaaatctcccacctccttctcaggcattagtttaagataaggagagggtagaactgctccttgacttaccagaaatgaggagcagatgctatttgttcacttgtacttttgtccatccctcaaatatttatggagtactttcagtgctaggtactgtgctgacttttatggactggatgagcagatacaggtacagacaccgctctcattgagtttgacatccagggctgtgcagtagaaagtgagcctactacgtaagctgaattttctaatggccatgttgaaaaggtcaaaagaaagagatgaagttaattttaataatctattttatttaacccagtatatcaaaaattagtatcatttcaacatgtaatcaatataaaattactgagatattttatgttctttttctcatactgtcttcaaaatctgttgtgtctcttacacacagcacatctcaattcagacttagccgcatttcaagtgctcgatagcctggatctagaagatgctgtagaacttggctccctgatgtctaaacccctcccttctctcctgcccattggtgatctccagaccttcggggactgttgggagctccagtgtgctgtaaaatagtgaggtgtaaaccttgggcacacagccccagagcagaaccccagtccaccttgcccaaagtgccagcaatggcagcctgatgatagaggtgcca

SEQ ID NO: 114119 - DNA, 1120 bp, Homo sapiens
aggcagtgagctctggtggggggcgcctttagatgcaagaaggaggaaacagctcgaaatccctgggcctgagcgcggcccgtgcaggccggagggtcaagaactctccaccggcggcagcggcccggtgtctgccccggcttcgccccggcctaaggctgcctgtgctataaatacgcggcccacatgccgcggtgacacggtgttccctgggctcggcgggacagataacatgaatgtgccctttaaacgtcccaagttgcagggacagcccccggcccagcctcgctcccggaagcgccttcgcccccgatgccctctgcagctgggaggagggggcgccccgcacctgcccagccaatgcgcggcgcgagcgccggccgcgacccgcctcctctcgcgagagcccggcggggatataagggggagctgcgggccaggcggcggccccctagcgtcgcgcagggtcggggactgcgcggcggtgccaggccgggcgtgggcgagagcacgaacgggctgcctgcgggctgagagcgtcgagctgtcaccatgggtgatcacgcttggagcttcctaaaggacttcctggccgggggcgtcgccgctgccgtctccaagaccgcggtcgcccccatcgagagggtcaaactgctgctgcaggtgaggaccgcgcggtgcaagaggcgggcgcgggcgcggcgggccgggcggggcgcgcgatgcggcgcgagctgcagggcgcggggcgccgcggaaaatctgcgccaggccacaggcccgggcgcccgcccgcccgcccgcccgcccgcgggggaagaaggtgccctctgcgtagagacaggtccagcgtcagtcgcagattcctggtgtcgggtggcgcccggcgttcgggtgtctatatatggaaacccacccggagccggtttacgtgtgccagatcctgcgcccgtgacagcacgggcgtgcactcaggcccggaggcacctagtgattgccagtatttttggcaccgtcttatgcgcacgcacctttacaataaaaacatcaaaataatcatcacccaagaattcccttatcgtatctcatgcacaatgctgtatgtaggctgacgccttca

SEQ ID NO: 114120 - DNA, 1613 bp, Homo sapiens
ctccagggtgatcagagtgacactgagaaattgtcattttttggccatcatgtctattaaatccaaagccctttgaagcagggagtgttactcatttctgtcccccagtaagcccctcatacagttctcaaacctagggaaagtgaaataaataaatggctatagctttatataattcaatcaccttttcagtttatttggggcaataccttttccctcaaataccctaataattgaagcaacattggattattttggcttgttatccagtaactaacatggataacagtatccatttacacgtcctcagtatccatttgatttcctcatcctttttttcttcaaaaaaaaaatctaggaagtgcaaacctttttttttctcctgtcctcttcccttctctctaccctgcctgtcctctgtcacccaccctcccctccaccaggtccagcatgccagcaaacagatcagtgctgagaagcagtacaaagggatcattgattgtgtggtgagaatccctaaggagcagggcttcctctccttctggaggggtaacctggccaacgtgatccgttacttccccacccaagctctcaacttcgccttcaaggacaagtacaagcagctcttcttagggggtgtggatcggcataagcagttctggcgctactttgctggtaacctggcgtccggtggggccgctggggccacctccctttgctttgtctacccgctggactttgctaggaccaggttggctgctgatgtgggcaagggcgccgcccagcgtgagttccatggtctgggcgactgtatcatcaagatcttcaagtctgatggcctgagggggctctaccagggtttcaacgtctctgtccaaggcatcattatctatagagctgcctacttcggagtctatgatactgccaagggtgagagaggggcatcggggagaaggagggtggtgtggaaagaggatcctatgggatctataactcacaaaggacctgatatatattgatcttgttttttctagtctctgggataattgaggcttctgaatgaggaggtgatgtgcataagttaatagctgaagcgttccttgtgtcctctactgaaataaactctggcctttagttattcagagaggaggaggggggagcctgtctccctctagacacagccatagcagttactgagtttaacttgaagccacttccaatgccctgtatacaagctgagcactgcccctccggggtccggagagggcagcagccacctttgctgtctgcctggtcatatgtgaagcacctgcacaggggcaggttccccgcaaggtcagagcatggagctggaggtgcagtggcctctctccctccacctgctttctgctgagaacaggcacttcatagccgttcggcttctgggctctgtccacagggatgctgcctgaccccaagaacgtgcacatttttgtgagctggatgattgcccagagtgtgacggcagtcgcagggctggtgtcctacccctttgacactgttcgtcgtagaatgatgatgcagtccggccggaaagggggtaagcttgtgctctactcatctaaacttgtttg

SEQ ID NO: 114121 - DNA, 2197 bp, Homo sapiens
gtgccagagaaagttttggcttctataggttgaaccatacgaaattgccactttaaaagtcaaaaacagtccaatgttagcagtttcgtatgtttcaacgaatagttacagccttttatttagactgcataacctcgtgcaggatcatctgaggctcggcctcagttcggtcctccataaaaaaaggtaaccgcgtagcataatactcctgctccactgcgcccttcttgtttcgcagttgggcagtccatgaattacttggttaattgccccagttcttcactgaccttgaactaatggagtaggaatgacaggagacccagcctgccagtgaagcaaggaaggagatgtccagtgggatgttgcatggagctgggactccatgcccagatgaccctgattttataaaactggtaacagtgtgtacagatatgtttcaggggaaaagtctctttcctccagcgttacggagccctcaccagcatttgtttccacagccgatattatgtacacggggacagttgactgctggaggaagattgcaaaagacgaaggagccaaggccttcttcaaaggtgcctggtccaatgtgctgagaggcatgggcggtgcttttgtattggtgttgtatgatgagatcaaaaaatatgtctaatgtaattaaaacacaagttcacagatttacagtgaacttgatctacaagttcacagatccattgtgtggtttaatagactattcctaggggaagtaaaaagatctgggataaaaccagactgaaaggaatacctcagaagagatgcttcattgagtgttcattaaaccacacatgtattttgtatttattttacatttaaattcccacagcaaatagaaaataatttatcatacttgtacaattaactgaagaattgataataactgaatgtgaaacatcaataaagaccacttaatgcacgctttctattttattgaactcttattaactgtaaaatgcatttttaaaagatcaaaaatgcatattttctagcatgattcatgtatcagtcagcagccaagcttctaaatgccagatattatattgagaatgtattatatgagaacgtacaatgcttaaagttccggttttcaaacttaggcaggtcatattctatctatcttatccagcattactgtaggctagaaagtgataatggctttcataatcctgccttgtcttaggcactttcctgcagtctttagaaattctaagattctgctaaaagttttaaatcacaatctggagaattttctatgattaggaagtgctctgttttcatccctttagataactgtgacacctagaattttatgttaagtagagagtattcattgaaaatcaaggccaggtgcagtggctcacacctgtcaccccagcactttgggaggcagaggtgggcgtatcacttcaggccaggagtttgagaccagcctggccaaccgagcgaaaccccatctctaataaaaatacaaaaaattagctgggtgtggtggcgcacacctgtaatcccaactactcaggaggctgaggcatcagaatcacttgaacccgagaggcagaggttgcagtgagctgagatggcatgccaccacatccatcctaagcgacagggcaagactctgtctcaaaaaaaaaaaaaagaaagaaaatcagttgtcttagtttaagctactataacaaggtactgtagactgatggcttataagcaacagaaacttatttctcagttctgtagtctggaggtccaagatcaaggtgacactgtggtcaggttctgatgagggccctcttctgggttataaactacggacttcttgtatccttacatggcagaaagagcgacagagctctctgtagtcccttttataagctcactaatcccattcatgagggccctaccctcatgacccaattacctcccaaatgcccctcctccaaacaccaccactttgggggttaagatttcaacagatgaattttgaagggacacaaacattcagtccatagcatcacttatcaagctagtatttaatacctcttaggccccgtggaagggaaaatagataggaacctgccctgaaagatgcttcagttggggagaaaaggtgaaattccattgttagacaatttgtttaagacaatacatcttgcttgagaag

SEQ ID NO: 114122 - DNA, 1016 bp, Homo sapiens
attttttaacttccacagggaattctgaagtgcatcctagtcgagaatcatagcattagactattagacacacatagaatgtggaagaaaaactagtctggacttcaagtgaggagaagtttctcagatatttcttctttttatattttcaggagcttccaggacatccagtgctacgagtggtctcagttgtaggagtgagcgatcagcggttgacccctccagtggccaccctcgaagaagacctaaaccccctaatgtccgtacagcttggttataaaacacttttttactttaaacattgttcacacaacttttcttgaagtgctcgtgcatattcctataattctctgtgtaaacatctagaataccgttttagcaattgaaggtgtacaacagtgagttgtaatgtattgttattcagtgcaaaattattgtcaaaaaacgatttaatgtaaaaagtgtttcctgaggatgtatttatatgagatgtatgtgttcttaatagagaaatagtggtatgcatgtgtatcttctaattattcagttgtcatgctgtcaaaatagtagtgatagtatcattgcatgtcgtacccaagatggtcactatagttttcaatttgtgttattttcatttctttataagtgttataccatgagctcagctcctaaatttggctggctttgtttttcatttgctttagaacttatgtggcatgacatagctcgattgtatgagatttaacacttattatgaaacaaatcttgaaatttgttttcactggtagagctgatctagatttgatgagcagattgagagacgcttctattggagcaattcttgtaattcaccagaggtatctagttgttgtataagtgcactgagttagatcttaaaagtttgatcaatcattccaaaccatttcaaatatgaatattagaaagttcaacttagaagcttcccttttgtgttttcatgcattcaggtaaagtcctatttatgactcttagaaatg

SEQ ID NO: 114123 - DNA, 1062 bp, Homo sapiens
ggcttttagcagcctgaagccatggtttttagtttctgtctctagtgatatgcagaaaagagagatgaggaaggggctttactggcccaaccagaaacagaaactaagaacccatgactgtattctctccattggacacctctggatgaattgttatatcacagtggtttggttagctgtgggataggcaaaaacccttggatttttatgaaattatattatttgaaatgtttttcacatggtatgtcgagaatgatttaagatcttttggcgggatgtggtgggtggcacctgtaataccagctacttgagaggctgagatgggaggatcctttaagcccaggagttccaggccagcctgagtgacagagtaagatcttgtctcttaaaaaaaaaaagaaagaaagtgaatgtcaggctctagaatgtattgccttgttaaaaatgattgctgtttaaccttgcctttcaaattaattgtctttattgaaggctttattgaaaaggcttgaggccgtgaaaccaacagttggtatgaaacgttcagaacaactgatggactatcatcgcaatatgggctatctcaactcatcaccattgtcaagacgggccagatccactcttggccaatatagcccattaagtaagcattttggaaattattttatacttatttgtatcttgtatcctttttttaaaaaaacgtaacatgttattatgatagagttttaaatgccaactctggaatgcgttctgttatttcccactgtcatgttttgttttatttgtattagttcacttaatttcaggtttcatttacagcatataatgacaggaaggaaaccaggagataaaacaatcaaaaatatcagtaggttcttaggtaattgaggaaggactgttaatttcaaagtttattgaaggaagaaatacataggtgtgctgtttaaaagctgctaaaacattctccttaggtagttaagaatcattgctaatagcctccagcccttatatgtgctttttcttacttactggataactaaaacaaaaattagcaagctg

SEQ ID NO: 114124 - DNA, 1029 bp, Homo sapiens
agtttctgcatgtaaacttgataattgatgtatcagactccagaatgggtttactttttgcattattgttgattttgatcacatctgtatgttttatatgtgatgaataagtattgtaattttcttaaaatttgtaaaagaaaaatactcatccaaccaaataaataaacttaggacactaggagtttaatagacattgagacgtctaccagcaaaaaagcaaaaatgaaagataactgaaaatgccaggtcttctgtcttgtcctttccaccctgcacagctcagtgtgtagttaataggataatcagacaaaacagcaaatgcactctgctggtagaatacactggagatgtggccccaggaagttcctgcacagttacaaactgcaggtagagaagatatgatttcaggaggtttggacacctacatcacactgcttctctgtccacaatgcaagaaagaggatatgatgggaagaccgtggactttacagtcaggtggaatcatgttgaaataaaaactcagctcagcaaagggaaccactaatactagttgggtaatttgagtaggtgactcttttctagcttttgaaggccaaaaattaggaaggggcacttcacgcagaaggaatagcatgcagggaggcagtaaagatgttctcagtggttctgtccggttcttcatgtgttttgcacctctgctgtttgcctccaagcctccttttgtttctataacaacctcctcctctcccttttctaagtggcccttcccctggatatcttggcttattcttccaccatctgttccttctttggaattgctcaggaactcagcatggaagggcagggggtgaaactgataaaacaccaagtggaagaaaagttatgggagtcggtggtgatgtttcacaacagtgtgggtgtacaaaatgccacagaactgtatgcttagaagtggttaaaatgtggtttcattttaccacagtaaaaggaagaaagaagaaaagattgtacagagaaaacttgtcc

SEQ ID NO: 114125 - DNA, 1855 bp, Homo sapiens
tgagtagccgagattacaggtgcacaccgccaagccaggccaattttttgtattttagtagggatagggtttcaccatgttgtccaggctgatctcgaactcctgacctcaggcaatccacctgcctcagcctcccaaagtgctgggattacaggctgagccaccgcgcctggcctcagtgtgtccctttttagtacatacttaacctgaaacattcagcaagtttaatacttttggatgttttctacaaatgtttagtagtaattgcacttattgataattataatatggaaatttaagaaataagcatgttgataaaaattatagtatgcaaaatattgttgctagctaaaaacacctttctgtttaatcaggaataaaatgtttgacttttacagtagaagtatttgctttaatggcaatattaagatttataaatccagcatcttttctggttaagttgagagttttggaatattcggagttactttttgccattgtttccctcagtcattgctgaggacatttttttggaagtatgccctccaactaagaaaagctgtacctaaattaagtattgtattagtgccctcaactctgaggtttctaacctttccagctattaaactgcagtcgggaaggataaaattgatataacaaaggcattgtctgtaaattatactagcctaaagaccagtactatatacatttttaaagatactttcattgtttcgtgtgtagcttttatgcccaaggaacccggtgagcataaaatactaagctacgtccaatttttttctacaaagttgtaatctagatgtcattagtattatttcatacatactttttcttgaatttaatacatatttttaagggttaaagcatgtaccaccgggccaggcacagtggctcacacctgcaatcccagcactttgggaggctgaggtgggtggatcacctgaggtcaggagttcgagaccagcctgggcaacatggtgaaaccctgtccctactaaaaatacaaaaattagccaggcatggtggtggatgcctgtaatcccagctagtctggaggctgaggcaggagaatcgcttgaacccaggaggcggaggttgcagtgagctaagattgtcccattgcactccagtctgggtaacaagagtgaaactccgtctaaaaagagaaaaaaaaaaaaagcatgtaccacatacttactttggccattttctcttttttttttgttcttttctgtagcttttctgcaattagataaaaaaggaccacaaaaacatcactttgatcagccttcagtagcacccgggaaaaactactctttcacaagagaagaggtgagacagatcgatcgggaaaatcagaggcttttgaaagaactgtcaagacaggcggaaaagccgggaagcaaaagtacaattcctagatcggctgatcatcccccaaagttatatcacagtgctctcaacagacagaaggaacaacaaaggattgagagagaaaacttggtaagtaactgaaataattagtcatcaaagaaaatgtgtttgcactgatttgtatgtccagcttacaggaaacctaaatacagccaaatattcaaacttcattacataaaagcaggtgcggtatgtgtggtatgaaacatatgatgtgctgtaagtccggaggatacgatatgtatttttatccaggaaactatatattaagagaccactggccagatgcagtgggtcacgcatataattctagcactctgggaggccgaggtgggcagatcgcttgaggcaaggagtttgagaccagattgcacaatctggcaaaaccccagctctaccaaaa

SEQ ID NO: 114126 - DNA, 1036 bp, Homo sapiens
tgtttttataatgtttctttttatatattaaacacacttgtcagtttgggaaaattatttaattattgtatacaaatggaaagtatttggaaatcactctttagtctgatgtttacatttttttttcagatatatttttgccatcatggatcagtttggagatatattagaaggtgaagtggaccattctttctttgacagtgactttgaagaaggaaagaaatgtgaaactaactcagtttttgacaagcaaaatgatgacccaaaggaaagaatagataaagatacaaaaaatgtaaattcgaacactggaatgcaaacaacagaaaattatcttactgagaagggaaatgaaagaaacgtgaaatttcccccagaacaccccgtagagaatgatgttacacaaactgtaagttctttctcattgccagcctcttcaagatcaaaaaaattgtgtgatgttacaacaggacttaaaatacacgtgtccattccaaatagaattcccaaaattgtaaaagaaggtgaagatgattactacacagatggagaggaaagcagtgatgatgggaagaaataccatgtgaagtccaagtccgctaaaccatctactaacgttaaaaaaagcataaggaaaaagtattgcaaagttagctcctcttcctcctcctctttatcttcctcatcttcaggttcaggtacagattgtttagatgcagggtctgatagccatctatctgattcgtctccgtcatctaagtcatctaagaaacatgtatctggtataaccctcctgtcaccaaaacacaagtataaatcaggaataaaatcgacagaaacacagccttcaagtactacaccaaaatgtggccactaccctgaggagtctgaagatactgtgactgacgtaagtcccttatcaactccagacattagccctcttcagtcttttgaactgggcatagcaaatgatcaaaaagtgaaaattaaaaagcaagaaaatgtgagccaagaaatatatgaagatgttgaggat

SEQ ID NO: 114127 - DNA, 1185 bp, Homo sapiens
tgattgtgagttagtaaaattactcttttgttatgtttaagatctcttcatttcttcagtgtaatcatccatctcttatagctaaataattttgtgatttcagtttcttcaaatttcaagaaaatgtttattttttatatttgtaatttaagctacatgtctttttttttttttttttttttaattaagagggagtctcgctctattgcccaggatggagtgcagtggcaaaatatcagctcactgcaacctctgcctcctggattcaagcaattctcctgcctcagcttcttgagtagctgggattacaggcgcctgccaccacacccagctaatctttgtatttttgtaaagataaggtttcaccacgttggccaggctggttttgaactcctgacctcaaataatccattcacctcagcttcccaaaatgctgggattacaggcgcaacccactgcgcttggccttaaactacatttcttcaactctggttcctgatttattgtagtgaggccttaatctattagcagagttttcctagactctgtcatattacctatgacacttgacactgtctaataccacccaaagtttaacctttcattccatctttatgtatcatagtacattaccttttgatgaaagctttttatctccatagatcagtggcatttccaacccttgcctgagactctcaggaatgtgaagctggttttacatcaaggcctagtacactcaatgcatttaagtaatagaaatgatggtttcatgaaacttactcttataatatgtaatgcactcttttttttttttttttgagacggactatccttctgtcccccaggctggaagcatgatctcagctcactgcaacctccgcctgccaggttcaagtgattctcctgcctcagcctcccgagtagctgggattataggcacgtgccaccacacccagctaattttttatatttttggtagagacagggtttcatcatgttggccaggctggtcttgaactcctacctcaagtgatctgcccacctcggcctcccaaagtgctgggattacaggcgtgagccactgcacctggcctataatgcactcttgattattacactgtgttctacttcgtcagtttaatgatggacatgagctactgaattgattttaaactggattgtgac

SEQ ID NO: 114128 - DNA, 1064 bp, Homo sapiens
gtgaggttaaaccatgtgctcaggctataaaatcagtgaaaaaactaagaattaaacccacgtctctcttaattaactctggagtctacacacttaaacactttattacccttttaattattaaaaattagtctggcctgattcagatttaaaacaacttgggaagctttgggatgattctaggatctgcttaggacttaatgtcacttcagaggtctcagaatgaacttgaatgatgtcacagctgtcccttctgtgctcaggaggatctttactaatcaagtaaggcacctggttgtgactgcagactctctctcaatacagcattccaggcagccgctgaaaattcaccgagttggcacatagcgtgaaacccatcaggcattttgagtgagaacctagtagaatggcggtggtgccttttggattctgcgatcactttttctgcggctgtattactctgtcatcactgcattataacagccaggcatatacttttttagtctctctggtaaaaatcagtgtttcccaaactgtgattcattaacacttagttctgggagatgcttttaggtacactgcaaaaacaaagaagaggaagcttgggaggctagtttggtggtcacataagtctgaaaaaactaaattttttgttgttgtttgtttgagacagggtctcactgtgttgcccaggctggggtgcagtggcacaattatagctcactgtagccttgacctcctggactaaagcagtcctcccacctcaacctcctgagtagataggattacaggcatgtgccaccacgccctgctaatttttaaactttttgtagagacaaggtctcactatgttgcccgggctggtcttgaactcctgggctcaagtgatcctcctaccttggcctcccaaagtgctgggattacaggcatgagccaccacactgtgccttggaaaaactaattcttaaagctttacaacatgtgttattaaattaacattgtaagaaatcctactgtaaagaaatctgcttagctttttaatccaatgttttgtaaacatgact

SEQ ID NO: 114129 - DNA, 1297 bp, Homo sapiens
aaaatactgagtgtaaacagccagatgcaaagttgtatgtataccatgatcccaatttcttttaaaaagtatacagatgaaaaagttaccaataatttattgttgtcagacattgttacagtacttggtgtgtgttaattaatgctcatatcaattttgtgaggtaggtactattgttatctattttacgtatgaggaaagtgaggtatggaaaagtaacttgcccaaggttacatagtaagtgttggaatcactgacaagaaggaaatgtaccaaaatgttattagtgatcatctggatcatcattatgagtcagtttaattccttacatctataatagagaatgtatttctgctgtttatgtaattggaaataacagtttaaaaagaaattatagcatttttgaaatttaggaaaacagtaatatgagaaaacttgtaggttgaattttaaagaatagctgctccttcctgtatctaaagtagaaattgtgcttgactaagagggaaaaaaaggcacaaatccactattttctattaatacactctccctaaatgataacctctcagtatcatgttaacaattttctgttttttttgataaggaaagtaagatattctttagttcatggttcagcacaataaaagcacaactcaggaaactgtcaaaccaggttttgtttggatacttaaatgctttacgtcacagcaaaacatctccagggaatgtgcgctttcctctctgtaaagcacatcctcaaaggcaaaaatacttcaagaattatgtgctctgttatgctgtgtcttactggttgcttaacttttcaacccctccgtgcttttatttctgccattcctgtgcctttagaaaacccctcaatcaacccactttggatttgttggaagttggtaaacattttgagttgtatttgtgatactgtctggtgggcgctctaagagctttgtgagagcagccattacagactagacgcccacggcttgaacatggctcaaagtttagcccaaacagtggcagcctgcagagtttgtaataacgttgaattagttggagatatcgtccaaaattcatgacttttttttttggtgttgttgttggaaaaaaaaaaatcaggccgggtatggttggttgctcgtgcctgtaatcccagcactttgggaggccgaggtgggcggatcacctgaggtcaggagttcgagaccagcctggccaacatggagaaaccccgtctctactataaatacaaaaattagccgggcgtggtggcacgtacctgtag

SEQ ID NO: 114130 - DNA, 1189 bp, Homo sapiens
agctaaacaaaaggagagctagtagctgctagaaagttagttattgggagtaaaattcatgcatttggcagtagttcttcaacagcaataacaacaacaaacaaaactagaatcaccttccaagaaaaatttgaccagttaattttatggagaattagaatctagaaatgtatattgagaaggctaagaggtttcatcagcatgtagaaaatctttagtggttataatttgcatctctggagtggtttgatttacatttctaaacccggcaccaatatatttaattggaattcagaatgttattaactagctataatagatttaatattaatcaaattgagggtctctgtacatttgcaaaacattaaacaatatacttgttaaggctgtagtaatttgagttcggttatactaaatgcttatgaaatacttacctaaaaatctcctccttggaagctaatttaaactagagaacattatggtaccattttatctttatatatctattttattggttttagagtgtgtaatttaaaaacatttaaagagttaagtaccacataaggcatgtgtgtgtgtctgcatgtatacatgttctacatgtttgtgtgtagatatttttgtcactaaatttgtgcttgtgttgtagctcagtataagttaggatttaagtctttacagattgaattacaaagaagaaagaagtaatagtcaaaaatgcagagcaaaataatatactccagctttctgtggaacaatatgaaatactagagctacaaatgctggaagttaaatggcacacttgaggaaagtgatcaaagcatatgactgctctgttttgttagccagtttaaaatgtaaaactatattttaggggttcagatctaatatgaatgaactcttctttttgagaaggcagaacagttacccttctgtaccagatagcttcagaagattctccaaaagctacatttaccagaaaactgacagaagataggaaaaagacgacttctaaaaatctttttgacttactattaaatctcaatagatctattgcctaattttcactagcctgccctaaaccatctctaatgtgaaccagataatttaattgtataattattgagtacatgctatttgttcagtggtgtgttcaatgttaaattgaaagttcttgaattgaaaatat

SEQ ID NO: 114131 - DNA, 1102 bp, Homo sapiens
aggctttcttgaatcactatcaagatactatgggaagggaagtatagaaagttctgttttccagtcctcttcactcagatcctccaaattaatgttcctgggatggagtcagtacagggaagtgcacaaccaaggttgtcaagactggttgaaaaatactttggagcctcacagaaggcaatttgccatcaaattagataacgtcgagtttatagaccctctagctcactagaaatacctgtagactttttatcctattatctcccagtcagaaagcaggctggcaaccctggtttatgctttgttaggtttttttgaaaaatgaagctgcaggtcatatttaagaaaacatctagaagacttaaaaattactaaataaatactcgtacctttttagattgttgctgtgattttggagttatatagaccctttgatgctactgaagttcgttgttatgatttcatttgaaatccaaaaaaggccatgcatttgcatttattctagcaaaagttttccagatgagttgatggttgaggaaatttgattatttaggagatggcagttactataaccaatgtgtttctcatttgaaatattttttacctaatagtacataattgaattgtttctagaaacttctttccttctttttcactctctttatttagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaaggtagacttatacagttgatttcactaattcaataagtgtgcaaactaatgtgctacatgcagaccttgtttactgttgaacatatgggatttgaagtattttcaaaatcttgtttatatgtctctaaaactatttggccattcaggataaacttaaatttttaatatgacatatcgccaaatgcacagtccattaagttgcatgttttgacatagaaaacaagtttttatgctcttcacagggaagcattcatttgggat

SEQ ID NO: 114132 - DNA, 1019 bp, Homo sapiens
atcctcagcaaactaacacaggaacagaaaaccaaacaccacatgttctcactcgtaagtgggagctgaacaatgagaacacatggacacagggaggggaacaacacacaccagggcctattgggggtgggggcaaggggagagaacttagaggactggtcaataggtacagcaaaccaccacagcacatatatacctatgtaacaaacctgtacatttacttaaataaataaatagtaaattactacaataaaattttactttattcctttaaaaaatgcatttttaccctaaatgtagaaatcagtccattggaagttaaagcaaactgacatttaaaattcgattttaaaaaaagttttcttaaattctcttaatagattcttcagtttgaagatatcttggccaatacgttctaccgagagcactttggaatgtacatggaaaggatggacaaaagagctctgattagtttttgggaatctgtggaacatttaaagaatgctaacaaggtagtatatgtaggctgaaaggaatattaatcactagctgatgtaaacttggcatgtgaggcagcatgtctgtttttctcaagataagtatacattaaaaatattttaaaccaaatataatactgacattatgttctagcccataatggcaaataaaattacattatatttttacagaagattcttttgaatgtgtagtcaagggaaaaaaggttttataaatgtaccaagagattgaatttagttttgggtattttttttacacattgtaaaaagacatatacatatccacattactattataatgaatttggccccctcacctacacttcagtctcataatcttgccatttataatatcataatgtgcatgttttatactttgcctttcatttcaattttttttttttttttttgagacggagccttactcttttacccaggctggagtgcagtggggcgatctcggctcactgcaacctcagcctcccaggttcaagcggttct

SEQ ID NO: 114133 - DNA, 1022 bp, Homo sapiens
gacaaagctgtctaatataagcttgactaggacataatcattctgaagtagtcattctgaagagtgtttttctcgtttttctgagttacacaattattatattgacttctttctgggatgagaaatggcacttctagttacttatattaggtaaaaagttaaattgacattagctaatacattttcttcttgtggaattgagatttatgaaaaggaatctattgcaggaagagaactgttcttattctgtttttgccccctccagtgtttaaaataaattgcaggtgttaactgttcaacatgttcatttaaagaattagtttttttttttttaggatctgacatttgctccttgaccctgaatatggacacaaaattctacataccagggtgcatcttaaatgtctttcttctgactttcaaatgcaaataattcagagaaaaataatttctctcagagatgatatgtcttacttttccttatcttcctgtcttttcagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatggtgagtcacatttaactttctgctcctttttattggataagcttttaaatatgtttaagtgggtgcatattgtgtgagccaaatttgatgcacatcttcatcttttaatatacaggaccttaaatagaataaaagtagcatcgtttaatatacaagaccttaaatagaataaaaagtaagcatcaataaccttgtctctggttgtatgtatttctttcttccccttttatcctctgacatacatcttcc

SEQ ID NO: 114134 - DNA, 1099 bp, Homo sapiens
gaacaagttccattgttatttttttgcttctaggatagaattagaaaagcatttgtttttaatctcttatggtttggagttctttctcagtttcaactgtgagcaactctgttctttacatctgctttgcctacagggcctttggagaaggggcaaagctttctcttgtgccagggtcatttctggaatttaattaaatactcaaggacaatcttttgaataaaaaaagatgttttctttcaactgctgcaggtgcaatttagggaaccttacagtattgttcaggaaatacattgttttgctagaaagcagcaatttgaaagtttaaaaatgtaaacagcatttcactaattggcctttctcaaacccaagctgtggtgtggctttttgctttgtgttttgctctttagaattcaacaaggaggtttctctcatatagatatggctgatgctctttgatctgccagattggtctctggcactttctgaatgtgtgtttgaggatttcaagcggtcaacatgaaagcaacttagaataaagcaatttcagtgactcacattgggttttctgtgagcaggtgcccaatcctattgagtcttctttagtattctttttgtggacattcaaatgcttttatagtaggagaatattcctgaaacaagatgtaagaaaaactggtatcatgagcctatcagcaatttacaattaaaatatctattcatctataatccagttactgtctagttaaacagtgagttttctttaacaaagaaaaagcaaaaaagaagaaggaagaaagtcctgcaaaggtgtgttgtcttggttagtagtaatgtttttacaaaattgtgtaggaagaagtttaatgtgagcatcactttaataattgttagtgatgggctggctgcacaatggctcatgcctgtaatctttgggaagccgagatgggtggatcgcttgagcccaggagtttgagaccagcctgggcaacatagggagaccccatttctagtaaaaataaaaaaaaaaatcagcccagcatggtagtggatgctggtagtccccagctactaggtaggctgagaaaggaagatctct

SEQ ID NO: 114135 - DNA, 1050 bp, Homo sapiens
tttattgctgaaatgcatcagacatgtatttatattcatgcatccattcattcaacatagccttttaagagccaacccaggccgggcacggtggctcacgcctgtaatcccagcactttgggaggccaaggcgggtggatcatgaagtcaagagatcaagaccatcctgaccaacatggtgaaaccccgtttctactaaaaatacaaaaattagccgggcatggtggcgcatgcctgtaatcccagctacttgggaagctgaggtgggagaattgcttgaacccaggaggtggaggttgcagtgagccaagatcgcaccactgcactccagcctgggtaacagcgagactccgtctcaaaaaaaaaaaaaaaaagagccaaccagatactatgctatatatacaaccccaagacagatatcatctctgtcctaacgtaacatagcgtcctgatttactctgccccatgttcctctgactacagaaggttagaatccttcacgttgctttttatgtgacttggcatagcttccattgccttgtcactaaaagttatacagaaaactgttttgcttagcacagaagaatcctgttgttaaaggtgagtgttggtgttaggataattccatggccaaggacgtgggaatgcctccaccctatttttcagctaccttttttcctcttgagcagtagttcttcatggagggaaggagggacatatggtgatgtctgaaaatgtttttgattgtcttaacttggagtgaggggtgctactggcatctagcaggtagagtctgggatactgctaaacattctactgtgctcaggacagccccgcggcagagttgtcctgcccccaatgacagtaatgctggagttgagaaatcctaccctagtgaatcctcaaggagagatgtacgtagaagaaaccattgtaaaatggggatcaaagttccatttccttaagagctatacaagtgcctctccctgaaagcatcaccttggtgaaaggtaaactggactccatggcttagtgttgagcgttgaatag

SEQ ID NO: 114136 - DNA, 1463 bp, Homo sapiens
ttgcagtaactacaatttcacatgctagaattgcttcaaaagcatcagacaggtttcagctgatagaaagtcagatctaaatcagtagaaaataacttagatgatgacctttattaagagtcgcttcctaatctcaagttgtaaactgaaattttaggaagctaggcaggcaggtcagcagattctctcttaaaccacaagttctgttaaatcaataaacttattttatatggtctagatttgaattgcacagttccaagaaagagaagagtctaggagatacgcagttatagatggagataacagtgtagtttgactcatagcagtgaccgactactatgtgcaaagtactggacttgaaacatctactgcagatgttatttctgaaaccttgtgttgtccatttaaaattctggttggaagtcagattcttaaaaggctttttaatatattattattcatgaattgaatttgaaatttgaggtctttctggcacaaatagtctaagatgattcttttccccttttcaatggagaggcttttctcctcccaacctcacaactactcttgggctctttgaactgtgtgtagtagtctcttgacagcagaggacctgtaactggttagaatgtgaccaatgactggccgggtgcggtggctcacgcctgtaatcccagcactttgggaggccgaggtgggccaatcctgacacagtgaaaccccagctctactaaaaatacaaaaaattagctgggcatggtggcacacgcctgtagtcccagatactcgggaggctgaggcaggagaatcgcttgaacccaggaggcagaggttgcagtgagccgagattgtgccactgcactccagcctgggcaacagagcgagactccgtctcaaaaaaaaaataatatatatatatatatatatatagaatctgtctaatgactaacgaaatggggttgtgtagaagacctgggtaaccaaataaaatgcataactgtgcaagtcaaatggctgccacccagtcttcattcttggggaattttgaaattggccacatagcagtgtatttttgaaagggactatctttttccttgcctcatgggcatatgaagtgcttcatctggatccgagtatcctgcccagcattctctgccatagcaacactaaaagacagctacggaaagcctgctcctcctgcggaacttcaggacctcagggaggttttccagaccacttccaacagtctttaaatggatttatgttttcaccttataccacttcatggaaatgctgcagtctgcagacaaatcagtctctcagttcttgtctttatagattgaacacagccaacatttggagaagttagtgccaatgacaaaattatctccaggaataactgctcatgcagtattaccaaaataaaaaaatgggccaggcacggtagctcatgcctctaatcc

SEQ ID NO: 114137 - DNA, 1673 bp, Homo sapiens
tttattttgaataaacccttggagaaaaacatttttccacttttttccttctttgttggttcaggcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctctatgatatttaagatacttatatctcaaagaggttgaaactctacaggctgttcaaatatttatcaaatgcctttttagagaaaacactatgtacttaactacttctgcagggaagtaaaagtttgctgccttctccagaaacaaaataaatctgtaaaatatatgatttttagtgagcagaaagagccaaattagtgcttgaagtgaggcattagggaggagagatgggagctgacccttggagtatgggcagggccgagatgggggagcggaaagaggagggcagctacttcaggggctcggttgtattatcaagccgtttagaccacagggacattaggggagatccagagtacagactttgtgttattgatagtggggccatgcacaagtacttaattttcctgggtttcaccatctattatgcagtaataaaataccttcccctgtctaatccccaagaatattgaaaacaaaacaattaaacaagtaacaggtaaaaattccatttgaatccctgaaagatactcccctcatgccctaggatgtaacctatgccagtttatatacgtatgatatacatatcatacctgctaacttcttgataagaaacaagttctgaaagataaatgattaaaaattagtaaaccaaatgttatccttaagatttttttagttatagcttttttatccttttttcaaaccatgatgatatttgacacttaaaaaaatacccaaagttggctattgataaaaattatccttcaaaagactatatagaaaagaccagataaaatacattcaaggaagagaggcaatgtgaagttgtcaagcctgaagaacttatcacaatacaattatgggaaatgtctattttaggcataattctatgctatcatttaaactgtagctgttaagtttacattgcgaatgagaaagatcactattattttgtctctatatttatttatgataaaatgtcatttttccatgagatatcagctacaaggaatct

SEQ ID NO: 114138 - DNA, 1101 bp, Homo sapiens
aaagaaacactcggctggagctttggtttctaagcagatccttctggaaagacgcttagggagagtctagggagcagctctgacgtcagtagctgccatcggaagtcaggtcatgttctacaaaaagcagtgacgcacgcccgacagcacccgcggggccggacagcggcttcaccagccccgcgggtccgaatcgcacgcggccgggtccgctctcccgggaggagagcccggcgtggaccagcgtgacgaccccagcgtgctgcggcctctccccgagggcccctccacaagggtccctgcgcgggccgggctcggccgttgccactcgggacagccatcccctcgagttcgcgctcgccgtccccgccttcacctcccgggttgggaggcgggcgactgcgcgcgaggtaaaggaacttgcgttccccggcgccgaggcggcagcagcgcagtgcacagcggcttctgaaggcggcgtcgacggggagctgcgcgtggctcccagtttcctggttacgtgcgcgccggcagagccaaaacctgcagccgaaactcccgcttctccgtaaggattaaagggcgggcgcactaccgggagacgtgtcaaactcagcgcgcctcatggcggccgcggagccccacccgctcctactccagtcctctcacgcccactgacttaccctgcgcacgcgcgctgaggctccgtggggccgccgcgggccccgccccgaggtgggagggcctgacgcatccacagctggccaatcggcggatggcctcgcgcgcccgccccctccccctgcccccggcgccgggctccacgtgccagtgtttgtgtacgtgcggccgtggcggggctggacagggtccgggtcgttgaggattaggctgctcgggcgtaaccggagctggggcgcggctgccaagggccggcccggaagtcccagcggtctttaaattctcccgtgctagggccagcctgcgcattcttacctgtcggggtgcggcgagtgtctcacctctctgcacttccaaggactcttgtcatctgccttaggcgggaaatgctgttgctggattgcaaccccgaggtgagat

SEQ ID NO: 114139 - DNA, 1057 bp, Homo sapiens
tcagatcctgagcaatcagaggtgcaattttgttcattatgactgtattctacttcagtttcggttcaggaaaacccattctatagttcccattgactacctttgggtactcatacactgtattaaacatcagataattctaacattcattcagaactggaatgcccgctctatgctggattctgttagttgctgaggatacaatagtgaccaaaaatgcaatttccttatgcatcctttacctcttctgttctgcaaccaacatttgtatgagcccaaaattcccttgtaagatataaaaaaaaagacttaagttcaatgtttcatttcactccgtttttatcctgttttcagtttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctggtaagtaactcagagctgctgcttttttcctcccgcagtgatctcttgtttgcatagcatttattattccatttaatactgacactcgtatttctagtagtattgtttcattctcattaacattttagtactggttatacttaccagagtctagagaccaaaaatgggactgcatggtggaagtttggggataaaactctttttaaaaaaaagtttttaatgttaacgtgtttttaaaaacagatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaatacattctccgtgcagtatttacaacctttg

SEQ ID NO: 114140 - DNA, 1016 bp, Homo sapiens
taacagtctaactctaagaacattaaacataattcgggagcatatatagaatatgtacttctatcctaagttaatattttactgtgtttcttctctgtatatagatttatgtggtccagggcatatatggctatcatcattatatgcaggatcgcatagatgacaatggctggggctgtgcttatcgatctctgcagactatctgctcttggttcaaacatcagggatacacagagaggtccattccaacacacagagaaattcagcaggtacagaacataccgttttaaattataatcaactgtatgtttcattagcccttaatataccattgataatttttgttacctcatggtgcagacttatttctgttttgaagaaaaaaaaattcttgtactggtaatcagggaaaatgccctaaacatcgtttttaatagctgtcttgtgtatggatgttttatatttttaaatacatcaaggctctagtcgatgccggggacaaaccagcaacatttgtcggatcgcggcaatggattggatctattgaggtgcagctggtactaaaccaattgatcggtataacgtcaaaaatcctgtttgtcaggtaagcacactttaagaaattagataaatcatttcaaagtgacagtctgtcattttaattaaaataatagaaaaaatggtatcttcccttatttctttttattccttttccttcttccttattactcattgctttataaatctcattttttaatcttaattttttttcatttttttttggaaggctctgattttatgaataaactttgtgatgtaatgtatacttgtattatttaggcctaattttagcctagaagaggaaaacttaaaaatatattaacgttgagtaaagtcataaaaattatattaacagtttctttatgctccaatcttttaaaaagtcttaaaaggcaaaactcaaatgttgaactatgactgacctttttgtttacctcctgctctttttctttcta

SEQ ID NO: 114141 - DNA, 1048 bp, Homo sapiens
taacatttgatcggtgaatatagcacatgtaaagctcagagaaaaccatggaaaagtttatggctaactcctcctctaatctttccgtcaatctcgtcgtgggtaaagatgcctttattaacagtagtgatgctgttggtttcgctcactaatggctttcttgtgcgctgtgtggctgtgtattttgtctgccattgtacaggaattcaaacccattggtaccgcgcacaacagaagggcccagccttttgttgcagctgcaaacattgatgacaaaagacaggtagtgagcgcttcctataactcgccaattgggctctattcaactagcaatatacaagatgcgcttcacggacagctgcggggtctcattcctagctcacctcaaaagtaagtatccggctctgttctggccacagtgtacctaacagtgatagcatggtttcttttcttttcaaaagtccagctcttgctgttttatttttactttcctgaaggcactatcagatttctcttttaaagacaagcatctaaaacatgttctaattgttgtggggtccaatccgccagtgcctgaccgtttagcggatagatggttggaaagaagacatcgtcctggtcccgtcatcgcctttcttagttatgacagtagttggtggtaaatgatcctccctgtacaactatcgttcgtttaatcttatctgcaacagtgtccgccttccactgagggcctttttaacgctttgttttcacaggacgggaactactttgaacacaagcataatattcggcccaaacctttcgtgatcccgggccgaagcaggtcataagcgctgagactgtggagtttgcagtgcatgcttcttaaatcagttcttactaatcatcaagaaaagtaactggtagatgtttggagtggcttttctcattgcgaagcttatttcaaaagcaaaaagaaacaaactcacttggcagagaacagaagccaaataacttgcatttccaagagtaaatattgacaagatgacagagctgtgaaattgtatgc

SEQ ID NO: 114142 - DNA, 1013 bp, Homo sapiens
acaggagcacatagatagactatgtcagcgaatgggtttggtggtagtggttttgagattgtataaatggcacttcctaatacagaaccttagctgtattagagccctaaatttttacttatgtgcagaggctctcatttcacattcaaaagactgaatgtgagggtgagctattgtttgaagtctgtcaccttttttccaaaggaaaatgttttaggatcattctgaacatagaaggaaaacatttcagtgatggactaatttcatgctgtggttgtcattaaatctctttccaaggccagtcattaattttgttaaaataattttttaaaaatagtatctttaggttaaataccagcggaactgtcagcctgcaagtctcagagatggatgctttgtgaagtgctacaaaaggatgatccttcccacatcctcatgaatttacgtcacttttgtggaagaacaaggctcaagacagtcaatgccaaagatcatcctgtctccaggctctgctgaacctgccgatcggtgggaaatgacgggagacaatgagtccactgagaggtgatggagaatggcaggcactgagctaagataccttaaatgtgatgcttctcatgctgacggccaactgaaaacaatctcatcattacttcttattatgatatacattttaatttgtttttctcctcaatctgggtatagctgctatgcaaatatgtcttttaaatgtttggatagaggccacgcccatgatgttaaaagttagcaatcagtatttatgtaacttcgtaggtcttgtgagagggcgcaaatctgaatgcatacatcttactaattaagctcattgaagacatgcaataaaccacactcaagatgcagttacctttaattttggtggattgatctcctgttgataagaatatttagggaggagaggaggtgagcagggctgagaaagtgtagagtccaggtcagaaacagaggcgaagagagaatgaaatggaggggag

SEQ ID NO: 114143 - DNA, 1035 bp, Homo sapiens
tacattaacatgatagagtatgttcttaccttatttgagctcaagctgtgaatcctatcactagaatagctgtggggtattggagggtcagggtagtcctcagcaccttttgtgttcttcttgacgacctccacataggaaacagggaagatgccttgtctgttggttcctgggattttaccttcataccagttttgatcaactcttttaagaagaataactctatctccctgttatgaatatgagaaaaatgcattagaaacagagatagaataacatgaaaatataattgtcaatgttttctatgaaaaaataggtttccatttgggcaggttttataccttcagtttttgtttaatcaggggagggcaagtaaggtactagtgcttactagaaaaatacacatgatcaacatatatgtaattgaaatgtccattcaggccatcagaatcttccctaaggatgcctgattaatgtgaacgggtttatacttgtttatgctggtattgtgtgaaattatttgtctaagttatttcaaaaagcagaatagtgtaaaaggtaatgtctcaatgacaataggattattttatctctggcaggttcagtgcattggccttctgtaggaagagcttcagaaagtgcaccatagcttgctgtgagggtctgtctgaaatgggttacagaaaacacctctagaagggagaacatcgaatggtacaccgttttctttttttatttctattttttttttttttttgagagggaatctcactctgtcacccgggctggagtgcagtggtgtgatcatggctcactgcaacccgcacctcctgggtttaagaattctcttgcctcagcctaccaagtagctgggattacaggcgcccgccaccaggcccggctaattttttgtattttagcagagataggggtttcaccatgttggtcaggctgatctccaactcctgacctcaagtgatctgaccgcctcggcctcccaaagtgctgggattgcaggcatgagccactgtgccc

SEQ ID NO: 114144 - DNA, 1018 bp, Homo sapiens
tgtttaaagagctttagctatttttttctagaaaaatgttagcagcaatagttcacagcattttgattttgcaattttggagaatactttgccttatagcttttaaaatctaaaacccacaaaaaattatttgatatagtcatgagagtattaattcgatgtaaatgtataaacccttcttcacctatgtatcattacgaatcaaatgaggctcaaattccggccctattaaattgcgtaagggtataacacttttgacactaattgttaaaccttcactaccagatcatgctatcagctgaagcagcactattgtgttttggcaaacaatattgtcagaaaggtgtatgaattatgcagtaggagtaggtgtatttgcttacgtcggttgcttcttatacacagttttgtcaactctctctgcaaagctacattcactgaaaaagtattagctcgctttagaattagaccttcttctctagagttgaagctccatgtgtgaacaatcagcacctagattaaaacacactaactgctttctccttgctatgctgtctgatgctttactgacatgctctcctctctttgtgaaccttttaacttctccaaatgtctctcttctaccacgctgctctggattaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcag

SEQ ID NO: 114145 - DNA, 1038 bp, Homo sapiens
ctgtgcctaatcattaatcagagtttaacttttaaaaaagttcataagtgcaatacttaattgctatcatagcttgctaatgagaaaaatcattaattaatctccccaatatacatggacccaggcagttccatcccttgttttccatattggctttttaatatttctttggatgaagggagaattttccaaatgcccttttcataacaagttgttttaattgcttcttattaaatccctcctcaggttaccaagcctcaagcttcctgattgattgtcattctaatggatcaagattatatttcactttgcaggattttttccaattatttaattatatgcaaacaaaaatatctatacacttaagaagaaccacttgcctcctcgaagcgcaggttcacacataggtcttcccttggccttctttggttttgattccccaatactcccttgcatgtcctttgcttcccctcagaaatcagtgtcctcaggattttctttgaaactccacagttcctctgcatctccttccaagcctacttctaggaaaacatttgcaatcaattgcaatttactctcatttttgctttaaaagaattttaggtgtcagtgaacaggaaaaagagagttttctttgtggagctccttcaagagtctccaagaaatcacactcatatataatccaaggccagccctgtggtttaattggaaactctagccttgccacacccaacatgagtgtccttgattgagtctttgaaaccctgtgtttgcggttgtgttctggagaagcatgttcaaaaccttatcatcagataattcatacatgatatttgtctaagccttcttaccctttctttaaataactcatatcttttagagtaacaggactacaaaagaaaaactgaaagaaaaaaaaaatcactgatttgcaggcaccattgcaaacttgtaacccatttactagtttctgtgattgagtatcatgctactctgaaatttccagaatgagaattgagtgaaacacaatgtcatcat

SEQ ID NO: 114146 - DNA, 1365 bp, Homo sapiens
agaaaatgagcaggattatttgcaggatgttacacctttaacactgactgaaatccagatgggaacaagcaggaatgtgtatgatttcttaaagacacctcaggtgcctttggtctctcgtattgtatatacagtgtatatgcaatacagtgtacaatgtaaagtgtacagtgtacaataccgtgtataatagaaagcagtgccaaggtctactagttttctctacagcagcagtcaacagtcaagttagagaacaggtggggaactagagacagagtgggatagagagagagaggaatgagccaggaggacacgtggaatccaggaggcaacggagccctgaggtgctcagatggaacagggtgttcagacaaccgcgagtaccatgaaccaggtgtgggacgacggtgtgtcccaggaacagggtgtgatgggtacagcatgtcccaggaacagggtgtgaggaggacagtgtgtcccatgaacagggtgtgaggacagtgtgtcccacgaacagggtgtggtgtggacagtgtgtcccacgaacagggtgtgaggaggacggtgtgtcccacgaacagggtgtggtgtggacggtgtgtcccatgaacagggtgtggcgtggacggtgtgtcccatgaacagggtgtggtgtggacggtgtgtcccatgaacagggtgtggtgtggacggtgtgtcccatgaacagggtgtggtgtggatggtgtgtcccaggaacagggtgtgaggaggacggtgtgtcccaggaacagggtgtgaggacggtgtgtcccaggaacagggtgtgaggacggtgtgtcccacgaacagggtgtggtgtggacggtgtgtcccacgaacagggtgtggtgtggacggtgtgtcccaggaacagggtgtggtgtggacggtgtgtcccaggaacagggtgtggtgtggacggtgtgtcccaggaacagggtgtggtgtggacggtgtgtcccaggaacagggtgtggtgtggacggtgtgtcccacgaacagggtgtggtgtggacggtgtgtcccacgaacagggtgtggtgtggacggtgtgtcccacgaacagggtgtggtgtggacggtgtgtcccatgaacagggtgtggtgtggatggcatgaacagggagcgaggcggatggtgtgttgtatgaacagggtgtggtgtggatggtgtgttgtatgaacaggtgtggtgtgggtggcatgaacagggtgtgatgtgggtggcatgaacagggagcgaggcggatggtgtgttgttgtatgaacagggtgcaaggtgagcagcgtgtctcatgaacagggtgtggtgtggacagcatatcccgttaatggggtgtgatg

SEQ ID NO: 114147 - DNA, 1624 bp, Homo sapiens
acccccagaagacttccccgcagctgatgagctaccaccgttaccgcccgaattcagcaatcagtttgaatccatccaccctcctagagacatgcctgccgcgggtagcttgggttcttcatcaagaaaccggcagaggttcaacttgaatcagtatttgcccaatttttatcccctcgatatgtctgaacctcaaacaaaaggcactggtgagaatagtacttgtagagaaccccatgccccttacccgccagggtatcaaagacacttcgaggcgcccgctgtcgagagcatgcccatgtctgtgtacgcctccaccgcctcctgctctgacgtgtcagcctgctgcgaagtggagtccgaggtcatgatgagtgactatgagagcggggacgacggccacttcgaagaggtgacgatcccgcccctggattcccagcagcacacggaagtctgactctcaactccccccaaagtgcctgactttagtgaacctagaggtgatgtgagtaatccgcgctgttctttgcagcagtgcttccaagctttttttggtgagccgaatgggcatggctgcgctggatcctgcgcctctggacgtgctagccatttccagtgtcccaactactgtcatcgtgaggttttcatcggctgtgccatttcccaacgtcttttgggatttacatctgtctgtgttaaaataatcaaacgaaaaatcagtcctgtgttgtcagcatgattcatgtatttatatagatttgattattttaattttcctgtctcttttttttgtaaattttatgtacagatttgatttttcatagttttaactagatttccaagatattttgtgcatttgtttcaactgaattttggtggtgtcagtgccattatctagcaccctgatttttttttttttactataaccagggtttcattctgtctttttccactgaagtgtgacattttgttagtacatttcagtgtagtcattcatttctagctgtacataggatgaaggagagatcagatacatgaacatgtcttacatgggttgctgtatttagaattataaacatttttcattattggaaagtgtaacggggaccttctgcatacctgtttagaaccaaaaccaccatgacacagtttttatagtgtctgtatatttgtgatgcaatggtcttgtaaaggtttttaatgaaaactaccattagccagtctttcttactgacaataaattattaataaaatacttgagctttatgcctctttttccttcccattgatactcctgttcaggattcagtggctgagatagaagaatggatgaatggaagggtggatattgatgtatttgcttttagtggacaaggcgtaaatgtgaaaatcctctctaccctgaccaaaagccctgctgtccaagcggagccagccaccaggtggcagtatatagctacttgatacggctcaaaactatagccacaaaagtaaaaagcataactttttaatatttttaaacaaaaccaagaaaattttatacatttttaattagtatgaatttattggttgtaattttaatgcttacatgtttttcacctttgtcaatgttttatatcaaaaa

SEQ ID NO: 114148 - DNA, 1027 bp, Homo sapiens
ttgatagtttctaacagtgcttaacctgcatgatcctgtttaatcctcataacaactctaacggattttcaccccatttcaaagagagaacctgaaggttagccagggcctgggcaggcgtctcatggccctaactgatagtgggatttacatgcgtttggttacacttcctgctgggcttctgtgtatagatgcggggccctggcagggcaagtgtaattacagacatggggtaagtgtagccgtggtctctttagggaatggctcacagtgtcaatattaaagcatattcaaaatacatacagtttggagagatcttcagcttgtacatctgtctttaagtatctaagtttgcctatgaattcctctgaatttaatgtcctttgaagttgcagtgtgctataaagtgtgtgcattatgtagctgtagatgtatttggattatcacctatgtaatctgatcagtttatattttattagagcctgtttgttttgttttcattattcctaaggaaattctgtgttttcaggctgtgattgtcagaaacaaggaaaagaaagtaatatttgagttttctggccaaatttctggttcctcattccgcagtcactttcctccacttccatattccattttatttgtggtacatacatttctcagccatttggaattgtcatagatactggcgtaaggacatgctgtatggctgattgggcctctgtaagcagttttcattgttctgtgtacttacctttattgccttttcagccgactgttttaattacaaatgttttcttttttttctactctgccaccaaaagaatctttggctgctcctgacctcagcaaaccaagaggtgacttatgcatgccagttattcattgatactcactaaaaacaatgggtcaagccttgccccagtgctgactgactacgctgggtcgcccagtgtttgcagcagtaactaagtacacggctgcatgtgtgtgcgcattgcatttgaagcacggattgcctaaccttctc

SEQ ID NO: 114149 - DNA, 1040 bp, Homo sapiens
atatcaccccagttttgtgggtttgtcagaaatcttcctcgcaactttcttaaccacgcagcacgcacacaaacacacactctctctcacacacacacacacacacaccccctctaagaagagatgtgatagtctgaaatgttcgatttcagtagcaccttgggtattacaaggttttatttgtctcctcccccaaccccactgcggccccagctcccatttggatcagagcgtactgccagagcacagtttaagagattgctagtaagtttgattatatttctaatgaagaaagtttaacagtgggatctttgccaccagttatgttgatctggtttccctatagggtaaattgcattgataactagctttgccatattaacacataccagtagagaaaaacgtcaatattcagtaacacaatgtagtttttagtggaaatttttgaatctcagaattagtaagtttaatgataatttttattgtataaacgtaatacgtttattattaaacatattaatatgttatacatttcaaatattttattggtgggaaaaggtaaccccactaataattattcaatccagagtaatatagtccataatacatcatatagtccataaatccatatagtcattatctattgcagtcatttttcaaactaaagatagctataagtatgtgctatcatttctgatttcaagtatatatatatatatatatatatactttcaagtatatatatatatacacactctattcctaatcaacacaggtatattttgataccgtatatatggtatcaaaatatacctgtgttgattaggaatagggtgtatggacatagctttgcttgttaaaccaacaagatagaattatgtcttttatcaattttaattctaagaagttcctgtttccagtttatgtaataatttatatcttggcccctaaatgctctttataaatacatttcagaattttatcagcattttctttctagttcttgttgttggaacatcagtcttcttaataatagtccc

SEQ ID NO: 114150 - DNA, 2026 bp, Homo sapiens
aaggcttgttgatgtagccaacttttttcccagagagagtgagaattttacgagcttttacagacctcggagaataaagataaaaagcaatataattaagaccaggtttctgagtcattgagtgataggacttttttgttcctttttgccgatttaggttattactgcaaatgcagtgccttgtacatagggacccactgtgagataagcgtcaatccgtgttcctccaagccatgcctctatgggggcacgtgtgttgtcgacaacggaggctttgtttgccagtgtagaggattatatactggtcagaggtatgtgtatttttcttaactttcataatcaattgtagtataaaattcttaaacatataatggtacatgtaaaaagtctgcacgttaatttgctaatgtgttctgttttgctttctgttttgctgtatttatttgcaataggatcatgaggtttatgtctgtttctccttactcttcaggtgtcagcttagtccatactgcaaagatgaaccctgtaagaatggcggaacatgctttgacagtttggatggcgccgtttgtcagtgtgattcgggttttaggggagaaaggtaaatggtttctttcaaaatttaggttcataccttttcatagcgtcatattgactggcagatgcaacagaccttcagtgatttgaactacattatgtcagattttgataatcctcatattggccccttatataatttataatcttttcactctttaaaatgaattatcaagcagatgaatacagtatatataatacttgaaaaaaactaatgtttagccaatggggttgatgtaatagtctgttgatcctaggaaaatggccattaatattggcttgatatgtttccttcccaaatatacatcaaaagcatgcgatcacatgattggtttctccacagaaggtcttttctcgtggttgtcgacgttacattttttagttgtcttttatctgggtttgatcttcacatagctcatcaaggagggattagtcttcagtctctaaggattgagcctgacatacgctggcgtatgctacagaggtctctcctcattcctgacttccttggcaggtgtcagagtgatatcgacgagtgctctggaaacccttgcctgcacggggccctctgtgagaacacgcacggctcctatcactgcaactgcagccacgagtacaggggacgtcactgcgaggatgctgcgcccaaccagtatgtgtccacgccgtggaacattgggttggcggaaggaattggaatcgttgtgtttgttgcagggatatttttactggtggtggtgtttgttctctgccgtaagatgattagtcggaaaaagaagcatcaggctgaacctaaagacaagcacctgggacccgctacggctttcttgcaaagaccgtattttgattccaagctaaataagaacatttactcagacataccaccccaggtgcctgtccggcctatttcctacaccccgagtattccaagtgactcaagaaacaatctggaccgaaattccttcgaaggatctgctatcccagagcatcccgaattcagcacttttaaccccgagtctgtgcacgggcaccgaaaagcagtggcggtctgcagcgtggcgccaaacctgcctcccccacccccttcaaactccccttctgacagcgactccatccagaagcctagctgggactttgactatgacagtaagagccactttttcatctcactaaagtgtcacttgagataaacagtgaggttacaaattctgtccagtcaaaatgtgtgtactcttcattagagacaagtatgctcagactgaaatccgtatgatgatttgaaacttttttggatgtcccgattgctgggttagcattgtggctttgatgttattttaattaagaaattgaatctagtcatgtttagttaatattctggagagatcatttcattttataattgataaaggttctcatctataattttttg

SEQ ID NO: 114151 - DNA, 1076 bp, Homo sapiens
tgatattcctaaaagacgcattttaatgatttatacagtggacaaatgaatctgtgctctgtagtacttaaatgtaaggcctaacttctaccctcactccctaagccctctcctgtagatttgtgatcaggtgctctcattgaaggttctatgagagtaatgtgaacagtcattgcttttatcctagattcatcatggaaggctgcagtacaagtttgactgtggaagtggccctggaattgtctctgttcagagcattcaggtcaatgatgggcagtggcacgcagtggccctggaagtgaatggaaactatgctcgcttggttctagaccaagttcatactgcatcgggcacagccccagggactctgaaaaccctgaacctggataactatgtgttttttggtggccacatccgtcagcagggaacaaggcatggaagaagtcctcaagttggtaatggtttcaggggttgtatggactccatttatttgaatgggcaggagctccctttaaacagcaaacccagaagctatgcacacatcgaagagtcggtggatgtatctccaggctgcttcctgacggccacggaagactgcgccagcaacccttgccagaatggaggcgtttgcaatccgtcacctgctggaggtgggctccgtaatgttgccatctttaaaatgctgcacgtgtgtacatttaaggggaagctccccaggtatttttttatttttttctcttttgattcagataattttgtcagacactgcagtcagtgttggaagcgagcagcatccctcatacgggggcagagctgggtctgctgcccttctggtgcccaggctgcaggtaccacggctcccactgctgagcgcctgcagtgccctcccagtgcccgagcaggaggcacctcaagtgactcagaactcttctttaactccatagtcatcggcccaggggaatttagaattcgtaccgcttagcccttctttgttatttgtatcaccttttatctaatggctcagcgtagggggcctgctagattcttgctggcaataatagttgggaatatgattt

SEQ ID NO: 114152 - DNA, 1020 bp, Homo sapiens
aattgttatttagtcagttctacataattttatgtaacagttgccatctgtggagattgatgacatttgcatcttctttggggaatggggattgttttattttgcttgagaaggtttcttaaatcaccttgaggctatgtataactattttctgaaattttcttctaataattttatactgaacatttttatatttaatctttcattactttagaattcatttctctgtgatgcagtcgtcaaatttattctttccaaacagagagccagtcatgctgggcttttcattaagcaaatagacgttttcccacagaattggatagtaaaatgttatcatcttaaataaaaccctaaatcagtctcaaggggtgcaggggagtcatactttaaaaaatatgcttaaacttggttctggtttattttttcctctgtgtgattcacagggagttcatctatgacactgactggaaacagctacgtgaaataccgtctgacggaaaatgaaaacaaattagagatgaaactgaccatgaggctcagaacatattccacgcatgcggttgtcatgtatgctcgaggaactgactatagcatcttggaggtatgtttctccacagcgttgcatcttagtggaagactttcaaaccataaatttcattttatattcagattgttaatttgcacagataataaagtaagtgaaatggttgaattccacatttaaataattcattgatgcctgtacaagttttagactttgtgggatgaagagctctttttgccctgccatgacagagatttaggtccatgtgacagttaacattcaaactctaggtgatgccccattttaataatgttggctgggtgtggtggctcacgcctgtaatcccagcactttgggaagctgaggcgggtggatcacttgaggtcaggaatttgagaccagcctggccagcatggcaaaacctgctctctactaaaaatacaaaaaattagccagacttggtggcggacgcctgt

SEQ ID NO: 114153 - DNA, 1177 bp, Homo sapiens
cattgacattagggtaattgaggagagcatctatccgcctgcgattttgcccctggagattttcatcacctcttctggagaagaatactcaggtggcgtcattgggaagatccatgccacagaccaggacgtgtatgatactctaacctacagtctcgaccctcagatggacaacctgttctctgtttccagcacagggggcaagctgatagcacacaaaaagctagacatagggcaataccttctcaatgtcagcgtaacagatgggaagttcacgacggtggccgacatcacagtgcatatcagacaagtcacacaggagatgttgaaccacaccatcgcgatccgctttgccaacctcactccggaagaattcgttggtgactactggcgcaacttccagcgagctttacggaacatcctgggtgtgaggaggaacgacatacagattgttagtttgcagtcctctgaacctcacccacatctggacgtcttactttttgtagagaaaccaggtagtgctcagatctcaacaaaacaacttctgcacaagattaactcttccgtgactgacattgaggaaatcattggagttaggatactgaatgtattccagaaactctgcgcgggactggactgcccctggaagttctgcgatgaaaaggtgtctgtggatgaaagtgtgatgtcaacacacagcacagccagactgagttttgtgactccccgccaccacagggcagcggtgtgtctctgcaaaggtactgcacatgagtgtatgaaagtcggtgtcacagatggtttcagacggcctttgaagcctttgatggctatacatgaaaggtgatgttcttgaaatgtctgttaattatcttttccctttctcccctctttgaatgaagagggaaggtgcccacctgtccaccatggctgtgaagatgatccgtgccctgagggatccgaatgtgtgtctgatccctgggaggagaaacacacctgtgtctgtcccagcggcaggtttggtcagtgcccaggtgagagttgaatggttgggtatacttttatttttaaaaatcggtttcattgtttcttaccattttcttctttattggagtctaaaaatattgcaaagtatgtttattgtaagaagacagatgtggagatgaataaagaatga

SEQ ID NO: 114154 - DNA, 1049 bp, Homo sapiens
agaaggacactggtgatgattaagaatgaaatttcagaagaataatgggtgtatctaagattaaaggaatttggggggagatagtgatgagatacctcattaaattctttaatttctcctttgatgtgtgaatgttgagaagggactttctaaggatttgggaagcatgcttaggattgcccccactgtggggcagaataaatttagtatctttgactaaagaacccagatcctttaatacacttctgtccattgtgagataccaaaggagctagcctgtggtatttcccaagctaatgcgccagcagaattctttttcattggagcgtcttgcaggactaacgttctgtagaacatactctgggatctagccagctttctggcttctcccacaactcattctagaagacagagctttatagggaactgccctgaaaaagaagctatctcacttgactttctttcttttgtgggaggtcctgacaagctaatcctgagggatttagacagctgagtataatccgagtgtgaaattgagggggagggtgatctggagtgtcctgaggcattggaaatgagtcagcgctaaggtgcgggaggcagctcatgtctgtctacttccactgagagcaaacttggggccctaaggaaggctgctcccatcttaccgaagcaacagcatttgagatatgttaacttcttgtcctaatcatttgtattacttttatgtcttagtttctgttaatagaactgcaagataaaagacttttacaaaacaagtacatatttaagaggcatcagagaatctaatcattattggtaattcttgctgttgggaaatgtgtattacttgcatgcactcgtttgtaggagattagggcatcgctcacaggcaggatgcaacagatagtggtagctcactgggacctgcccgtcaggactctcaggaggacactcctcattggagctctgtcggccttgtgaaaatgaacgtgcattctgtcttttgcctgaaaagatttcaggttacacgctcacggttcaagctt

SEQ ID NO: 114155 - DNA, 1150 bp, Homo sapiens
atttatatttataataaaattatttttagggctctttaggactagaatgatgtgaaagatgttaaaaggaattgtttaaaaagggatttttaaaaatgagaggatgtaaataaagggttatctagaagttaaaaggatataaatctccattttaaaaatatgagaaggaaaatattttaaaaagatgagacaaaaaatgaaaccgaaagacacaatagaatttttacgtttttattttgttgattaaattagagtgaagtcgagtgagctatggtatggaagggatgatacaatcatcatgtttataataagcagggatgtaggtggtgttgactggaaaagcaatttaaatatcatgaagaatatcatgaaaattaagagaaataaagatccagggatgggcagattcatagtttttaattgttgaattaagaaaataggaaacatacgtaaatggtaagtaaacttttgaagtgaaaactaaatgtactcaaaagcattcatctatttcagtcatagtgggaaaatgtggtggcattgcagaatgctggaagtaattttgatttctattcaggggccgtatttatcattgagaatctggattatgagagctctcatgagtattacctaacagtagaggccactgatggaggcacgccttcactgagcgacgttgccactgtgaacgttaatgtaacagatatcaacgataatacccctgtgttcagccaagacacctacacgacagtcatcagtgaagatgccgttcttgagcagtctgtcatcacggtgtgtattttttccccattacagtgaaaactgtgtatcttctggatctttgcaaaagtttttagtaaaatcaatctagtttttgtagcggcctttgtaaatattttggagatttgaaagtgtcttttgttaggccaactgattgctgactttgttatgaataattgtgttaaaacagctaagctaaccctgtctctactaaaaatacaaaaaaaaattagccaggcgtggtggcgggcgcctgtagtcccagctactcgggaggctgagacaggtgaatggtgtgaacccaggaggcggagcttgcagtgagccgagattgtgccactgcactccagcctgagtgacagagcaaggctcc

SEQ ID NO: 114156 - DNA, 1044 bp, Homo sapiens
cgtttacccttctaaaaaaattttgtttggtttttaaaaaaaaaaaaaaaagcgttggccgggtgcggtggctcacgcctgggatcctggcactttgggaggccgaggcgggtggatcacgaggtcaggagttcaagaccagcctggccaacatggagaaaccccgtctctaataaaaatacaaaaattacagtgtgtctgtaaccccagccactcgggaggctgaggcaggagaattgcttgaacctgggggacagaggttgcagtgagccaagatcacgccactgcactccagcctgggcgacagagggagactccatctcaaaaaaaaaaaaaagtgttaaacttttttatttaaaatcttttgacatgtttttatgtcttcataggattaaatcggaagattttatactcactgattgactctgctgatgggcagttctccattaacgaattatctggaattattcagttagaaaaacctttggacagagaactccaggcagtatacaccctctctttgaaagctgtggatcaaggcttgccaaggaggctgactgccactggcactgtgattgtatcagttcttgacataaatgacaacccccctgtgtttgagtaccgtgaatatggtgccaccgtgtctgaggacattcttgttggaactgaagttcttcaagtgtatgcagcaagtcgggatattgaagcaaatgcagaaatcacctactcaataataagtggaaatgaacatgggaaattcagcatagattctaaaacaggtaacctaccatgtatctgagaggaaacccttcattccaccaagaaaactagatttgcttaaccacgttgccttgtattaagtgaccctgtgttgtcagtagatgttctaaaaaaggcaaatcaagttttcttttagttatttacagtgggattgaatgttgtttggaaggcttcagattatagttctacttaatacattttgggcatgttcattataaaatacaagcaaattaacttaaaatagaaaatcaaagcagcatgttc

SEQ ID NO: 114157 - DNA, 5444 bp, Homo sapiens
atagccttgtctttccaccacacattcccagtgcagccgagagagggagttttggcttcgctaagagcagagtgctgtttcttctgttttttgtttttcatcatttatggacaaaattctgtaaagtatacctggttttaggtggataaaaataaaacaagttgaaggttccattcaaatattgacatcccctgagtttctgcttaatttcagaatataatttttaaggatactttgtttctgtttctctaactactactactactgccccttgtgtttttctgtaacatgtattttttcctctccttccaggaaatattggaaattcttttatgattgatcctgtcttgggctctattaaaactgccaaagaattagatcgaagtaaccaagcggagtatgatttaatggtaaaagctacagataagggcagtccaccaatgagtgaaataacttctgtgcgtatctttgtcacaattgctgacaacgcctctccgaagtttacatcaaaagaatattctgttgaacttagtgaaactgtcagcattgggagtttcgttgggatggttacagcccatagtcaatcatcagtggtgtatgaaataaaagatggaaatacaggtgatgcttttgatattaatccacattctggaactatcatcactcagaaagccctggactttgaaactttgcccatttacacattgataatacaaggaactaacatggctggtttgtccactaatacaacggttctagttcacttgcaggatgagaatgacaacgcgccagtttttatgcaggcagaatatacaggactcattagtgaatcagcctcaattaacagcgtggtcctaacagacaggaatgtcccactggtgattcgagcagctgatgctgataaagactcaaatgctttgcttgtatatcacattgttgaaccatctgtacacacatattttgctattgattctagcactggtgctattcatacagtactaagtctggactatgaagaaacaagtatttttcactttaccgtccaagtgcatgacatgggaaccccacgtttatttgctgagtatgcagcgaatgtaacagtacatgtaattgacattaatgactgcccccctgtgtttgccaagccattatatgaagcatctcttttgttaccaacatacaaaggagtaaaagtcatcacagtaaatgctacagatgctgattcaagtgcattctcacagttgatttactccatcaccgaaggcaacatcggggagaagttttctatggactacaagactggtgctctcactgtccaaaacacaactcagttaagaagccgctacgagctaaccgttagagcttccgatggcagatttgccggccttacctctgtcaaaattaatgtgaaagaaagcaaagaaagtcacctaaagtttacccaggatgtctactctgcggtagtgaaagagaattccaccgaggccgaaacattagctgtcattactgctattgggaatccaatcaatgagcctttgttttatcacatcctcaacccagatcgcagatttaaaataagccgcacttcaggagttctgtcaaccactggcacgcccttcgatcgtgagcagcaggaggcgtttgatgtggttgtagaagtgacagaggaacataagccttctgcagtggcccacgttgtcgtgaaggtcattgtagaagaccaaaatgataatgcgccggtgtttgtcaaccttccctactacgccgttgttaaagtggacactgaggtgggccatgtcattcgctatgtcactgctgtagacagagacagtggcagaaacggggaagtgcattactacctcaaggaacatcatgaacactttcaaattggacccttgggtgaaatttcactgaaaaagcaatttgagcttgacaccttaaataaagaatatcttgttacagtggttgcaaaagatggagggaacccggccttttcagcggaagttatcgttccgatcactgtcatgaataaagccatgcctgtgtttgaaaaacctttctacagtgcagagattgcagagagcatccaggtgcacagccctgtggtccacgtgcaggctaacagcccggaaggcctgaaagtgttctacagcatcacagacggagaccctttcagccagttcactattaacttcaatactggagttatcaatgtcatagctcctctggactttgaggcccacccggcatataagctgagcatacgcgcaactgactccttgacgggcgctcatgctgaagtatttgtggacatcatagtagacgacatcaatgataaccctcctgtgtttgctcagcagtcttatgcggtgaccctgtctgaggcatctgtaattggaacgtctgttgttcaagttagagccaccgattctgattcagaaccaaatagaggaatctcataccagatgtttgggaatcacagcaagagtcatgatcattttcatgtagacagcagcactggcctcatctcactactcagaaccctggattacgagcagtcccggcagcacacgatttttgtgagggcagttgatggtggtatgcccacgctgagcagtgatgtgattgtcacggtggacgttaccgacctcaatgataatccaccactctttgaacaacagatttatgaagccagaattagcgagcacgcccctcatgggcatttcgtgacctgtgtaaaagcctatgatgcagacagttcagacatagacaagttgcagtattccattctgtctggcaatgatcataaacattttgtcattgacagtgcaacagggattatcaccctctcaaacctgcaccggcacgccctgaagccattttacagtcttaacctgtcagtgtctgatggagtttttagaagttccacccaggttcatgtaactgtaattggaggcaatttgcacagtcctgctttccttcagaacgaatatgaagtggaactagctgaaaacgctcccctacataccctggtgatggaggtgaaaactacggatggggattctggtatttatggtcacgttacttaccatattgtaaatgactttgccaaagacagattttacataaatgagagaggacagatatttactttggaaaaacttgatcgagaaaccccggcggagaaagtgatctcagtccgtttaatggctaaggatgctggaggaaaagttgctttctgcaccgtgaatgtcatccttacagatgacaatgacaatgcaccacaatttcgagcaaccaaatacgaagtgaatatcgggtccagtgctgctaaagggacttcagtcgttaaagttcttgcaagtgatgccgatgagggctccaatgccgacatcacctatgccattgaagcagactctgaaagtgtaaaagagaatttggaaattaacaaactgtccggcgtaatcactacaaaggagagcctcattggcttggaaaatgaattcttcactttctttgttagagctgtggataatgggtctccatcaaaagaatctgttgttcttgtctatgttaaaatccttccaccggaaatgcagcttccaaaattttcagaacctttctatacctttacagtgtcagaggacgtgcctattggaacagagatagatctcatccgagcagaacatagtgggactgttctttacagcctggtcaaagggaatactccagaaagcaatagggatgagtcctttgtgattgacagacagagcgggagactgaagttggagaagagtcttgatcatgagacaactaagtggtatcagttttccatactggccaggtgcactcaagatgaccatgagatggtggcttctgtagatgttagtatccaagtgaaagatgcaaatgacaacagcccggtctttgaatctagtccatatgaggcattcattgttgaaaacctgccagggggaagtagagtaattcagatcagggcatctgatgctgactcaggaaccaacggccaagttatgtatagcctggatcagtcacaaagtgtggaagtcattgaatcctttgccattaacatggaaacaggctggattacaactttaaaggaacttgaccatgaaaagagagacaattaccagattaaagtggttgcatcagatcatggtgaaaagatccagctatcctccacagccattgtggatgttaccgtcaccgatgtcaacgatagtccaccacgattcacggccgagatctataaagggactgtgagtgaggatgacccccaaggtggggtgattgccatcttaagtaccacggatgctgattctgaagagatcaacagacaagttacatatttcataacaggtaaaaaaaattcataccaaacggtttaattaatttaaaatgatttttagaagcataaagtataagatctgtattgtatggaaattggggatttaagggatgattttagttaaaaatatctaaaataatacgtagaaataacatctgttgagcctcatttcaagcttgttacctgagcaaagctaccagttgtttcattagactgtttttgatttttgtgactcattcttttgaaccttatacttagtgtataataaatataattaaaaacatctatagttttaatgcaggctaaatgattagtagtcttaatgctatgtttatgcattttaatgctgcccttgtttttgtaaattggaaggctaatatatgccaaattaattcttttaatactcaattcttttaaactataacattatacatcttttgtacagtttattttttctgttacttatttttatcctttcaacaaatttgattattatcttcctccattgatttaataggaggggatcctttaggacagtttgccgttgaaactatacagaatgaatggaaggtatatgtgaagaaacctctagacagggaaaaaagggacaattaccttcttactatcacggcaactgatggcaccttctcatcaaaagcgatagttgaagtgaaagttctggatgcaaatgacaacagtccagtttgtgaaaaggtaagcagctcttcccttacatttgtgtgttatgaatttcaatttcttaattctttcaatgggaccatcatttggcgctgtggtgtaattcacatgtgttttatgatcacttactgattaagcagaggtgttaaatggggtaagacttggaaaagcttcagaactatttgcgggaatgctcaataaatcaaaagcctcattctagaaaactaaattacggacaggactccagttgcatccaacactgaaaatgctctgtaaccttttcatgaggggattctcttaatatggggatacagctgttttgggggaaggatctgacgggaaacaaagtgccgacgtgccgtgagacactgttttg

SEQ ID NO: 114158 - DNA, 1049 bp, Homo sapiens
agttgttattcctgaagatacagcgccagaaacagaaattttgcaaatcagtgctgtggatcaggatgagaaaaacaaactaatctacactctgcagagcagtagagatccactgagtctcaagaaatttcgtcttgatcctgcaaccggctctctctatacttctgagaaactggatcatgaagctgttcaccagcacaccctcacggtcatggtaggcgctctacccgctctcctcccaccatttggtcctgaggcctttgtgtgttcgagcgtgatttttaattagttataaggaaagcaccaatgggattgataatgtgtcaattctttttaggtacgagatcaagatgtgcctgtaaaacgcaactttgcaaggattgtggtcaatgtcagcgacacgaatgaccacgccccgtggttcaccgcttcctcctacaaagggcgggtttatgaatcggcagccgttggctcagttgtgttgcaggtgacggctctggacaaggacaaagggaaaaatgctgaagtgctgtactcgatcgagtcaggtacttttggagccttcagtggcattttaaatttgcagttgttaaaagtctgtttctacttttccaaaatcagttctgggtattgaagcatttctatgtatctgcaaaaatggcttaaattgatctctagatacaattttacatgttaggagaaaggaatttttttttttttaacttttagcccatcagagagtttgggggaagttctgggggattcacaatattagcccagttcaaggctctgagaagccacgtagtagaggaaactttatttgaccaattcagtatttctgaaattattttaaccacagtttcttctgtaacattggttaaattaaacacacttaggaagctgcttgcctagtaatttaacgtttcacttttttgtcagagagtattttctcttgagcagagcaggaagctccataacagtgttgactcatctcattgtaattggctgaaacctcagaaagaggtgtcgtgcccctcccaccccttcca

SEQ ID NO: 114159 - DNA, 1030 bp, Homo sapiens
tcagctgggaggtgagacactagggtactgcagggatggattgaagagcagagggatcagctgggcagtgagacactagcataccgcggggattgattgaagagcacaggaatcagctgggaggcgagacactacgataccatggggatggattgaagagcagaggagtcacctggacggtgagacactaggataccgcggggatggattgaagagcagagcagtcagctgggcagtgagacactaggataccgcggggatggattgaagagcagaggagtcagctgggcagtgagacactaggataccgcggggatggattgaagagcagagggatcagctgggagatgagacactaggatactgcggggatggattgaagagcagaggggtcagctgggaggtgagacactaggatacctcggggatggattggggcttggaagtaacactcagaagtcaacagagcagccattgtgtatccaggtcaggggcagcagatgccgatttgagaaggtttaggtgagccgttggtgagtcaagcgggcagcctccagcagaggtaggcggcaggacagtgggagaactgccagtgccctgcggaaacagctcttctctggctttcctgtcctgcgtgtgtggcttaggatgctgaccgccattgattccagtcacttggctttatcttgtatctccaggtaacttaccaaatccagttaccttttttttctttcattcaaacaactttgctttcatatcttctttaactttctctcgagcatcagcatcgtggcctctggagcagatcacttggtttgaatcccggctccacctcttgtactcctttccatgggcaaatagctgtaactctctgtgtgtccatgttctcatctacaaagtgggggtggtgataatcgtccttttggaggtcttaggaaggttgatgaggtgacccgcagggtgcttgttcttcacgttctgagagcctgtcacccagtaagcacgcagaaagccatagtcttgttgcaca

SEQ ID NO: 114160 - DNA, 1019 bp, Homo sapiens
aaaataaaagccttgttttgtttttgtttttttttacttttttatttccagtgactatcttccatcgctgttttttttttcatagtgtgcgcatggtcacccatcccactcgccagcgtgttgccacgtaatgctcacctagctccgtggttttaggtttctcttaagacgtcgtgtgtgttgttttgtttcttggttagatttagtagtagaatttcatcatgacattaaacctctattttcatcccatttcattttatatctaggtcgatggatttgaaaagagagttttatcaaaaatatttggataatattaataggatagaaacttttgtttcattaggctttgtgtttgtcaaaaatgagaaaaaaaattcttttcaaatagtttatagtagccaggactaattaaagttaacgaccgctattttttttagagttaacattgatttttaatagctattttattaggtcaatttgctcaaagtatcagaaagttttgttagtaagtaagcttttaaatggcccagtgatggtatctactgagatacaaattgaagaggaattcagaacccctgaaaaagcaaattgaaagtaactcattggcaatattagcaatgtctttgttttcagagttgctttcttgctttctttcagttagttgcttcctggacaattagggttcactttgccttaacaagcattgtctttctaattggccactcttttctttcaaaatgctcctccttggaagctctttgctagtatattagaagatttttcagtgccattaagtatgagaaagccacagaataaactacagagtgttatcctgtgacctgtttttacttttttttccccaaattaggtggcaactacgacagtcacttcgatgtggacaagggaactggaaccatcattgttgccaaacctcttgatgcagaacagaagtcaaactacaacctcacagtcgaggctacagatggaaccaccactatcctcactcaggtaagtgaatt

SEQ ID NO: 114161 - DNA, 1075 bp, Homo sapiens
gctgcctcacctccttacagccctgttgttggaatgaagatctgctgtgtatgttgtcatcgtgccctgcaaaatgcagagctttacacacatgcggagtagcatgaggaagaagatgctcactttttatatagtatatcttaacatgttaatctgttaactttaaaaaaacaggttactgtgacagacaatggtagtccccccaaatcaaccattgcaagagtcattgtgaaaatccttgatgaaaatgacaacaaacctcagtttctgcaaaagttctacaaaatcagactccctgagcgggaaaagccagaccgagaaagaaatgccagacgggagccgctctatcacgtcatagccaccgacaaggatgagggccccaatgcagaaatctcctacagcatcgaagacgggaatgagcatggcaaatttttcatcgaaccgaaaactggagtggtttcgtccaagaggttttcagcagctggagaatatgatattctttcagtgagttaagattgtagtactgtaatttttcatatgttgtgactataaaccttattttgtattttttctttagtaactttatttctattttgtaaacggctgaagtgtttgtgacctgctggccccattaggcaatgccggataacgtttgagaatcagggtgcttattgtttatgttgaatgtggtcatgaaatcattgttcttctgtcaggcattccatacacagaatacaaatgtgaaatgtttgaaattggctcagtttaagaccaaaccagtctgtgcttcattcatttctgggttgtaactcctgatttgctgtttttaatcccctctgcccaaatgttgtagattaaggcagttgacaatggtcgccctcaaaagtcatcaaccaccagactccatattgaatggatctccaagcccaaaccgtccctggagcccatttcatttgaagaatcattttttacctttactgtgatggaaagtgaccccgttgctcacatgattggagtaatatctgtggagcctcctggcatacccctttggtttgacatcactggtaagcattcc

SEQ ID NO: 114162 - DNA, 1031 bp, Homo sapiens
ctgggattaaggcatgagctaccgcacctggccaagagtgtgattttaattgcagtattttgtaattgaccttattttgtgaggattaatgaactgttatcattttacaggtctcatcacaactacgtcaaggaagctagaccgagaacagcaagatgaacacatattagaggtaagttttttttttatctttaatacttaaagattcgtagttacaagtatcatgggaaagaacaatcttgttcccattaaccagtattcttagctattaatattttgttgtattaatattatttactggttgttaggaaaaaggaatataaggaaattgttaatgaatatagctcttgtcccctttatccctcaataccattcccagaatacacagccactgtcatgggccggattcagatctttgtattttatgcttgcgcacacacagggggcgaacagatctataaacagtgtcatgtggaattcatttgcatttacataagtgatatttttctgtatacatctttttttccccttactattatgtttttgagatatatttatgttggtatttatagatctgtttcaacctttttaactagaggtaatttgtttccagattcatttttttgctcttaaacagttgcattatttttgcgttttaaactatgaattacttagtttgtgcttcttaaatacctcaaaagtaaaagtagattgaagtctcagatgtgctcttctagaaagttctaataaggcttctcattctcatggataatttacaatgccttttagtccttagaaaacccacagcttgttatcatgtattggtcacctggtttttggctaatagtaaatacattgcagaaaaaggccgcgagtaatttggagagggaaggtggagcgtaacatggacatcaggttgatgagatctctgggccgtgtcgtcaggaagcggctgagagacaggcagaccgcagagaggggcgtagagacatctctctgtcccgtgtggaagactggtgttcattatcgga

SEQ ID NO: 114163 - DNA, 1058 bp, Homo sapiens
tcgcccgctgagccaagtggagactcatagcagagaacggggagcaggagcatggcagggcagtatcagcacagtcaaaatctaggaaagttttactttttttttttttttctatgtaggtttaagacagatgtctacaaaaatttggatttagataaatattttttgcttcaaattttaaccacagaaaaggattttgaatattgcagatgttaaagtttttagttttgacaggcagcatttgaaattggagatgctataaaggatcagacataattggtgactatttaaatttaaattatttaaatttaaaattcagttctatggtgacattagctctgtttcaagtgcatagtggccacatgtggccaggtgctaccatattggacagtgcaaattatagaacacacaaatcatcacagaaatttctgttggacagtgcttttctagaacgtgtatggctgtggttcatgaattattgtaaaataaaagggcggaaaggccaaaatcattgcagggggtagaggaaaataatcagagtaaaaggaaggtatcgggtgaccagatttttaccttttttccttgatctttttcccttcctgtgcttattctctagtagagtaattgaaaagtgttccaagtaaatttcctgccgggtgaggtgaacatagggctgcagagattccttcctttagagccaggaccctgtctttcagtgtggggtcatcgatgactcgtactacagattgcaagtgcttgctctcttgttgcagttggacctgaatcctattcagaaatcctatttttttccttttctagctgccatctttcatgtgtgtgtgtgtgtgtgtgtgtgtgtgtgtgtgtgtatatattttttttttttttttttgtgagacagtctcactctgtaacctaagctcaattgcagtggtccgccctcagctcactgcaacctcggcttcccaggtccaagtgagtctcatgccttagcctcccaagtagctgggattacaggtgcacgccaccacacccagctaatttttgaatttttagta

SEQ ID NO: 114164 - DNA, 1052 bp, Homo sapiens
ggctttagcaaactttatttttacagtaagaggatacttagcacccgtgatccatttcattaaaaatttgctgcaactcaaaaacattagaaaaagtcatataggatatgccacttcaatatttctaaggagtttgagttttttatatgtgtggccatatattagtgtatataaggcttaaaaaataattgatttgagattttccagcctaagtttagttttcagccatcaaatatgtctatattttcactctgagctttaaaatgttttaatatttaaatttatttgagtaatatgcccattaaagattaaagatggccacaataaagtagtgtataaaatgaagttctcctgtctcctctcttccctcctctctcctctcttccctccagctacctgttccatttcccaggagtagccagaagtaatatgtcagggttgaacgtgtcacagcttctgtgcacaggagtttgtgcacacattacatccgtacacacatatgcatgtctcatcagccccttgccttgctggtttttgtagtgctccttgtctaaaagttacccaaacagtgtaagtttcacagtccgcccatgagtgtattacaggtgttttattgtaattgtccttaatgttgctgattcttaagcacactgaatgtccctgggagcagtccctgccacagtcaggattgaagggtagaaatctaacttccggatcctggtagtaacaactcctgaagaaattacactgaagaccctaaaacttaaactagacacttcctttaccaccaaaaatactatgattacagttcttaaacttagtatcaagtagaatatatgaaagtgtttcagagacatcatcgggtgaaaatggtatgtatctgaagtgcgtgcctgcagtcaagggtttgtcagaataatgctatgattaatacaacatcgtgagaaagggatggagcccagaggactccttcctgcaaaaggagctgggcttggtggagagaacattctaatcctagaagaaagtgagatcactgaataattttgttgtat

SEQ ID NO: 114165 - DNA, 1029 bp, Homo sapiens
ccgctgtgttccagtaaaactttgtaaataaacgaaataaattcaataaaatttgaattttctgcccttttcatgtatcacaaaagtttttttcaaccatttaaaaatgcaaaagccattcttcactagccagccacacaaaaacaagctactgtgctttcctgactcctgatgagtggacgtatttactggtgggactagttaaacaatttcgttgattgctgatttttaaaattattttgaagggatagacttttatatttctgaagtaaaaattgaatccctcccgttgctctaagcaagagtgcttagaaaggatgtttgtatttcacttctcttggttgttaataacaaaattattctttaaatagagcaattagagtatcagtatcaaggttgagatctcagatacgattttgcaagttggttagtagactgttagatctcttctacattgggaagtaattgtttctcattagaagataaattttcctagattttgaggttttcctactttttctgtgttgatgtgtcctgttaagttttcagagctcccaatttcagctcaaacagttggctctaagtatacttagcaggtctttatcatctcccccattttgtttattctcttattctgtgtcgacatgttatactcaaattactcagtttccatttcatatgctttttagaggacggcgttatacagtgttctgttttttattcgcttctttacatgtaaaatcctgtatttagtatagaattattttatgtttactataggaaatgtgatttgtgattgcagactgggcagcgatgtatagtttatgtgtggtaatccctaaagcacgcagtaaagttacaaaatggtagaatagctggtaggtatactgggtgctcatcatgtgttagtccagtaacactttacaactatttttttctgaaccagagtaaatggcattttattgtggctggaacgaatactgaacaaactgcaataggaaatagctaaagctgcaaacaacttccagg

SEQ ID NO: 114166 - DNA, 1077 bp, Homo sapiens
ttgtttgactgtgtccatcatcagttacagggtaaatgtgcttcttttaacttaagttgagcacttgctcaaggtggaagagagacaggagcatagaactcagattggagccttggcagctgcagcgcctgcaaacaaaagcatcacagctttgtggtgtgtcaaggacagagaagaaagggagtcccaaacaaaagagactagtgtgagcttctcatgactcattattcacgaacaacctcgggaaatcgacaccacccttgcaaagagtctttttagttaaagttattgctttgaacttgggggagttgatatgcaacttacaattggcatttattaataattttgaagtgttacttttagacatgtgtgtcctttagaagagaccatggtcttgctctcttatctgtatgtttgatatttttcacgtttttgctacaaaccaagtattgatctttatttttaaaaagcttttttgaggtgtaattcacttacagcaaattgcacatatttaaagtctacaatttgataagctttcacatagcttttacacctgagaaaacatcaccactatcaggcagtgaccacacccatcattcccaaaggtctcctcacacttctctgtattccccctcccaaccctcccacctccatctctagtcaaatgctggtgtgctttctagcactaaataatagtttgcatttcctggaattttatcttggtgaactcacatggcatatactctttttggtaaggcttcttatacttcgcatgtttattttgagactcatgcatgttttggcgtgtatcaagactacgtttcttttcattgctgtgtatcctttatatagatagattaatattataatttgtttatccactcacctagtaataggcatttgtattgctgccagtttttggcagtttgtaaatccgctgtgaacattgagtacaagcctttctgtggacacatacttccatttctcttggacatcacataggggtgcatagctgtctggaaactgtctcaaggcagaaagctgctgcgatcgtgggtgtcccctcatctgtttctc

SEQ ID NO: 114167 - DNA, 1077 bp, Homo sapiens
tcctctttgctaacagactttcttttggatgtaaacccttgaaataagattgctgttttaactactttaaaaacaaatcattaaaagttgttttctttcagaagcatgtttttagttcaaaaagtctgtcttcatgcatacgcatcatgttagaaacatttacaactttcttttttttttttttttttgagacagagtctcgctctttcactcaggctggagtgcggtggtgtgatcttagctcactgcaacctccacctcccgagttcaaggaatcctcctgcctcagcctcccgagtagctgggattacaggcacatgccagcacacctggctaatttttgtatttttagtagagatggggtttccccatgttgaccaggctgttctcgaactcctgacctcaggtgatccacccgccttagtctcccaaagtgctaggattacaggcgtgagccaccgcgcccggctaacatttacaacttttagcaattcagaagataagtaataatattttgaaagaaatcttaggaggtgcctgattcctagtcctgaatctgggtggcaacctaggttttcttcccagctgttagataaggagatcatccaacgtcccttatcgcctccatatgacaactaataattttatatatttggtgactaaacacgaactattatgctttacttttattttggtaatcatgatatcttctagcaatgacttcttttgaacttggttagtctttacttatagatccgtaaccagttctgagaaagtagttgtgacaaaatgtaacgaaaataagtggggaaagatagttatggaggcaaaggtggactaatgttcctttctgtgtcccagaaattcctaatttgacttttcctggtttttattgtcctttcatgtttgaaatgaaactttgaaacgttttataaaagtagctcttcatttggggctggagggaaagtttgtggcagacctcactgccacttcagcggtattgatgcatactgtttcaggttaaaaatgctttacgctgtcagttgaaataactcatcgatgtgtctcagtgaacaa

SEQ ID NO: 114168 - DNA, 1053 bp, Homo sapiens
actaatagaagttgagcatctttatctgaaatacttgggactagaagtgttttggatttatttggattttgagatatacgcattataccagttgacatcccacatccagaaatctgaaatccacaatgcccagcgcaccatgttggtgctccaaagtttcagattttgcagcatttcagattttttgatttgggacactcatcctgtttgtatagtaatactcaatttttgaatatgtaagttccttgtttgtgtgtatctctgttgccttagcgtaaataacaggaagtgaaattgctgggtgaaaggtaatgaaatttttaaaagctgttctttttttttgtttgtttgtttttatgagaactagacatcccatcagcagtttgtgagtgcccatttctctgcattcttgctgccactgaatatttggatttagaaacagaaatcaaaatgatggcagatttatgagtggaaaatactaattcagtcagggaactatcataattgaaacagtggttgttagttttgtggctgtggttctggttgtgtgtttaaaaattctgatttttataacccaactttttgggatcatattctctgatttaacttaccttttctcgatctttgtccccagtgcatattgaggcttatttcttcacattaattaattgtttaaaaagcgtctcttgtatgccagataaaggctaatgagggatggacagactgtaaaacatgctttcactcttcatttcattggccagatgctacttcgtaaaatcagaagtagttgaatttttcgttttcgctgctatcaggcttgtcaaattaaatttaaaaatgtaattttgctgttgaaatcaagaatataagttctcttttccttcccaagtatccctatgagttaattcactcacctgtgtccatagtgtataatcagcagtgtagtgattggatccaaacagatagactgtttcatgggatcatctgagaacacattatcaaggatgtgatactaggcaataagcagttccttggcagctattaattcatgtt

SEQ ID NO: 114169 - DNA, 1090 bp, Homo sapiens
acttctttttgaaaagtagttgctttctgtaaacttgacctttctgttgtttcaatggcctgtttattcttttcagagttaaaaaggtcattttcaggtttatggaattttccatgtaaattttgggatctgcatgctggggtgattttctgctttatatttattgcggtactttttgtgtccttgggtttaaacgaatacaggttatgaaaacctaccctgccacattgtggctgctgcctttgtatctcacagatacacctgtttcatttgggcttcatcagtttcacgtcaagagttgtgactgaagcttaagtaaatatgtttattttgtgccggctgctggctggaaagtctactgtagcagctgaagggtgtgtgtttttttgggggggggcggggggggtactcttgctgggtgaaccatcattgtgacaggtaaatggaattcgtcaataaagcttgaattgcgtcccccttcatttcttccgagctgttgaatgtagggattgtcttgcttggaaccctattgattaggtcacagcctggtctgcagaaaacagagctgcccaggggccatctcactgcaggggatttgccgaagcccctgtgaaaggaccacatggggtccgcgattaccttatgaacaggaatcagttcagggagcagatacatattaaggacctattaacttctacaggcttctctttgacttgagaagcactggagagtgaagattccttcacacataatgaaaggaaattattgccaaagccaccgaaggtgcatcttgccatatctctgtgggtgcctctgttgagttgcaaatttatttcctgctggggcatctgcttagctttagaagtcccatttaaggtcatgaaaagggaatttggaaatgattacatagtgttggctttttttttttttttttttcagctttgagtctccatagcatttggacagaattagcgaactcccctcattaaaaaaatgatctttatttccaataaaaaggcagtatatagtcattgtagaagcctgggaaaatgtaaactactggaaaggagaaaacatgactaaaatttta

SEQ ID NO: 114170 - DNA, 1049 bp, Homo sapiens
ccaaagtgttggaattacaggcgtgagccactgtgcccagtccagaatttttatttaaatggacttgccgtatgttctttgacctctatggaaaatagccctgccataagttcttagttaaaagattctccaaaatgcatttgtgggtcctggtttgcttttagctttctattaatttttttacttgcctctttattcttagggctgcttgacattactctgtctcagacgtccgtgttcctcttatcacagtgcttggcacagggctggtaccgagtagctgcctgctcagggggtgttcatcttttcatagatcctgtgcatgtttgtcccatgatcctcttctttcgatttgttgcccagctgaaggtgtttacatatttaagtgaaaaaaggcgggtttgtcatgtaaataccaagttagtctgttggttgaggcaacaaaatggaaatcagttattttttaaggatctaaaaaattttaaaaggaagtgctttttcttaatagtgtggcaagctcatttagaagatggaaactgattaggaaagtatgaacatgagtaatatccatatgtggttttaattggcagaatgttgatttcagaaagaagtcacacgaagtttcatatctacaaagtatcaagattagagtttaaggtcagtaatttttaaaataagtgttctagggcctatggccgggcgctgtggctcccgcctgtaatcccaacactttgggaggtgaaggcgggcggatcatctgaggtcaggagttcaagatcagcctggccaacatggtgaaaccctgtctctactaaaaatacaaaattagctgggcctagtggcgcacacctgtagtctcagctgctccagaggctgaggcaggagaattgcttgaatctgggagctggaggttgcagtgagtcgagattgtgccactgcccttcagcctgggggacaagagtgaaactccgtctcaaaaatgtgtgtgtgtgtgtgtgtgtgtgtgtgtgtgtgtgtgtgtgttttatatataatacatattaaaaatt

SEQ ID NO: 114171 - DNA, 2031 bp, Homo sapiens
aattaggaggacaggagtttgaattccgtcgcggtggcagtcagcaagtcaagatcaggccagcgaaggcgtgggtgaatccaggtgagtgcctgtagcttcccttgtctcattggccattgaagagatggacaggtgtcatatttgtgtttgcagttgtaaaagtgtgatttaatcggtaaaaatgctgcccatctgaactggacaggacgttaattgttggaaggcttttcttgtggaaaccatgtttaagatggtggttaggtcccagctttcaggcctgcacgccaaagctaacgtgatttgtacctccctctgcatcgagttacatgaggccatcgttctcttgccttgtcctccttggtgccttggcatcagcagctgtcctcttggccatctagtacggggcaagaaagccagagtaagcttactcaccgtcccccttgccagggaactgttttttgtcctaaggatgtttaaggattgggtgttcgtaatttgttgagtgacctgtgtgtgtagaggtttaatgttcacttaatacctggtctgttctttccgtattacctaccgtgtacaactatgaaaattgaaaagattttaagctttaggtgttagtttaaatgttggagattttcttaccatttagttcccattgtttttactttttggattattttagttcgtagggctggatttgtcacgtttttatttattagtgtgtgttttgtgtactgttattttgcagttgcctttctggcatttttttttttttttcaaacagcagaccatgctgcttataaatagtgcatgctccatacaagacatagtgccacaaagcgcaatcttttctgtctttgttactaggaataaatggacttggaaagattgccgttcaagggcacatgcctgtacttgttgaattggcagttctccagtttcacagcagtgacagtaagtctaggaaactattcacatatatacttcaagggccagtcttatcaattaacttgccttgccagttcaacagtaccatatctcctcgaatatctgataccatgttgaactcggtccattgctaggcctccgagtggctcaacctgttgaatgggattctttagaatgtcttactcatttcatgttggggagagtctactaatacagtctttttagttttaaatcaattggttttttgtttttttttaataaaagttactcagctatttatgtagtttctgaagactgctttctggtttgtgataatttaaccatattcttatcacaggtaagctttttcttcttaatcatcatcagcatgtaattatagttaacgtttagtgagtacttgccgtgtacaggccctattttatggtctttccatagactgtctcactagattgtcacaattagtgagtaaaattacgtggtgttatactctgctcatggagttcatgtctgtgccaaattataaaaacacgacaaatgatggaaatatgatgcacgtcgacttagtgccattgaattttgaaatattctgttgcattttttaaaggaaagtagcgcgtgccagttgatgtagtttatggtgtgatgcgttaggaggcattctgacaatacagacgtgattcttgagctgaggtgttcatctgtcacggaatcctccttaacccgtttcactgtctcccatcgcacggggtccagtctctccgtggcggagccgcattgccctaacaggcctccctgctctcccatttaacatcacccgtgcttccctcactggctcctgtgcagccctggtccctcagcccctgccctgtgcagccctctacccctctgtgcctcgccgttttctgtctccctgcctttgggcatacagtggtcagctcgtattatctcataactctacttaataaagctttcttgacagccctcttcgttacgtggagctgtttcttatcttttatgtacttaaacatatgactgcagtatcactctagtgtaattgtttatttacacgcgcctttcctctag

SEQ ID NO: 114172 - DNA, 1945 bp, Homo sapiens
taatattgcgctaattaatatgagcctgtgcaggagtgctgtggctctggggaccaacaacctgtccacgtaactgtttgcttcttgtctttgacttaaagctactagtgttggttgagtattataaccaaatttttgtcatattttacctatttcaacctagtcaaatatgtgtatcatttatatacttttcacagaacagagaacctatccagcaagctgaatgaagttctattttaagatctttccttttcttctctttaaatctgcttaaattggaaacatcctctgaaacgtagttttctgtttttgtagaagtagaaattctatggactacctaaaaatctgtcaccaaacggacagtcctgttagctctgtgttcttagctccgtggtttgtacatgttctgcaaatggctttgcagcgagagaaagcgtagtggcagagtggggatggcgggcgtggactctgcaggtctcacggtatcatctgcccttcctggagaggcctctggatgttggtgaactgttctgacagatccatgccacgtgactgcccttccatgtgaggtctggaaggggagagggccatgtgaacaattatttggaaagtcggtctcgttagagagccagtttccagagctctaattaagattctcctcctcagattgctatctgtaaggtctacagtgaggattataaagtagatttaacaaagatgtttagcggagtaaagatctttgaagcatgtgtaatcccacattcagggttcggtctgcctgccatgcgtctcagcatccaaccccctcttctacttcagatccattctctgttgctttgttgtaagcttcaacaggttttcctgtaatttaagcagaataaaatctggagcatccctcttgtgggtgtgtggaataaatttggtgtagtgttcttagctgatgtgtacttagcaagttaattattacttgagcaccaatgaaatgctgcagctttttgttcatttttaaaactaagggaatgtctagaaaaatgcctggccagaagattttgtagaaattgtgaatagaagttggtgttgaagcagtgttgggttgaggtctgttccctgatgtgtgtattgcgtacaggacgccctggaatgtgtttgaccttcagtctagagtagtttggttctctttttggctgttaatgttagtatacaaagcagcccaggacgagtgtttccccttctgactctacttatttggggagcccgtgtttttcattaagataagagcagatctctaaacatattactgctgtgttacttttagcatcccaatcctggtttcaggattgaaatttacgttttgatgaaaagactgggaatgaattaatatggaagtacagccgttgtcacaacttaagtcagcattcatgaaatacaggaagggaaatgaggacatttttcttaagagaaaatggctgcattcacacgatggagagtgttggagcaccatccctgtgtcacctgtgtggaggccggctcctggcctcatgtctgtgtcacctgtgtggaggtcggctcctggcctcatccctgtgtcacctgtgtgggggtcggctcctggcctcatgtctgtgtcacctgtgtgggggtcggctcctggcctcatccctgtgtcacctgtgtggggtcggctcctggccgcccggcttaggtgcacacaggtgagtgcgtttctacagtgggaacggaacggaattccggcccaggctaacctgattgttgacctcagtcagggaaaatgtttctggagcttctgtctggttctgcagaactctgaatgtttcagctatttattattcattcaagttagaaacccttttcctcatataaagtaggatattttacttacatcctgggatccctgctcctgctgcacgtcctcctgtgacaggag

SEQ ID NO: 114173 - DNA, 1052 bp, Homo sapiens
gcactttgggaggcgcaggtgggaggattgcttgaggccaggagttcaagaccagcctgggtaacagcaaaacctcgttcctaccaaaaaaaaaaaaaaaaaaatgctggggtggtggtacacctgtagtcccagctacttgggaggctgaggtgggaggatggcttgagtccaggaggtcgaggctggagtgagctgtgattgtgccgttgcactccagcctgggcaacagagccagactatctcaaaaaaaaaaaaaaaaaaaaagttattttggaagttgtaatatattttttgtgcttctattaatgcaaggaattctttctctgttggttatgtgccactagcatatggcctatgtattaagtctacagactatatatcactatctaaaatacccataattagtttatttcaagagaaactagcataatcaacagcatttgataatcctctgaagagtagaatgtcttttttatcattttatctgtccagtataagttagaattttcaaatactgtttcaacatagaaaaataccccaaatttaacaactgaagctgagtcaaactgtttttgtaaaatttttgaagaacagttattcctactttttttccttctccaaagtaggtttcaaaagcctataaagaactgttaaaagttaaagttgagacaaaatggaaccaaaaccttaatttaaattctcttcatgactttgtatgaacactgccttttgggttttttctttcaagtgaagaagagtatttttattgttgctttttaaggaatcatttcgaaactagtatttttcacctacacatttaagagattgggatatttttactaccaagaaaaaaaaaataaggaaacaaccagccaaacgaggtggtgtcccaaaatagatttatggtattttccagaaagggcagtgccagacttttccagtagtaatttagtgggaggcggggaggtgttgggattgtgggcagtgtggttggtaagtatataagaaactgtgtgtaaatattgagatttaaaggtgagagagaagct

SEQ ID NO: 114174 - DNA, 3470 bp, Homo sapiens
ttttaacagttgcttatatttgccttaacgatttaaatataaaaatataacttagttgttacagttagtagcctttcatttgatactcatgaagatttttgagtcgtttaaatatgaaagagaggaccttgtcgttcaaaaatgaaaaggaagtttttgttaagcttaataattctagacatgttacaagaatgttgatacttatattggaaaacatgaaaaacatcccaaaccgttgcatttatttatattccatgtgtatggaaaatatttttttaatgagaagtttaaaacaatgtacacacttttgcttgttttatttccccaaggtaacgattctgatttcttctgtttcagattcccgacagttaagcaatggggagacatttggctttgctcctgcttctgctccttctcttccaacattttggagacagtgatggcagccaacgacttgaacagactcctctgcagtttacacacctcgagtacaacgtcaccgtgcaggagaactctgcagctaagacttatgtggggcatcctgtcaagatgggtgtttacattacacatccagcgtgggaagtaaggtacaaaattgtttccggagacagtgaaaacctgttcaaagctgaagagtacattctcggagacttttgctttctaagaataaggaccaaaggaggaaatacagctattcttaatagagaagtgaaggatcactacacattgatagtgaaagcacttgaaaaaaatactaatgtggaggcgcgaacaaaggtcagggtgcaggtgctggatacaaatgacttgagaccgttattctcacccacctcatacagcgtttctttacctgaaaacacagctataaggaccagtatcgcaagagtcagcgccacggatgcagacataggaaccaacggggaattttactacagttttaaagatcgaacagatatgtttgctattcacccaaccagtggtgtgatagtgttaactggtagacttgattacctagagaccaagctctatgagatggaaatcctcgctgcggaccgtggcatgaagttgtatgggagcagtggcatcagcagcatggccaagctaacggtgcacatcgaacaggccaatgaatgtgctccggtgataacagcagtgacattgtcaccatcagaactggacagggacccagcatatgcaattgtgacagtggatgactgcgatcagggtgccaatggtgacatagcatctttaagcatcgtggcaggtgaccttctccagcagtttagaacagtgaggtcctttccagggagtaaggagtataaagtcaaagccatcggtggcattgattgggacagtcatcctttcggctacaatctcacactacaggctaaagataaaggaactccgccccagttctcttctgttaaagtcattcacgtgacttctccacagttcaaagccgggccagtcaagtttgaaaaggatgtttacagagcagaaataagtgaatttgctcctcccaacacacctgtggtcatggtaaaggccattcctgcttattcccatttgaggtatgtttttaaaagtacacctggaaaagctaaattcagtttaaattacaacactggtctcatttctattttagaaccagttaaaagacagcaggcagcccattttgaacttgaagtaacaacaagtgacagaaaagcgtccaccaaggtcttggtgaaagtcttaggtgcaaatagcaatccccctgaatttacccagacagcgtacaaagctgcttttgatgagaacgtgcccattggtactactgtcatgagcctgagtgccgtagaccctgatgagggtgagaacgggtacgtgacatacagtatcgcaaatttaaatcatgtgccgtttgcgattgaccatttcactggtgccgtgagtacgtcagaaaacctggactacgaactgatgcctcgggtttatactctgaggattcgtgcatcagactggggcttgccgtaccgccgggaagtcgaagtccttgctacaattactctcaataacttgaatgacaacacacctttgtttgagaaaataaattgtgaagggacaattcccagagatctaggcgtgggagagcaaataaccactgtttctgctattgatgcagatgaacttcagttggtacagtatcagattgaagctggaaatgaactggatttctttagtttaaaccccaactcgggggtattgtcattaaagcgatcgctaatggatggcttaggtgcaaaggtgtctttccacagtctgagaatcacagctacagatggagaaaattttgccacaccattatatatcaacataacagtggctgccagtcacaagctggtaaacttgcagtgtgaagagactggtgttgccaaaatgctggcagagaagctcctgcaggcaaataaattacacaaccagggagaggtggaggatattttcttcgattctcactctgtcaatgctcacataccgcagtttagaagcactcttccgactggtattcaggtaaaggaaaaccagcctgtgggttccagtgtaattttcatgaactccactgaccttgacactggcttcaatggaaaactggtctatgctgtttctggaggaaatgaggatagttgcttcatgattgatatggaaacaggaatgctgaaaattttatctcctcttgaccgtgaaacaacagacaaatacaccctgaatattaccgtctatgaccttgggataccccagaaggctgcgtggcgtcttctacatgtcgtggttgtcgatgccaatgataatccacccgagtttttacaggagagctattttgtggaagtgagtgaagacaaggaggtacatagtgaaatcatccaggttgaagccacagataaagacctggggcccaacggacacgtgacgtactcaattgttacagacacagacacattttcaattgacagcgtgacgggtgttgttaacatcgcacgccctctggatcgagagctgcagcatgagcactccttaaagattgaggccagggaccaagccagagaagagcctcagctgttctccactgtcgttgtgaaagtatcactagaagatgttaatgacaacccacctacatttattccacctaattatcgtgtgaaagtccgagaggatcttccagaaggaaccgtcatcatgtggttagaagcccacgatcctgatttaggtcagtctggtcaggtgagatacagccttctggaccacggagaaggaaacttcgatgtggataaactcagtggagcagttaggatcgtccagcagttggactttgagaagaagcaagtgtataatctcactgtgagggccaaagacaagggaaagccagtttctctgtcttctacttgctatgttgaagttgaggtggttgatgtgaatgagaacctgcacccacc

SEQ ID NO: 114175 - DNA, 1024 bp, Homo sapiens
cagatggtctttggagtttaatttccataagcaaaggagtctaggcgataaggtcctttttagatgaaatggtgttggagtctctccccgcttcagctttactgtttgttttgcatgagagccacagccattgttttgatcagggtggtttttatagtgaaacctgaattcgtggttcttggttacattactgcacggttaacaatgtcttccaaaaagtgtattttttcatttaataatttattctactcacagtagcattctgttagccaagtttgcagagtacattcaggtttttcaaagatttcagttaggaatgtggtccacaagtccgtcccagctgtattgtgtcccgtgagaactgctgagtaggatgtggaaggtaattgcatgtttgggaatccagttggggatgagtgggtggtggtgggggctgtggtgggactgagcacctgggacagcatggggagagaacagccaaagcagtctgacgtgttggccatggtctgtgtgtcttaggggatggaacagtgccagagccttctggtggggggatggagggggaagcagcgtggcgcatcagcaagtacttttttttttgtttttgagacagagtcttgctctgtcacctaggctggagtgcagtggtgcgatctcagctcagtgcaacctccgtctcccttgttcacgcgattctcctgcctctgcctcccaagtagctgggactacaggcgcacaccaccgcacccagctactttttgtatttttagtagagacagggtttcaccatgttggccaggatggtctcggtctcttgacctcgtgatccgcctgcctcggcctcccgaagtgctgggattacaggcgtgagccaccgcgcccagctggattagtgagtatttatattatatagaactccaagttctaatgttaggcttcagctgtagaaaaatctttatttactcactgtttcttatcacaccactatgctgtggttccctttcctccctcagtggccgacatc

SEQ ID NO: 114176 - DNA, 1011 bp, Homo sapiens
gttctcaacctgaggttggttggatccatggatgcagaactcttatatagtgaaggccaatcgtataacttaggtttgatggtattttaggaggaatgttacgaggtgtttgagagaggttagagctgaaattgcagatttggtgcactgatccttcatgatttgaggcagagtagatgagatctttaagggtggtaataaatgcatgtggaggaagagttggaagacaagtttgtaatgccagagttgtaggtgagtcagtgtagagtataaaagagtatggaagagaatcaggagaatgttgtcattcatttttcatacctgtggattgcctctttgttttgggggactctgtgaccgaatgaaggatcaggagtgttggggaggggagtgagtggtgtcaaaggtgtcatgaaatcaaggaggatgagcactgagaaaaggtcattggtttgacattagcttgtgatgcgggaacggctgttctgccagggtggacctgcaggatctctgtggagcagcgtttggcggagagggagttctaaggaagccagggcggtgctgtgaaactccttttcttgcgatctttgccagtataaaaaaagagaagaataagagtgtttgtttgaaagaagcaaaggtttgaatgaagtttattttattttattttattttatttttttgagacggagtctggctctgtcgcccaggctggagtgcagtggcgcaatctcggctcactgcaagctccgcctcccgggttcaagcgattctcctgcttcagcctcctgagtagctgggactacaggtgcatgccaccacgcccggctaatttttgtatttttagtagagacggggtttcaccatgttggccaggatggtctcaatctcttgacctcatgatctgcccacctcagcctcccaaagtactgggattacaggcatgagccaccgtgtctggccaagcttattttttaagtaggagaagaacctgtgtgtgtgtatggattc

SEQ ID NO: 114177 - DNA, 1056 bp, Homo sapiens
accaacctgaccaacatggagaaaccccgtctctactaaaaatacaaaattagcggagtgtggtggtgcatgcctgtaatcccagctacttgggaggctgaggcaggagaatcgcttcaacccgggaggcggaggttgtggtaagccgagatcgtgccattgcaattcagcctggggaaaaaaaagaaaagaaaaagaagagaagaaaaatctttaaaaattatgcacaaactaattctgttttcattcccctgatcatcctctacctttccattgcctttagactttgctttgaggtccctttgaagcagtcgtttctttgaatgttagaggtggataggatcttagagattatgttttaacactttacccgcttgctttccacccaagtttggctgattttacgtagaatcaatcagccaaatcaaattagtacattattattgcattagattctgtctcagtggcataatttgtagcctaaaggacctgatttaatagcagggagccgtaaggctggatgtgctgtttaatctttatgagtgggatttgcgctagataattgttcttttgaccaaattatgtagaagttgaagccaaactctatcttttggtctcacttaattgttcagtttgcaagtgcttatttatccttagacactggagaagagtttttgaaatgagtgatatacatcagttaagatcaggaagttgccattttctcatacctgaggggaacttttcatttcaaaaatatattctgatgaggaatctgcatatttcactcttttaagttttttaagtcatcttttactgtaagtcccagatttaaatacattgcctgaattcttgcttaattccaagggttcattatgtatgtgaagataagtctataaagtaaaaataataaaggcttctatacactgcttaggaaatattagtcatgatttaatctgtatccttcatagaatattaaggttagagctttgtgataatctgcaacacagacactgatctggcattatctatagccaattttgaggcagcgtaaggtgg

SEQ ID NO: 114178 - DNA, 1045 bp, Homo sapiens
taagatctttttaaaagaaagagtttttggtccttcattgcctttaaaaaaaaatgctttcttttagagagccagctttctgctgtgtgttagatttttttgttcccgctgatgtgaattgcaaggctttggaaacaaggacgcaattgtatgagttaggaaagtaaactcataaatattttctatgcagttaagtttttttttttgtctgaactgtggtttcattaagtggcttttgttaagcaattcccgggtgcctgatagaggcgattttttaaaagtggatattaacagtgattattagtatgagaaaagattgaaaagaaaatgaccttcagatattcatttccttttcaaaagcagattcttaatgcttcgtatattcagatacaggtttcgatagtttaagaaggtatctgtgtgtgagaactaggtaatggtgatgtttttcacactattcttaatgagtttggttatgctgtccaacacatccagttgttacagggacgtttgaaaaggtgtttctccagttaatagttaattgtgatatttgtctttgtctttttgtcttaggaagacagctctgattccacagttagaattattcctttgtatttaagatgtaaaaatacttaaagcactatgtaattttttaaaacaacaattggtataagccttgagtgatgctaaacatggcatttaacaagctcaaggtaaggtttgatttgaatgaagtttgcatttgtataaccattttttgaaaaatgaacaccttaaatgagccaaattctttggcactctggaaagaagtgtggttgttagaggactttataaaatcatttcgggccacctgtatattcatttgtctcttttgaagtatccccgttgggttctcatcatgttagtagatcatttaaatccatggtccggacaggtgccaacagaaaaatgtttaaaaattatggccgggcgtagtgcctcacgcctgtaaacccagccctatgggaggtcgaggcgggcggatcaccggaggtcgggggtccga

SEQ ID NO: 114179 - DNA, 2432 bp, Homo sapiens
agcaaaaatctggcaggcgacacatcgcgacgaatttcggctgcagaagaggaagagcatcacctgcagtccgcggcgtgggaaacgccgccggaggggctccgcgagccggggaagtgcgcgcagcggggctccaggcggctccaggcgctgagtgcgaggaacgcccgcgctcgccggcgcccgggagacgcagccgaaggaggagggcgggcgtttcacccgcgccacagctgcggccggccagagagaccgcagaggccgggacccccgcagcctccacggccgctgctgccactgtcggggtggcgcgcccagccggagaatcccgtccgcgcccggggcggggggcgaggcggggcgctgacgtcacctcccctcccccaccgcctccaagggggagggagtggggaaagaggcagcgagtcgccgcagccggcggccgcaactcctcaactcggcggctggctgcctgggcacgtcctgacaaacttggctgctcccgggccctcgttccggccccgcgcactctcttttcgcctgcgtttggtgcttaagtttgccctggtcggaagcctccggagatgcggccgcctgggtcccggcggcacggacgttggcactctggttagggacatgctgaagatcccggggaggcaaagttggtacttcaaacccggctcttaacacatatctacaccgcgaggggatcacggagctgccgaggactttagagcccagggccgaggactcggctagactggtgagttctttgttcaaatcgtgcatgccttttggcatttaagtttaaacgttaatgaaattacgtggggtgtgtggctctaagcgagtgcggggaagcgtgtgcgccctacgggttctcggctccaggagctgcgcatccctctggctttgtgcggatcggcgatgaaagattcgtatgcatagctttgggagttcataaaatacatatagagcactgttaaaaagaacttgagaggcgatgctgtttgtgcattattttgaatgtaacttattatagcaatggtgcctagggagggcgcatcggggccgcgagatttgcaggggcgcagcgccctctagtccgggcacctggcgaggcgcgctccttgcagggttctgtgcggaggcgaacctggacctccccggcgctcggcgacgtgggcgcttgctcaccccagtcttcactgaccacccacccgggcccattctttatatgagttacaaaaatcagcttgggtggactggatgtagaggccgtgctggaggaaagcgttttgtttctggaaccgtctccccaaccccctccctaatttccacgagcctttggggacagggttagggagggtcgattatttaaaggacaaatgtggaacttgaaccacatttctctctctcatataaaataattcgatttgtggtagctaataggcatgtccatttcgttctgttggcgcttaaggatcagtagaatcgtggcagagtcctaagtctgaaatctccatccctggctctcggcggctcctgtggcgacgaagtgcaacttcttccaggcagatagatttctcagggagcctggaaaatcgggattcccagacagatgtaaaacatctagtaagccctaggaagcgttattacttattaattaatggtaatcttctccaggaattctcttgtgccatttaaaaaaaatcccgtgattttacgtcagggaatggtatctttgtactttttttactgttcttcttttccccttttagcattactcccgcttcctcgctcccaggaaacggctggagttccggtgtgtttgggttttgctgagatttacaattcggcaagcggcacaagccggttgggcttggagatcaggtcacccactttcgaggtgttccatgtatgaaattgacctgtaagcacttggagcaattatggccgggacaaacacgtctttggatgatggagtttgcatttgctggatgtgtgaatctatgtgtattccaactggtgggcagggaatatagggctacgaatcggcacactcatcttgcaggcattatttttccttcccagccacaacctgctagacacctttattattattattttttccggtcacctctaagatggcttataaggtgactgcgttaactttgaacccaggaaattctctttcacacttgactgccctgccgttcccctccccgccaagctcccctcaccagtcccagggaaatcggatctctttgtcttcccagtgttaaaatgcctgagtcccacaaactttccgagatcaagtccgccctcttgtccgggctgcgtcccagcgcctccggccctccgggcttcggccgagtccgccctgcgccgagcctgcggctggagccctgcccgcaccggggatgggctcc

SEQ ID NO: 114180 - DNA, 1062 bp, Homo sapiens
aattttaaatttagtataaaatttccaagacccatttatttaatattccattttaggatggcagagattctctccttgactgaaatccagccagcctcctctgagctctcttctccactagggcccgaccttggcctatcaagacttgaacaaacactagcacagtttcccacagctgaaggccgcaaccctcaggtgaccccagtcccccataagtgcctgcctgagcaaactcaaggctgccaaaagaatttactgtttgttccagcccacacctgaagctggagcccctgcttcccagcctctgtgtgagggtaggagcctaacgttaactcatgtccagctttggcaaagagtacattttatttttatttgctctgtcactagggcatccacattagccatagtgctgcaggatttcacatttcagaaaatctcaagcaaaatgtaatcatagctcctgtgaattgtgcatctgctgtgacccagacattgtgctttcctttactcccacccattcctcatcacagccctgcaaaaagaaaacaacagcaacaccgtgcacaggccaagtggcttggtgatagggctagtacacggtggcggagactgcggacccagcgtggcacatcacgggatgtatcattctgctcagctcgtcaggctggcctgcaccagtgagcgctttgtgtgctaccaactgtcataattattgagctaaggagctcgataattatcagtggagaaaattccaaggctgatcatattagagctttacttaatttttgatacctgattgccgacagttttgaagcctgacctctccctcctcctctttgctcacatctgcgcaagctgatgagaatgtgtgggctgctgtcttttggcacccacaggaaggctctgccccaccagggaaccctcaccccagccccaccttcaagccaccacaccagtctcctttcctggctcgttcaagacatttttggatctgcctgggaattgctccctgatctccccaaaagctctcattatgtgagaaataaagcttttcctgttctc

SEQ ID NO: 114181 - DNA, 1110 bp, Homo sapiens
atgcttccgctattacagatttttgtcaatcttctccttggtgttaatcagtcatcaagagggctttaaagaactacaggtcccagagcaacccaaaccctattgaatccaaacccttgggagtgggtcaaggaatctgtaaagggaaatgtcgtccaggtcatgccagtgagcagccgagtctgtgaatggctacttcacatgcgtgctattgattaactgagaataattcagtcccaatgtcagaccatgctgtgcatctacatgttgacacaaaatttttctctcttaagaaatggagatatgtgctgcattctatcaatttattatctggaaaacctattcaattcatggatattgtcttgatctaggcaatctgtagtgcttgcatttaagagttcttatttttcataagctctttacttggttttgaaacatatctgctggtgcaattatattttcttgcttccagttttctgtgagaaatgtcatgagagaagaattttgttaattataccacctttacactgtcagcatcaccttttgggataaaaattgtaatagcagtcagagcagatggtaatgaaaaagaaagagtgacttcttgagaaataaaagaaggaaccaatttatatgtgctttgctctcctgactttaaattttaaaatcaacagtataaagcacaaaagagattgcattttgcaacgacattttttcaagtgatacatacattgggctggtgaaattacatttttatgcaatggaaaggcattttttatatttaacttttagtttttattgattcttgggtagtttattgttaagcttttgtatatttcctagatacaccaagtaaaaagtgtgtgtgtgtgtgtatacatatatatatatatatatatacctaaatttttattttattttattttaaattccgggatatatgtgcaggatgtgcaggtttgttacacaggtaaacgtgtgccatggtggtttgctgcacctatcaactcaacacctatgtattaagccccggattcattcgctatttatcctaatgctctccctccccttgtgcccccaacaggccccagtgtgtgttgctccactccc

SEQ ID NO: 114182 - DNA, 1111 bp, Homo sapiens
gaaagatccttgaaaaaagaaattagaataccaatgggaccgatagtcatagaatcaggtgacatgcaacttatctagaactaatttgagaaacgccttttgttgttgatatttatttagccaacatcatagagtgccttttggggtgattaagcactttttggctagtcacagatgcttatcatcaccatgagatgctacccctagtacagttgccttcgtattaatgactcttattttcatacgtgtagttaacataattataccaaatgtgaagatcccatagcagttttataacaatatttgttgctgacatttattaagcagttattatgagataggtactatataatttcatttatttatattaacctgccttatttatctatacagactcatttatgcatttagtcatttagaatctaggcagtgtctgacacatggcaggcactctgtaaatactaatgaaattaagggtttaattaattctgtttacctaaattcaactattttaaatttgcatctgtcctcttatcttaatggttgctttaaatgtgttttcttttccctgacctatgaagcaaagtaatacaagaaattaggtaaaatattgtatttggcatacctgatacaacattatgctattacaattcttgtgtttctagtctgtagatcaaaagggcatagcctattacccaagataaattgtctgtataaaagatgtgaaaagataacaagaaattttatgaaagctttgggtaatcatctttttttttccacctcactcttcattccattataaccagtaagtgtccattaagttttgccgcatcagacattttcagtgtttaatgactgttataaaagaggcaacaatacatcagagaacaaacattggagaactggaattccataaaaagctgagttgttgctaagtaaaacacccagtaggcaaatcattccttcaaccgcagtgccagacattaggtcctactttatgttggagcttcgagaaatcttccagccaggggcagatacatcaataagcctgaagacatgtctcttttttttttttttttgagacggagtttcgctcttgttgcccaggctc

SEQ ID NO: 114183 - DNA, 1014 bp, Homo sapiens
ttaatgcttacactgggccatcctgagcaaatcaagttattcattcagtctacttctggaggatatttgcagatggcagtctattttttcaccccaaatttccttgctacttcccccgtagtattttgtttcctataggaaataatttaaaaagaagaattttctctattttgttaaaaggccctcaaagtacacgtcggattggaatcatgaatatctatcaatcaactctttcatagtccatttctgcagagtggatcttctctgacctattccatgctatatcttttggttcaatttagtatctatacttcattacacacttgaatagctatttaatcttgcacaaacacccatatggtgaggtttgaaacctggcacaagagataaaggcaaataattactatcctcacttaacattttatcttcttgccatttaaaacctttttgtagaagtgctgataatctggatgattaaatggcttaggtccttctgatagatttttatggcctggactcaacaaaaacttaggttttaaaagttcagttgcaattttatctgaaacctgaagatagtttcttatacctgcaaaaaatgaactcatatgaaatgaaaaatatgaagtgatgttgtagactgagcacgttattacagactctgctcacacaatggaagtgctaagaggaaacatgaactatttttttaaaaatggctgagaatgccacaatcatgcctccttatttgcttcctgtaatacaattattttactgacatatgttcaaaatgtcctctttaacaatcattttggaatactgtttaaagcatatcagaagtagagtggaaagtgtattaaacatggaggaagggatctgtgtcacaatccagattccgatattgattagctctgtgatcttgaaaataaaaatcaccttgctgaagtctgcatgcctctttgtgtatgcgagtaatcctcaaaacaggcaagctgcagtggctcatgcctggaaccccag

SEQ ID NO: 114184 - DNA, 1035 bp, Homo sapiens
catttggtctgaaaagtcattttgatttgcttagattttaaaaaagaacctgagatgctaatatagactaaaacaaaatcagctgctatttaaaacacaacccccaaagtcacacatatctaaatatgcatctattttttacaataaaaattataacttagaggccgggcgcggtggctcacgcctgtaatcccagcactttgggaggccgaggcgggcggatcacgaggtcaggagatcgagaccatcctggctaacacggtgaaaccccgtctctactaaaaatacaaaaattagccgggcgtggtggcgcgtgcctgtagtcccagctactcgggaggctgaggcaggagaatggcgtgaacctgggaggcggagcttgcagtgagccgagatcgcgcccctgcactccagcctggacgacagcgagactccgtctcaaaaaaatatatatataacttagaggtgaaagaaacctcagaaaatcattgtctaccctttgccttttggtggtttggtggtggtagtacttcctttgtggctgtgaatgaggagggggtaagaagggaataaatgagaagcttgaatttttttcattgttgttgcacagcttcatcattagtactggctataagaaagtctttcatcatagaaataaatgcggaaaaacgctttttaggaatcttgcccttcacctatgaccgcttgtattagtcactttgtgctgtaaccgaaaccctctgttgatttcttcttcacactgcacgcggctgctaggcagctgaatctctgctgggctctgcgtgttttctcatgtcagggttcacactgaagaagaaacctctgttgtgactgaggcggagagacacacttacacacacacacacacacacatacacacacacatacatacccacacatacacacacacacacacacacacacacagaggggaagcagtaagcatgtaatcacatttaacccagatagaaacaattacccatttacaacactattattaactgtttggtatgt

SEQ ID NO: 114185 - DNA, 1244 bp, Homo sapiens
accagcctggccaacacggtgaaaccgcgtctctactaaaaatacaaaaaattaactgggcctggccaacatagtgaaatcccgtctctactaaaaatacaaaaaattaactgggtgtggtggtgtgcgcttgtaatcccagctattcgggaggctgaggcaggagaattgcttgaacccaggagtcagagattacagtgagccaagatcaggccactgcactccagcctggacaacaagggcgaaactccgtctcaaacaaacaaacaaacaaacaaaaaacacaaaacaaacaaacaaaacaccaagtaagcagcaatctggtctgagaggcggaaaatctgtattttttggaatattcctcatgtgttaatatatgatattgttgttaacttagtgtgatgtttactgaaagtcgcaagtcagcaataatagatatgtattgagtggccactatgtgtcaggcactgatctaagcacttgggaagcatccacaaatacccctttcctcccggaacttattaatacagtcaaatagaaagcatttgtttccaataaataaaaatgataagtgtaacaaatcagtaaatgatgtgataattaggtgatacgcacatacctgctatggaagaaggaaaacaatagaacatgatcagagcaattgggaatttaaaatgagttgtaattttaaacaggatggacaggttgagtcttattgggacggtgcatttaagtgacaatgtgaagcaggtgaaggaatttgccaagttgatctggggaaaggaagtcctggacagtgagaagagccagtgcaaagccagtgcagagagcgtgccaactttgtccgaggagattgaggggcagggcagcggcagattaagttaaactggtaatggggagggaaagctcctcaggccttgtgtggactttgtcttttattctgagtgatgctgagagacagcatctgatttaggtcttacctggatcactctgactgctatgtttagaacagtctttagggcaaaaaggaggcagaagtcactttggtggaagtgaatgaggtcagatgtgggatatgtgcaaacttcaggtaactaggattccataatggattggatgtggggagtgagaaaagcagagtctaatatgacttccagggagtttggtctcaggaatagagaagaatgaacttgtcatcaactgaaatggggaaggctgcaggtttagggggaaagtcaggactg

SEQ ID NO: 114186 - DNA, 1170 bp, Homo sapiens
aaatgtgggttggaaatagaaaagaaagccagaaatcatttgaaatcatgcagataatgaccacatcttccaccagtgggtcacagattggctttaaactttgtagcagcaaactcataaagagaaaacggattagttacatgcttcctaacatccacaagataacaaaaaatccttattgctcgagacaaatgtcactcctttaagaatcagaagaaattactcctggaaatttgccatgaagagaaaattgtaatgtactccacatgcttgaaaataccttctgagttagtgagagtcctcaacaggacgaatgtgactgggtcatgtattgtaagaacaaataggctggtggtggcatgtggaagcctggatgcggagaggtcaagaagcttctgtaggatactagtacagttcagcgccggtttccgattctcagctgatctagctgatccaagagtggattttaggaaaagctggaagaatatggagattgctttaggaaagcagcatttaagtgaagcctggagagacaaagccaaaactgcataaaagcagattgagggagtgacatgagcaaaaggggggaaaagattctttgactggagcaaggtcagtcgctcgatgtggtgaaagccgtggttctcagcacagcccacacgttagaatcacccggaatgctccccgcagagcccagaccttagaatcacccggaatgctccccgccgagattctgactcagtcggtctgggctgggtcctaggcataattattttatttttattttttatttttttgagatggagtcttgctctatcacccaggctggagtgcagtggcgtgatcttggctcactgcaacctccgcctcctgggttcaagagattctcctgcctcagcctcctgagtagctgggattacaggcatgcaccaccatgcccggctaatttttgtattattagtagagatgaggtttcaccatgttggccaggctggtcttcaactcctgacttcaggtgatcctcctgcctcggcctcccgaagtgctgggattacaggtgtgagccactgcacccagccataatttttaacagctcccaaggtggtcctaaagtgcacccgggaatggggatgctgggccagcactgtgttccttaagtgtggacagtgg

SEQ ID NO: 114187 - DNA, 1043 bp, Homo sapiens
tccctgtacgatatgcatctttccccagtcttatccccagagcattttgcccccaacaaaatagcctagtgaggaatatgactgcatcccaccgacctcaattatcggcctacggggtgggcgttcaggccaaccagggccagccagggcttttccgggcatctttcttctgtgttgcttagctgggagactgtaaatttgttgtcaccagcactcgcttttcctgtcattggaaaaagtcaatctacataaagccaagcagagatgtgaggtggatgcaccagataacagctcctggccatactgaactctgccttccaagcctcgatttttggcagggcttcttccagttttgtgagcttcatcagtattccttttagtcctgcaaaccaaccaacttccattctattgcttgaactggtttaatgtatatttctatcctgcgctgtctaaggagtcctgaataatatagaaaggaagcaaagatggaaaaaagagcatatagaattgaccagcatgaaggttattttgttataactagagtagctaagtattgttactagcttcttagaatgaaggaactataagttgagattataaataactttaaatccagtctatttattgtggaagatggcatgcaagaagctgtacataaccgtcaatacagagacagtgttcagaattctcaagtctttttgccccaattaaagcaccccagtcatgcattgtaataagagatgaatactacttgaatattgttattaaggttccagtaattataatgatcgaaacaagattatcataaaaatttctcactgagtgtaggacacgtcacctgggtgggattgatcctaggctccagcaaagttaatccagctcctttgcataatttgaagatttcaggacagctttttgataaattgttcccttgtgtagtaacattctctctctctctctagctatatatatatttataaaatatatgccaatcaataaatatttgagtctttatctgaaagtaggagaaaagcttataggct

SEQ ID NO: 114188 - DNA, 1032 bp, Homo sapiens
tagctaggactacaggtgtgcgacaccacgcccagctaatttttgtatctttagtagagatggggtttcaccatgttggtcaggctggttttgaactcctgacctcgtgatctgcccacctcagcctcccaaagtgctgggattacaggtgtgagccaccacacctagcggattaccctttcgatagaccgtgttgaggaccgtcttgcctggagcaaggatatcaatgcttacaatggtgaagaatccacagaaaagttaccttttcgcatcatccatgataagaatcgggaccttttcatcctgttgggcatgctggatccagcggagaaggatgaaaaggacatgcctgtgacagctcgtgtggtgtttgttattggtcctgataagaagccgaagctgtctatcatctacctggctaccactggcaggaactttgatgagattctcagggtagtcacctctctccagctgacagcagaaaagagggttgccaccccagttgattggaaggtggggatagtgtcatggtccttccagtgattcctgaagaggaggccaaaaaacttttcctgaaaggagtcttcaccaaggagctcccatctggcaagaaatacctccgccccacaccccagccttaagtctcttggagaagttggtgctgtgagccagaggacatccgctgccaatcatgttttcctgctgcaattccatgaaaacatcctggtgtcatcacaccaaggtttttaggttgctatactactggcttattaaatgaaaactggcactaaaagtttcttgggattctttacactctgtcttcaccagcattcaattctgttcatacatcagcactctctactggttctctttgaaatatgttctgtatttaaaactcaaatcttgttggatctctgcagggcttgtgaccaatgaggtcatatttgttgatggttgagaaagcttgcttccctccatcagagaatgactatccctccatcagagaatgactatcaatttttttaactgtcc

SEQ ID NO: 114189 - DNA, 1057 bp, Homo sapiens
tccgctaatgttaacatcctacacaaccaatgtacatttatcaaaatacagaatcaacaatggtgcaatcctgtcaaccaagctccagactttatttggtcttcatcatgcttttccactcatgtactttttatttcttctaggatttgatccaggaggccattttgcatttaggacacagctaatgcacagatatgaactccacaatctcattccagttctagcctagaaagtataatttacgccttgcgatatcctcgctaatatcaccctttctataaaatttaccaccctcccattccaagtttataccttttacaagactcaaatcaagaatcaccgcttgtaagaaagcctttctttcagaaacttcaatattatcccttcctacatggaattacttggcttttagggatgtattttatatcatatcatcagcctttagatgtcttttgtatccataatgtggattttaaaccaatactttaaaatgcacatctgtccaggaaaatatcattgaggcacattggagcctccaggttttacaaggtctatatagtctaaatagggaaattgtagaactggttattgttttatattatgtctgaaatgatgagaacaaatgatatcagcctgtaaataatacaggttccaccttatttgggcaaagaaaaaggtataaaataagcagttgtgggacacacagttatgtatagttttcttttaattttaggatttaaatctatgattttcattataagttggaaccaattagtgggtagtgaccagcattttgtaatggtcagaaaggtttgaaaaatgtgtttatgtgtgtaattggaaatggatcaatatgagtaaatatgtgagcatcagggactcaaaccatatttgatttggaacttaaatattttatcttcttcttttttttttttttttagctgaaagaatccaccaaatgtgccttagaacaggttgacttaggtgatgtagtcgatataaagaaaccagtgcagcccctcagctcttcaggcatgccgtgctgtcccatccccag

SEQ ID NO: 114190 - DNA, 1384 bp, Homo sapiens
acttattcctgtataaagtttctttgtgcctcggggttattttaaaacgcaaatgaaattataataacagtaataataactattttagaaatttgatttcagataaaatgagactgtgcgtgtattcaatttatattagctaaatcaaatagaaataagctgaagctctaataatgaaataatgttttacaagtttaaggttaataagcatttatagataaggcatgttttcttacaatattccgttcccagggctcctggactgaagatcgaagttcttcccatggcctacggggtcccagagtctgggcctgcatagcctctccacactcgcctccactcatctcaggtccttccataactattccctctcctgtcagggaggctctgccgtccacgctgattcctgcagatcagggaaacctcccctaacttcccggctctcctatgtggctcccacagcaccacgcacctctccttcattgtgctaataatagctgcattgtgacacttacaatcatgattatttggctggtatcctctgactgtctttatttacaatgtggatattttgttctctataaattgttgcgttgattttgattcttttacatgccaggttaaaatattactaatactgattactgagggtgttttgtttacaagtgagttactcacctcaatctagttcttaccctcctgttctgacctggccattccgcattcaaaccccaggaggccaggaatacgtatccaccagggcctagaacctccgcctgtgtaggggagaaactcaaatctgtatagagtgaattaatgcatatctatagtttttgcattttaagggttttaaggaaaatattgatttgtaacacagataaaatggtcgaaatacaagtgttttaagtgaccatgatgttactggcagaagaatcactatgactaaaattccagcaatggacaacactttttctatgcataacctctttgtggtcaatttcaagacagcccacttctgtttcacggtttaattggttctcgagctcatttaggagaaattcaatttcctttgagctgagttcatatcacaacagatgagttcattcgttttggtttcttcttcaggcccatggaaaggaaagctaaacgataatgggagcaaaaataatctatggaagaggtggagtgtgaaatgtaaaattagattttctaaacatgctgtctctaatgcccaaacagagccacacccaagcgatcaaatggaatcagtggtaggggaggcgattataaatcaatctagtttatgggatgcactgtgtgaatggttaagggagtgataaagggtggtttccgacaacccaaagaaaggatcctcggcttgagc

SEQ ID NO: 114191 - DNA, 1437 bp, Homo sapiens
agggtaaatgtgattacacccacgcgtatttgttcaacagacatttattgagcgctcaccacgtgccaacgccgggcgtctgggctctggaggcgctgccacgtggcggatgcgcagtgcccggcggccgggctgaggggtgaacgcgggggtcagggggccccgggctgagggtttgcgtgcgggccgggtgcctgggggccccgggctgagggtgagcgcgccgcccaggtgccaggcggctccgggcagagagtgaacgcgcgggccaggtggctccagggcggcgccccagggcggggccggccacgccctccctaaccctggcggagctgatgggtggctgtagcctgattagaccgcgtcagtccggagggtgggtcttgggagggggcgcagggcagtccacgtttccactgcagtttctcctttgttttacgtttgggaggaggtggcattggaaatagcagagtgcttcgcggtaacaggggtgagtcttgtttcatggaacttttttcaaatggggagaagggggttgtgttgctcactacttggaatgtgtcggtcaaaggggttagatagtcagggaggggaagcgtgttctcatcctgggaccaggccggagccggcctcgccgggagacttgtagccctcgccctgcggtgacccgtggctggccactggcctcaaatgttgaaaacgggcagatgggcaagtaatacactctcaagaaagcaagtgtctggcggtgatttcctaaattgcattttttattttatttcaaaacttcatgtaaatatgtttccttacaatatctggctaagtcttttctatattaacatgcttacattgtgatcaagacaccagtctcttccctttcttttcctctcctcttatctctggagatggcaatacccccaactcaaattactctagcaaaaaacctaggagactctttcttttcttttttctttttttttggagacagtctcgctctgttgccaggctggagtgcaatggcgcgatctcggctcactgcaacctccgtctcccgggttcaagggattctcctgcctcagcctcccaagtagctgagattacaggcgcccttcactgcgcccggctaatttttgtattttagtagagacggggtttcaccatgttggtcaggctggtctcgaactcgtgacctcagatgatccgcccgcctcagcctcccaaagtgctgagattacaggcgtgagccaccgcgccgggcgagactcattcttgattcctgtttcccttccgctcttcatccaatccaccggcgagctgcagggcgagggggtggttctttctcctgttttcccgctctccctgcatttcatctcctctgccgccatctgctccaaacccctggcagcccttcgcgggattcccaaatctaatagattt

SEQ ID NO: 114192 - DNA, 6302 bp, Homo sapiens
agtactttgagaagccgaggagagcagatcacctgaggtcaggagttcgagaccagcctggccaacatgatgaaatcccgtatctactaaaaaataacacaaattagctgggtgtggtggcggggcgggggggcgcctgcctgtaatcccagctacttggggcctgaggcaggagaatcacttgaaccccagaggcggaggttgcagtgagctgagattgcgccattgtactccagcctgggcaacaagagcgaaactccatctcaaaataaaataaaaggacacaaaaaataacattagtagcatataacatatatgtattacatatttttaaatacattttaagaaatcttaaacttttcccctacagttggaacacattttgtttttattatatgtatttgttttttaccaaaagtaaatgacatgcttctgttgaggtgttttttttttaatgtggttattttaattttcatccaacaacttttacctttgcctcttttttaaaggcatataatttttcttcctacagaaagacatcaggacaataaatagggagatcttttctcaggcacacaattgtaacattaagtaagagacttttatagtcaaagcaataacatattcatgctataacttttataacgtcattgctgttaaatgtttaaggaaatgataggaaagtcttcagggccaagctaccccgtgcctttattttggcatggattcctaaaagtgggagcaccattaatttcatgtgtcttattctctggatccccattttttagaacaatgagtgggcacacgatggcccatgggccagtctccctgttttactggaacacagccaccctcattcctttatgtgttatctgactgcttctgtgccgtgctacaacggcaaagttgaatagtttcaacagacaccacaggacccacaaagctaaaatctggccctttgcagaaatagtttaccaccccagtctagaaagaacctggcgtgtagcaggatgcaacatatacttgtagaatgaataaaaaggtaataaaataacacgagctcacatagcggccagcatttgctgtgcaccataatccgtgctaagcactttgcatgcgttatttaatttgaatttcataacagtattacataagaaaacaatagggccaggcatggtggctcacgcctgtaatcccagcactttgggaggccgaggcaggcggatcacgaagtcgggagctccagaccagcctgaccaacatggtgaaaccccatttctactaaaactagaaaaagtagccaggcgtggtggcgtgcgcctgtaatcccagctacttgggaggctgaggcaggagaattgcttgaacccgggaggtggaggttgcaatgagctaagattgcaccactgcactccagcctgggcgacagagtgagactccgtctccaaaaaaaaagaagaaaaagaaaagacagtattttgctccctcaccgccttcaggcttttaaccaactgccacttaccaccctagtgaaggtttgcccgagtgccctatttaatattgcaggcttctgtttcctaccagcccctttgcttactctttcacacttagtcaccttctaacgtggcatacattgcttattttctatgctcatgagtatgtctactccatggaggcatagatgtttgtatgcctgtttactgatggatcacaaactgtgtagcctaaaatagagctagcacatagtcccacccaacacgtgtcaggtgagcaattagatatagagggttccaataacttgtggggacacccagataagatctgtttatgactcatgtcttacacagagctcattcttggtctcttggttagtttatcagagaagacaaatgtattattggaaaatgtgtcttaggtcattttttgacagtggctctaatactggaatctattttaactaaaggttattatcataaagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaatttgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttcagaaatatgccaagtctgtattttaaaaaatcaaagtctacattgaaaagagataccatttatttgttcttaaaacttagcaaaattcaacagactgatgttcggtataggtgagatatggcgggaagttgggcttacgtgtggttggataagggataaactgtcacagccagtttggaaataaattttgtaattgtgctatattcgtttttgagctgccgtagcagtactcccaagctaggtaacttagcagaaatgtattgtctcggttccagaggctagaggtccaaaacccaggtgttggcagggttggttccttctgaggctgggagggaaggactggcccaggcctccctttttggctttaagtgactgtctcgtgttcacatggcattcaccctgtatccccacatcccttcactctgcctgtgtccgaacagggacaccagtcatgtgggattatcacccgtgctgatgacctcatgttaacttgacaaactctgaagaccctaccttcaaataaagtcacattctgaggtactgaggttatttgtactaatgtacaaagggatctgttcaagaatgttaactgaatagtatttttaatagtgataaacccataacgtaaatgttcattaaggggatatgggctgcataattcatgccacttttgttcaacagcaaatgtgcaagtctccttcagggagagggtcacagctggaggcaagccacaaagaggaagtttcttgttactaacagatgagacgggatctggtgtattttcttgctgtggaaggaaattcagagaaagtagttacatacggataaagggagaaattgtctgaaggtagctgatctaatgtaggggttaactcatttttatcattattaagtgaatccctgattggaatcatctcataatggccaaaaatatgctgccatcaaacttgaaatgcttatttgattttaagatttaagacatctctggaggtagtgctaagtgtaccattaatttaatggcttttcaggaaataacaataccacactaagtaaatatatcaaacttaagattaatcttgatttctaaaatgccaaagtctaaaatatgtctttaaaacaagtaaaaaaaatcaaaggcttacattttgacgtcagtatgagctaattgctactatggactatggaaattacttcttaatttggtctagaatttctagtatcatttttacaggaatgtgggtactgagtgaggaacactgggtacataatccatttgtaagtggaatttcctccaaatcaaacacctgagtatagaacttgagatgggaatttggtatttgatcaagatgacaaagcatattctcagctagttttgctttcgtagcactgtgtttgatttgctcttctgtgggtttctacttcagagatgaattagcacagagcacctctgaagaccaggcaaaaggcaggactgaatagcagccctcaaggccagaggaagtcaggggcagggtttaggctgcaagctggagagccgagatgcagggcaccgagagggatggatggagatgcttcttcctgaaccatgagcatttctaaaaggtagatcagcctttacatagcgggagccagtctccatccctcttgctgttctcagatggctgttcctgttcagctcttttctagagctgaagggtccgaaactccctgttaacaactctaaagcttaaatgtgtaagaaacagcaatctgagaaaatgcttgtgtatctggatcccaaggcttagttaaatcctgactgaggaatagggtgctacttagctagcttcctagctgttcttgtttttgcttttcttccaaaaaggaaccctaaaactgctaagaatgtaagaggatgcatgtggatgcaatgtggatgtaagatgcatgtggatgcaatggaaacaaaaaaaaaaaaaaaggaaaaggaggttagctaatgaggatat

SEQ ID NO: 114193 - DNA, 1797 bp, Homo sapiens
attcctacttgttcaaatcagttgttttataccgtgcgatatgtgcacagctctcccagtgatatctgactcctgtatttcaccacagctacaatatacatttgtggacataggatttacagaattctatctgaaagcaaatttgtcaggttgttatattgttgacaaatactcttgtttctcagatcattttttgctggctatatgcacgtgcaggaatctgtatgtgcttgtgttttaattacctaatgcactggctctgactgaataaattgcatgattacctcctacactggacacagaacagtgcaagtcatattaaaaagccattatatttgcaactctgagcaagagactataattaaaaggcagttggatgaaattagctttgagagtacaagagtttaagcaagatttggtaaatgaacattaatggttaacatgtggtttttattaggtcttttgcttcttctctccataaccccggagttgaatttcttagatgtcagtggaccagacatgtgagaacacctgtacaaagctatactttaccatgtggctaaaattatattcataaaacaagccaacataacttttgtgactttagtaaatcaaaggtattagactagaatgatcccctgggcattaataaactattcttaatgctcctaagattttagttatatgtcattaaaagcatactgtgtgctccatgcaacttaaaatgtttgtcataaaatacacatatacacgtcaaagaagtaataaaacttgagggcattttaattattctcaccgttaaatataaaaaagttaaagttgtatgcagtatgtgtaatagcatcccattcttatctgtttgcagactgttgaggactccgcatggtagtgatatttttgtagaggggaaagctttatggagtatgtgtatgtactcaataggtcttacacttaggcagattaaagatgcctgcaaattctggccgggggcggtggctcacgcctgtaatcccagcactttgggaggctgaggcagggggatcacaaggtcaggagatcgagaccatcctggttaacacagtgaaaccccgtctctactaaaaatacaaaaaattagccgggcgtggtggtgggcgcctgtagtcccagctactcgggagactgaggcaggagaatggcgggaacccgggaggcggagcttgcagggagccgagatcgcgccaccgcactccagcctgggcgacagagcgagactccgtctcaaaaaaaaaaaaaaaaaaaaaaatgcctgcaaattctttgctacttctcccagtgagagtaggggtctatttccttccccttgagtttgggctggtctgtgactgctttgatcagtacagtacagtataatgtaaatggtgctgcaatggttatgccaattccaggcttagtttgtaagaggccttgctgtcttggaaacctactgctagtttgctgctgccttggaaaccaactgccgtttaagaagcatgactaccccaagaccaccctcctgggcacaatccaagccagccacaggcagaggccctgtaggataagaaatcatgtggagagagaagctaaggagcaatgaggtgctgggcttgcaagtgaagaaggcgactggaaaagccatctagcctggatcaccccaggtgacgccacaggagttggtccctttccaagtttctaacccacaaaatgatgcacagtacaaaaagattgccttaagccgcttaatttcgggttagtttgttatgcagcaatgaattacat

SEQ ID NO: 114194 - DNA, 1611 bp, Homo sapiens
actaaaactcagtctctaaagattggtggagggagaatctccacttgggaggaacagtttttcttcacggaaccagttctgaggctgggcctggtggctcatgcctgtaatcccagctctttgggaggccaagatgggaggattgcttgaggccaggagtttgagaccaacctggacaaaacagcaagaccccgtctctacaaaaaaaattaaaaattagccaggcatagtcccagctactcaggaggctaaggcgggaggactgtgcaaactcagaagttcgaggcggcactgagctatgatcacaccactgcaggccagcctggatgacagagccggaccctgtctcaagaaccggtcctgccacctgggtgggtcaccttcttggaggaatatcattaattgctgtcaccacaagcactgtccttaaagggccatgctgcacttcacactctgacccaagcctgagcacctagctctttctttatttcttagtaaaactgagatgaggttggaacatgtaaaggcctctattaacggcaagaaaataataccgcttggattctcaggccacaggcttaagagaggtgcacctgtttcaagatctagagttaagaggctccaatggttcatttctatctgagacctggtttaggtttctggctgggatctaccttactcagtattctaccttacccggtatgtctcactgacctcttcatgaaagtttatctccacgcattgtgtgacttcacatttcacttaacacgctaacaacgtaaacggctcaacagccccaaaacgtagataagaaatgaatacattctttatgaactttttctgtaaatctgctggcgggattaaagtattagatagagtatttaactagaagacccctctaaagttacccaagatgggaatagagaatgaacaagagagagaactttgcccctggcaaggggcagttttgcaggctttgtaacccatcgtaaagggttagaactttgccttgtagtcaataaaggaagcatagaagggattaataagcaagtaagtgacatgatcaaattcactctttagaaaattcatttagggtgcagagttaaagatggattgggagaaggaaaagatgaagctgttgccataatctagaggtgaggtgacatgtctttctggacttagtttccagcacaggcacagagcacagtaagtgattatagatgtttgaatatatgcttgactagacaaagctaaaaggatttccaagcagtagtaaacatagaaaagtgacagatgcactaaacttaaagtcagtgacacacaacaatcaaaaggtaaatacacccatttaaaatgggcatagggcttgagtagacatttcaccaaagaagacagaaaaacaaccaataagcacgtgaaaagatactcaacattattcatcactagggaaatgcaaatcaaaaccaccctcagataccatttcacactctcaaggctgcctataatcaaaacaagaagtattagccagatgtggagaaatttgagccttcattcgctgctggtgagaacgtaaaacagtttaatagttccttagaatattaagcatcgtta

SEQ ID NO: 114195 - DNA, 1067 bp, Homo sapiens
gtgctatatgtgtttaatattgttatttttattactatcggttttaagggattaagcagctgttgaaaccaatgagactacttttttttctttttctttttcttttctttttcttttctttttctttctttcttttttttttttttttttttttttttttgtttgagacggagtttcgctcttgttgcccaggctggagtgcaatggcgcgatctcagctcaccgcaacctccgcctcccgggttcaagccattctcctgcctcagcctcccgagtagctgggattacaggcgtgcaccaccaagcccggctaattttgtatttttaggagagacggggtgtctccacgttgaagctggtctcgaactcctgacctcaggtgatccgcccacctcggcctcccaaagtgctgggattacaggtgtgagccaccgcgcccggcaagactactctttaatacacgcacacacacacaaacacaaaacctggaaaaatgtgctcaaatagtttgttagtactttatataacaactgaaaattctttggatttaatcaaaatggcatatttgaagtaaaaacacctatacctactctctcaagcctcttaggtagaaaatatttgatagaaaggaaattaattggattaccaaaggacagtaggtgaccccaattacttttgcttttaattataaaaaaagtctgagccataaaattggaaaactcttcctgtaatgaaaaatgtagagaagtagtttcacaattttacattttcttttttttttttttcttttgagatggaatctcacgctgtagcccagactggagtgcattggggcgatcttggctcactacaaactccaactcctggagttcaagcgattttcctgcctcagcctcccaaatagctgggactacaggcacctgccaccatgcccggctgattttttacttatttatttatttatttttatttttaatagaggtggggtttcaacatgttggccaggctggtctcaaactcctgacctcaggtaatctgcccgcctcagccttcctaagtgctgggac

SEQ ID NO: 114196 - DNA, 1059 bp, Homo sapiens
tttggtcataattctatacattttcatctgttttttttcttttcagatggagtctcactctgtcgcccaggctggagtgcagtggcgcgatctcagctcactgcaacctccgcctcctgggttcaagcgattctcctgcctccgcctcctgagtagctgggattacaggcatgtgccaccgtgcccagctaattttttgtattttcaatagagatggggtttcaccatgttagccaggatagtctccatctcctgacctcatgatccacccaccttggcctcccaaagtgctgggattacaggcatgagccacttcgcccagcctttcatccatatttttaaaaaatgcattcataatgtccaaaaactccaattccaactagttctacatcctgcaagaccccctttgaaccttccaacccagaccctgtgtctttcccctctttctccatctgacacactgataagactgtcaggttgtgtgcttatgacagagagcctgactctgtcaaagctctaaagctttgttcgatcaacaggattttcggatgatcaatctttcaaggagcccagcagtcaacatttctcatcttttgagcaacaaattgcaaattcaccttcacctattctttctcctttcttctgtcttgcaataaaccaattttttcctaccttgtatttcctccaaattcctgagggcttttaggaaatcctcacctggagatcagggcttggcaaactttttctgtaaaaaactaggtaattaatatcttagactttattggtcgtactgtccctcttgaaactaactctgctgctctagtgcatacacagccaggacagtgcttacattaatgcatgtggctctactcttccaataaaactttataaaaacaggggccacagtttgcctacccctgctataggtgattcgttttctcttttcaatattgaaactattcctcaatcaggaccttctaaaattaacttttaaaaagctaatgtaggccagacgtggtggttccttctgtaatatgaacacttcagcaggcccaggca

SEQ ID NO: 114197 - DNA, 2002 bp, Homo sapiens
atgagtagctgggattacaggcgcctgccaccacactcggctactttttgtatttttttagtagagatggggtttcaccatcttgaccaggctggtcttgaactcctgacctcgtgagccaccgcgccacgttggatgaaggtgtttctaaaccttccttagctcattcatctttgttttattcttcccgctcaggtagactgtgtccctttccatatcttatggactttttcctccatgaggtccatattgaagttcagcagttccttttcctggaccctcccaaattgcctctcccgtatctgggcctgggacttgtgcccactcagtgggaagcccaggtgtgttagaaatcatgtctctggcattggcattggtgaactcctaggttaacgagggttttctctcctgataggacatttaacattggatcctgaaacagctcatccctgcctggcactatctgaggacctgagaactatgagattgagacatgggcagcaggatggggctggcaacccagaaagattggatttcagtgccatggtgctggctgcggagagcttcacctcagggaggcactactgggaggtggacgtggaaaaggcaaccaggtggcaagtgggcatataccacggctctgcagacgcgaagggcagcacggccagagcttccggagagaaagtcttgctcacggggtcggtgatggggaccgagtggactctctgggtcttcccccctctgaaaaggctcttcctggaaaagaagttggacacagttggcgttttccttgactgcgaacacgggcagatatcattctacaatgtgaccgagatgtccctcatttacaatttctcccattgcgccttccaaggagctctcaggcctgtgttttccctctgtatcccaaatggagacacaagtccagactccctcaccatcttacaacatggtccttcttgtgatgctactgttagcccttaatcttctgtgtgtaaaatccaagaccacgagacaccagaaagttggagaacaagactttgaaagaatttgtgtaaactaacccaataaaaagcgttccaggagtaggagcctgatttaatatccagagcctttgcatttgtgtaactgtcaacacctgtgtgtagtggaagaggttgcacttaacctgaatcatgaatgataataacggggagatcctatgctaatgagaaaaaatgcatatgcatcgtaagcttggggaattagagaagaaatacagtctggggtccttagaactaggttaggaacttgatgtatttctgaaaacatttgcagaatcaggtataatcaggaatgaaagcgggactttagatatgagcatgccaccatgcggaacaggtgtccattactgacagtgagtatcaggacttcctaaagtgttttattccaaatagagaataataatttatatagatattttatgtggataagaaggagttgtggaaaatgtgaatatttttaaattttcttttctttttcttttttttgagacgaaatttcgctcttgtcgcccaggctggagtacagtggctcgatcttggctcatcacaacctccccgggttcaagcagttctcctgcctcagcctcccgagtagctaggattacaggtgcccaccaccacgcccagctaatttttgtatttttagtagaggcggggtttcaccatgttggccaggatggtctcgagctcctgacctcaagagatccaccagcctcagcctcccaaagtgctggaattacaggtgtgagccaccacacccggcctacctctctttctgataggaacaatttgatttattagaagaagcccgacaggtaatggtttgaatcaggtaagtaataccgatgatgcctggtgttcaccctcttctttctctgtttggtggtctacaggcaaatgccttctcttacatccttgctcagggatggttgtataatgctgagaaaataagtatctac

SEQ ID NO: 114198 - DNA, 1109 bp, Homo sapiens
ccaggttcaagcgattctcctgcctcagcctcctgagtagctgggattacaggcacccgccaccacgcctggctaatttttgtacttctagtggagactgggtttcaccatgttggccaggctggtctcaaaccctgacctcatgatccgccggccttggccacccaaagtgctgggattacaggcgtgagccactgcgcccaaccgaaaagcaggtttttaaaaacatggttgaattaatctataggagaagttaccgaactcttgttcctgaacttgaggttgttgaatagtaacgaagaaatgcttctgcagagactgggccgtgtggggagagagaacatggagaaactgaaggagagtgaagccagggcttctgaacaggtccgcagcctcctaaagctcatcgtggagcttgagaaaaagtgtggggaaggcaccttggcattgctcaaggtaagatgctgggaaaaagaaaataaaattcattccagtatttgagaaatgagaagtggacagtactcattaggggttgctgtcagaacacaatatccaatgatcttcaaccacaaaagaaggctacatgactttctttcagctgccaaaagctttaggaatggtcatagctttgtgggatagtgtggagctgcttcatgagatgaattctcaccttaaaattatcagcagtaagttagggttgagatgtgacacaatgtggttaatacctccatgcaatgaaatattctgtgatcataaagaataaaacagctctataggcactaacagtatttcaagcactcattaagtgaaaaagaaagatgcagactgctttttgtttgatctttggataataagtatatatacacacacatatacatgtgtggttgctaacattcacagactttctggcaaaaaattaataaatgtatagtcatctgtgataatcttgaaacaagggtgagattatctgctatgatctgaatgtttgtgtccctccaaaatatatatgttgaaatcctctcccccaaggcgatggtattgggaggtggggcctttgggtagtgagtggggcctgggggcagagcccctgtgaatgggattagggctct

SEQ ID NO: 114199 - DNA, 2089 bp, Homo sapiens
ctgctcactgcaacctccacctcccaggttcaagcgattctcctgccttagccttccgagtagctgggattatgggtgctccccaccacgcccagctaatttttgtatttttagtagagatggggtttcaccatgctggccagtatggtctcgatctcctgacctcgtgatccacccactttggcctcccaaagtgctgggattgcaggcgtgagccactgcgcccagccttccttgtctttatattggggttagagatggaaagaatacattgtggtcagtgtaagatatatatatctatatatagatatagatatctatctattatgacgtgtgtgtgtgttgttaatctatcatgtttaacctgaagtctatcatgtctatatgaggaaggaagaggaacaaaattttaaaaagatgattgagtctgagtatagtatgagactccggttgttgaatgaagagtgtgagcagaatctccagagacagcaggaatgcatatctgacttgaacctgagagaaacccttctgaatcaagcgatcaagcttgccaccgagctagaggagatgttccaggaaatgctacaggtgagatattgaaaacaacatcctcatatttgagaaatgagaaaaagaagagctaaacattatgtcaattccaaaataacatagccagtgacaaccacacatgtattaaatgaattatatacctacctggcaactccatttctatgaatttatcttgacatgcatataaaaagacataaataaagcacaatatacctataaatatatttgtacacatattactgtattatgcttcaaacatacttacacacatagaaaaagacacctgggtaaggcaacactgaaactgagtttcagtttagagccatggtttagaattcacctttcttttttttgagacagagtctggctctgtctccaggctggagtgcagtggcgcaatctcagctcactgcaagcttcgcctcccgggttcacgccattctcctgcctcagcctcccaagtagctgggattacaggtgcccgccactacgcccggctaattttttgtatatttagtagagacggggtttcaccgtgttagccaggatggtctcgatctcctgacctcatgatccacccgcctcagcctcccaaagtgctgggattacaggcgtgagccaccgcgcccggcctagaattcacctttgaagccggatgaatggagttcctatctgagccagctgtttactggctcctgggtggcctacgacctgctgcttaacctttgacttggttcctttagctgtaaactggatataacagtgacccctaatttataaaattattgtgagatttgagtgagataatctgctaaagcttattaaatcgtgtcttgttcatgttaagcagttgatgagtagcagatgttacaattataacattcatagcaagaggttagaaacaccctgtatttgtcaatagaagactcacaaaatgtgctccatacatacatggaagaatactcttcagcatgttaagatgatgtcatggctctgtgtatatgaataaggaatgttctccaagaataaagtaagttgtcagattagtaatcaaatataataaactatcacttatgtttatgttttttccccctaaataacatactcaagttgcgtatgtgactacgcagtatatgtaaagtatacttggaaggataaaaagaaaattgatatcagtaacgtaattatttatttcttattagttaatctatataccttaattttaattgatttcaagttaatgaaaaaatagggaaccttctgaacaaacagccacagaaaaaacatgaaatgttttaggtgcatattaatgtgagtaagggctgcgtgcacacacatctgtattggcttaaacatacataacagggggcaaagaatcaactgtctcttgagaggaatcctgcttcagcagaagaatatcatggccttgcctaattatgtctgttcctggggtagcaggcagaaaagcagggtttttttttttttggttttggttttggtttttttttttgatttggag

SEQ ID NO: 114200 - DNA, 1847 bp, Homo sapiens
gcggagcttgcagggagccgagatcgcgccaccgcactccagcctgggtgacagagcgagactccgtctcaaaaaaaaaaaaagaggagctgttttcccttatttgcttccccattccttctgttgcatgtgttttgtcccagctgtagtcccagctactccggaagctgaggtgggaggatcgctggagcctgggagttccagaggctgcagtgagccgtggtcacgccactgtactctagactgggcaacagagcaagaccctgtctctcaaagggaaagtattttaataactttttcagatacttgtggtttttttctgtaattctatcaacgaacctctttcgcactctgttacctcactctagtcctgaagttccttcagtaattagcgcgatgcctttagagcactgttttcccctgaatgactcgtaagtgagtgctgttccttgtaattaattttcagcctattgctcaagattgtcagaagacctgagggaaacccgctggtcttagaacactggcctaactctgtcttttccccaagcaggcagctgccagaaatttgttggatttgaggagtccagagcgccgacccgctctgtctgcgtggacttatttccttggatcttcgtggactctgaagttgccaagtgtgtgtgcctgctccagaaaacaaaggaagccaccattttttctcattcacagtgcagggagatacctcagtagaagcatacagtccagtcttcaactagggacccctaccaggatgtccaaaaggctcagccctcagttacagcacaacatcacagaagatgcctattgtgaaacacacctggaaccaacacggctgttctgtgatgttgaccaaatcacactctgcagcaaatgcttccagtcccaggagcacaaacatcacatggtgtgtgggatacaagaggctgctgagaattacagggtaagagtcactcacgcaaatcccaaaacactctggccaactcctatatggatgaaatggacagacattctggtcctccaaaaccattaccttagttgatgtttattacagaatattagataagttcgttgaaccttcaacctaaaggctaagaaaatatatactcagagttgttggctgtttaaggtcaggaatccaactgttctaaatcaatgatctcacctggaattctgtgctttctctatagaagttattccaggaaatattgaacacatcgagggagaaacttgaagcagctaaaagcatattgactgatgagcaagaaagaatggcgatgattcaggtcagtgagtgcttatcttgattcttggggggaaattaccagtaatgttgttagaaaatagtgtatcataaacaaagtcaaaagacaaatcacaaagcaggaaaaatgtgaaatctataggaaggaaaagtgctaatatcttaatgtataaaaagctctttaaagtcagtaagaagctgggtgtggtggctcacgcctgtaatcccagcactttgggaagctgaggagggcggatcacttgaggtcaggagtttgagaccagcctggccaacatggtgaaaccccatctctactaaaaatacaaaaattagctgggtgtggttgcacgagcctgtaatcccagctactcgggaggctgaggcaggagaatcgcttgaactgggaggcagaggttgcagtgagccgagatcacactactggactccagcctaggccacagagcaagactccatctcaaaaaaaataaaaataaaaaaagtcagtaaggaaaagactagaaatttaattttaaaaaacgatcaaataagagtttgcagaaaagaaagt

SEQ ID NO: 114201 - DNA, 1017 bp, Homo sapiens
gtcgtatcccagccgggcactctggctcatgcctgtatccccagcactttgggtgaccgaggcgggtggatcacttgaggtcaggagttcgagaccagcctggccaacatgggaaacctcatctctactaaaaatacaaaaattagccggaaattgcttgaacccaggaggcggaagctgtagtgagccaagatcgtgccactgcactccagcctgggcaacagagcaagactcggtctcaaaaaaccaggacaaaacaaaaacagtcctgtcccctttgttagccacatcaccttcaccactcgccccaggctggcatactctcggcttctgggtgggatgagtatggctggtgccaaacaaggctgtatttgttactttggaccaaatctgcggcaggagactaccacctcctcccattccagaaaagaacagctggaggcgggggtgtgctggttgtggtcccagtgttatcactcatctggaaggtgtggcttctctctggctccttttctccaaggctgctccattagaagcaggggcttggctctcactggtttacttcccacagctctaagaggtccagaagtcatgttcaactgcttcttccttgcttaagaaagcattaaaacttaagaatcaggccaggcgcagtggctcacgcctgtaatcccagcactttgagaagccgaggcaggcggatcacctgagttccggagttcgagaccagcctgatcaacatggagaaaccccgtctctactaaaaatacaaaattagccgggcgtgggcgcatgcccagctactcaggaggctgaggcaggagaatcacttgaacccaggaggtggaggttgcagtgagccgagatcgcgccactgcactccagcctgggcaacaagagcaaagctctgtctcaaaaaaaaaaaaaaaaaattaagagtcaaacattatgggggccgggcactgtggctcatgcctgtaatcccagcactttgggaggccgaggcagttggatcac

SEQ ID NO: 114202 - DNA, 1035 bp, Homo sapiens
acagagtctggctttgtttctcaggctggtcgcaaactcctggcctcaagtaatcctccccgccaaagtactgggatcacaggcgtgagccacggcgctggccctgttagaacatagagctagctttgtcaatgctttttcatcagtagtaggtagaatgtagggactggttaaatgttacggtgattacaatcttgaaagaaagtaagtggtatcattactgccaaataacttcttctttagcctgtaactatttcagtgcgcattatgattgtaactagaaacaatggaggcaggagccaggcctacattttatctattattctatctgcttagtgcaaaagtccctgactcctaatccaggatttttttttctcagagggttaaaaatagttttctttttaaagatttgtggactgggcagacaattaatggtacagaatccccacgcatattgtgggaatgaaaaaaaagaagacaggatgcagagttctaatggcacaattggcaaacagagtaggaggcagtctctaatagcatcataaacgaaaacagcccccaaatacctaggaagagctcttccttgtctgtaacaagctttgtttgaggaactaatagtaaagaatgtggttacagaaaatacagtggtgtctgccaagcacctcggcaaatacaaatccacactggagaaagagacgactttgtcttccgagatacctgcctgactcctactgctcagccacgcttctctcccacacgcacccccagtaatgactccagaggtcaagttctgagttctcacgatggcaggagaatcagcctgtcaagacggtcacctcgattaaccacacactgcaaatctgaggactccgtgagggaagggctctgttcctatccagggtttaggcactgggattagagttctccagaaagacacaatcagtaggataggtagagagatgcatgagaggaggtgtattaggggaactggcttatgctattaggaggctgataagtcccaggatgcgacacacc

SEQ ID NO: 114203 - DNA, 1103 bp, Homo sapiens
tttactgtcacacatagctgaagctagtacattggatacattgactgtcctaaagttaagatctggaagatctaacatggacagctgagcatgggatttatttgagtttgggataactcatgggatcattctgagttttttggcagtgatggcgaggggaggtggcttaggaacaggagataaagctatggaaaaagcagtgttaatcgtggaggaggactcagactgtctctgccttctagactatgtggctttaataatgaagagctgcaacataaaacctgcgaaccaaaagcattttcttgaaactgatagttcctgaaaagagagaggatagaaggaaaccgctatttctatctaagtcctgtgtcccatggacagtttcatttgattttaatcctgtatgggtaagccttggtcttttcccttgactgctccaagcttggaggtgcagtacagtgatagaacagccgtgaatccaggccagctcgcctgcgccactgctgacttcgcctgaaaattctctcatccattcttaccatcttgctgcatgctcaggccttctcaaaaccaccttggggacgttcttcatcttggaatggtgcctgtgaacaaagatggagttattctgtttaggtaatgctaagaaaaaaatttgttttccttactcccttccctcactggatacctgcagtaagtaggccatcccttagacacaggcagatagagaagaggcactgtggtgggcagaaatatgagaatgcccccaggattctcacccactagtacacatacactttctcccagtttttcaaacacatactaatctgggtgctggccaggagcggtggctcatgtctgtaatcccagcactttgggaggccgaggcgggcggatcacaaggtcaagagatcaagaccaccctggccaacatggtgaaaccccgtctctactaacctccaaaaattagccaggcatagtggcgtgcacctataatcccaggtactcaggaggctgaggcaggagaatcgcttgaacctggaaggaggtggaggttgcagtgagccgaaatcacaccactgcactccagcctgggcaacaga

SEQ ID NO: 114204 - DNA, 1085 bp, Homo sapiens
tcagtgactaaggagataaagaaagaggattagaagtggattcttcaagcaacgcctacatcttatgttgggttcaggaaacaaatcaagccgggcgtggtggctcacacttgtaatcccagcactttgggaggctgaggtgggtggatcacctgaggtcaggagttcgagaccagcctggtcaacatggtgaaaccctgtctctactaaaaatacaaaaattagctgggcatggtggcacatgcctgtaatctcagctattcgggagactgaggcaggagaattgcttgaacctgggaggtggaggttgcggtgagccaagatagcaccactgcactccatcctgggcgacagagtgagactgtatctaaaaaaaaaagaaaacaaatcaagaattctgttctaactcaaaattattttattagaccaaaatgatagcctcaacacaaacctagaatagctttgacacagaacttaacctagaaagaaaatatactcggtgaggattttttcatgagaaagtagtaaattttacccttcccctacaagggtgaaaccctctccctgaaccaaagttctttagaagatacaaagtatttgttttccaaaaattcaccctacttgtcactatacctgttcacacaagacaatgaactaaatgtcttcacatgttcagtgaaatgagcacaaattgctaccagtttcagtagttttacattttattttaagaattttcttattttaagaaaacgtggaatgcttcacgaatttgggtgtcatcctcgcacaggggccttgctaatctctgtatagttccaattttagtttatgtgctgctgaagcgatcatggtttccgtttttttctgaccagattctgcataagagaagcctcctgcaggtattgacagattcttgcattttctttgtttttctccacttcctactcattcacgagaggtttcacgtttgactactggtagttaactgtgtaatccacgtggttgaagttcgttccacgaagttagtggcgtacccgctctcagtcttacagaggctaacaacaggtagtcacagattgttacct

SEQ ID NO: 114205 - DNA, 2461 bp, Homo sapiens
gtgaactctaaggcagcagatacccagggtgcttctcctcagcacccaccacggaactgacctcccaccacatgatgctgatgcttcccttcctatgtgattttttggtatttcttttgcagcctgcttgaagtgacataatgaccagatacgtttgtgaggatgctgactgggatttggtcagaggccccggtaggcccactgaattcttaccgtacatcagtgacctcataacctttcaagctttctattcatgaagctcaaaacacccctctcagtaacatacacacatcacttgatagattttgcattttcttggctcttaatatactcaaatgcctttttcatttaaatctagagtttgatctggatgaaataatgcatttttccatatataggcatttctgctacgtgcaatgtattttcctaacaaacaaacaaaaagacaccccactctgccagataatgtattaaaataatagtgcttccgtaagagttagagtggaacactcaatccctatacaactcaaaccagatgcttacaaaatgttaacagcccttaaaaaaaggccacatatagagtcgaggacacataaacttctaacaacgacaaaaacaaaaatacagggtaactattgaatctgctttttttggaagtgaaagttatttgataagaaatttgggaaagggttgaggctgccgagttagggtggccaggacaagaggcacataggaacagcaaaatcagcatctctatgacagagtatctggtcaaactgagccaagaagagtgtggtgtggatggctgtcgtgatctcatcatagcagagagatcaccccactgagggcttgctgccttggctgcgttagtgttctctgccttcgactgctcttacttacaaccaaacttcagtgtgccagggaaaggacatgtttgaatcaacatgattttcttgtcatactaaaacaagtcctttactttgcattatagaaacatgttatttttagccctacagttgatttctaatcctcgtaggacaattcccaaggatgtttaagatctatttgaactttgagtttcacctgccttctataatcatgacagtggagactccccattctacatattctttctggacagttacctgtgatctagtcttcagctaccttctgtatgccagaacttcatctctagtttaggtccctctgttcgtcttcaggctcataaggatgtacatattgatcactggagctctctatccagatattgtgcaggacacctcaaagtcaaggtgtccaagatgaaacatgtacatatatatacaccattctctccccgtgtcaaaggcaaccacatccactcagtttttcaggaatgccagtattgtctaggaaagactatctgcgtcatatttctatagttaattactaagttttagctatctaagactttttttttttttgagatagagtctcactctgtcgcccacgctggagtgcaatggcatgatctcggctcactgcaacctctgcttcctgggttcaagcgattctcctgcctcagcctcctgagtagctgggactacaggtgtgtgccaccacgcctggctcatttttgtatttttagtagagacagggtttcaacatattgcccaggatggtcttgatctcctgaccttgtgattcgcctgcctcagcctcccaaagtgctgggattacaggtgtcagccaccgtgccctgcatgtctaagactttatacaacattaaagtccacttatctctatcccactgccactaccccagcccagcttctagctgagaactgcaaccaaatatcaagttttgtgacagtgtaaactattttgatcccaacctgaagccagtcaaaataaataaataaataaataaaaaataatctttctctgccaatctcttgtttaccactttggtggatatatatttactttggaattaagtacacattttttagatgtgcaaggccctgcctattttctcccaaataacttttgctgatgaggagcttgacttactcctccttccagtcctttctacgtaataatggtgccctctgagccttcttgttccttcaaaccctattaggatggaagaagtgacgcttgagtagaatccttaactatttctttgaaactgtttctggctttggtgctttgtgtactcactacagccattttaccatagtttctagatcatgactgtccagtgacttttctgactcttccatgaggatagtttccttgaggcaagaactcgctatattttctggcctttatatagtttgggtgctcacatttggccaaattggtgtttacactgtggtgaggagaagctgcagcctgtgaccctggactcactgaagactcctcgttaatcaagcggccatccttattcggaagagccccaagcatactcacctgttca

SEQ ID NO: 114206 - DNA, 1025 bp, Homo sapiens
cctggtgtgatggctcacgcctatagtttcagcgctttgcgaggccatgacaggtggatcacttgaggtcaggagtttgagaccagcctggccaacgtggtgaaactccatctctgctaaaaatacaaaaattagccaggcatggtggtgcacatctgtaatccccagttactcgggaggctgagacatgataatcgcttgagcctgggagccggaggttgcagtgagctgagatcacgccactgcactccagcctgggcgacagagcaagattccgtctcaaaaaaaaaataatagtaataaaagctattattttaagtatacattcatgtaagactgctccataatttcagagtatatatttgacaactgttgcaaattctctttcctagaaatatataaataaggtgaaaaaagcaataaaaaaggaaacatatgagtagaaattcatacttgggaaaaaatagacacactcccccctgcccacgcacacacacatatatcctgtatttatctacctggaatatacttcggtataagttgctgggtagagatcaactgaatttatttttccagatgactccctgactttccctaaactgtgtgttgagtaacctatcttttccagactggcatgaaatgacagatatacagaggacccttgaacaacctgggtttgaactcctcaacatggacacttatacacggatttttctcaataaaagtgacaccaagaatgcctgcctctcctgctcagccttccacttcctctacctatctggcctctgccacccctgagacagcgagaccagccctcccacccccacctcctcctcctcagcctactcaaagtggtaacgacaagggtgaagacctttatgaggatccgctttcacttagtgaatagattttctcgtaataacattttcttttctctagcttatttgataagaataaaataatacatgtaacaaaaaaatatattaattgactgtttctgttattgataaggcttggtcaacagt

SEQ ID NO: 114207 - DNA, 1934 bp, Homo sapiens
cacccgccatcacgcccggctaatttttgtatttttgtagagacagggtttcaccatattggccaggctggtcttgaactcctgacctcaggtgatccacctgccttggcctcccaaagtgctgggattactggggtaagccactgggcctggctaactttatttttaaagctaggctttcaagcaatgtatttttcaaataagctcccaactagtccaccgcctcatcaacaaataagcccttactgtatctataaagttcatttttttctgcatgtgccaaccctgatggcatctgggtgatagttgtgacagtgaccctcttggagtactcctagcatcaccctctcaggagagaaaggccagagaagaagctacttgagttgttgatctcagaagccgtgtctggtagtgtgattgggtcatatattttgggaaggctggtctattctatgaatgcatttcatctatgaattaagcccaagcaaaatgttgagaaagatggtaaggaagtctgccttcccaagagtgaatgtggtcagtgatttcagatgcctgtcacaccatcactccataatgacagctgtctgacttccttctcacagcaattggacaatgttcatttttttttttgagatggagtcttgctctgtctcccaggctggagtgcagtggagcgatctcggctctctgcaagctccgcctcccgggttcacgccattctcctgtcttagtctccctagtagctgggactacaggttcccaccaccacatccggctaattttttgtatttttttagtagagatggggtttcaccgtgttagccaggatggtctagatctccggacctcgtgatccacctgccttggcctcccaaaatgctgggattacaggtgtgagccaccgcgcctggcctgcaatgttcattttattgagataactggaaattttcacccactcacaagtcaacaagtggatgcagtatagtgtgttgacaaaagagaaagactgggaggtaggcgctccagtttcctagtcctaatccggcgtatgtggtaagtgagtatcaggagatgaatttaatttattctagcctcagttttcctcagcatctgtagaaggtagttggactatatgatctcttgacttccagctaaatataagactatgattccataataatatagttcctctattcatttataactcattaacagaaaaatcgagccacgtgcaaagaattcttgtagtcatcaatgaataacacgtggttattgtgttacgatgcctataaaataaaaaaaattatctggaagagggaaacgggatagagcagatcagtgtgacttgaacagagactatgccagcctccctattccaaattggaatactggctctgtgatgtgctataactgtattgtgaggcttattctaatgattttggtaaatgttaaagactcctcctggggttgtgttgaaataacacactgaatggagatggtagttcataaattctttttctagtggtggcagttagtgttattgtagtctttttttttttttttttttttttttgagatgggatctttctctgtctcccaagctggagtgcagtggtgggatcttggctcactgcaacctccacctcttgggttcaagtgattctcctgcctcagcctcccaagtagctgggattacaggcgtgcaacaccacacccagctatttttactttttttttttttttttttgagacagagtttcgcttttgttgcccaggctggagtgcaatggcgtgatctcacctcactgcaacctccacctcctgggttcaagcaattcttctgtctcagcctcctgactagctgggattacaggcatgtgccaccatgcccggctaattttgtatttttagtagagacggagtttctccat

SEQ ID NO: 114208 - DNA, 1048 bp, Homo sapiens
gaggctatcttggtagaggtttcatgatgccaccctgatgccacctctcttcctctttacagtagtataactctttgctcttattttttcatagcttaaattctcatcctagcaattcacgtatgctttacaagggatgtataggattgaaacattttgaattaatgatttcagaaaggtgagttttgactaggagaaaggaaggtggaggaaaaaacattctcagccagaaaacttctttttcccaaagttcaagataagaaaacatccaacatcctgttggaggtaagtgggaaagaagtagcagttggagccttgaaagtcagaaaccaatgaacggaacagcctgagtaatggacccgactcgtggaaggctgccaagctggagagtgaggggacggagacagaaatatggcgtgatgagttcgtgggaaggtcaaactcgctggcctttgaggaagagcttttgaggtgcaacttcctggcatgcagtgagcagaaggcaggccaggacaggagctgactcccgagcaggggacacagtgaatttgtggcatttgttaccaatctcggagttcactgtgcacagtctccacactaggcatttactttttcatatgtccgaaaaaatgtctgcacacttcatttctgtccagtaagaactgataatcagggatttgaaggggcctagtttggaaattttcaatgggtgaaaataagtgagcaaaattacatttatactaaaatataattctttccatctgctccatagtgggatagcctcttgaggcaacttccaattagaatgtcattttagatgctttccaagatggcagatgggtgagtactagggtgtgcagggaagatcaataaacagctctggcaattcatcgtgcgcctaacaccaaggaatacttcagtggaagagctctcattttgttgggatgaataaaattaaataaaagtacacagtacccaataaaggaacaaaagcttaggctttggtcaagcagaacaaaaggggctaatgagaaaaggactatgtatt

SEQ ID NO: 114209 - DNA, 1045 bp, Homo sapiens
tgtcagctggtgaaatcaggcacagaagagataagggtttcttgtcataacaacataggaacaggtcacccgcgtgttactcaaaactgtaggacggcagtgagggctttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgcccaccactgccaaggcgctctccgatgacgagcagggtggaagcgccttcgtagcccagagccatggtgcaaacagagtgcatctctccagcgaggctgaggagcatcacagagtaagacagctgctcagcatgaaccccacgactcatcgcagctaactccgttagctttcctgacgtttcctaacgtcctctgtgggggacagtcacgagggcccatctgagcaccacatcacaaactggcgtgggtccagtttacacccttttttttccctttttttgtttttgagacagagttttgctctgttgcccaggctggagtgcagcagtgcgatctcagtcactgcaacctccgcctcccaggttcacgccattctcctgcctcagcctccccagtagctgggactacagtcacccaccaccacgcccggctaattttttgtatttttaatagagacggggtttcaccatgttggccaggctggtcttgaactcctgacctcaggtgatccgcctgcctcggcctcccaaagtgctgggattacaggcgtgaggcgccgcacccagcctgccctttgttttagaggcct

SEQ ID NO: 114210 - DNA, 2410 bp, Homo sapiens
gtgtaaggagaaaggaagctcaggctgtactaacccatgagaaggagagagtgaaactgtgccaggtcggtgtctgtctgacttttgctgcttgtatatgaccccataagggggactaaagggaaatttagtgaaatatcaggaaaaaaaaaagacaaatttttccagtctcacctctaaaatatgcagtttccttgcattgggctgccttcttctgagcgtcctcgtgggagtctcaaggctcagctgcaattcgccccctctaggagcctcctttgcataactagacaacgctgtggcttcctctatgatggctctggtagaattatttaaaacacaagtgatacttatagacatgtaacatgagacggaaagcgattttaaaaagaaatatctcaaaaacatggaggggaaaatgcaaattaaaaaaaataaagagacagagatataaaagcaaaatagtggtttaaatgatacctgacaagtcctcaaggttggtcacggacttggatttgagctctccagcagtcaaagcaaaggactaaatatcaaattatatattttttaaaaccatgtatctgattctcccaatagactttgaaatctgtttttttttttttttttttggagatggagtctctctctgtcgcccaggctggagtgcagtggcgcgatcccggctcactgcaacctccacctcccgggttcaagtgattctcctgcctcagccttctgagtagctgggattacagacgtgtgccaccatgcccagctaattttgtatatttgtggagatggggttttaccatgttagccaggctgatctcgaactcccgacctcaggtaatccacctgtctcggtctcccaaagtgctgggattacaggtgtgagccaccgtgcttggccgtagactttgaattcttaagtgagagtatttgccatgtatgtttctgttcctttttggttatctgacacctactttcattgaataaatatttgttgaataaatgaacacacatttttcataatttttcttaattttgttttatttgtatcatagtcctgatcactacttgtcatatttcttactcatttttggttttctccactagaacgaccgcctcctgggaatggagattttggttttgtttactattgtatctatagcgcacatacctccgaaaacatcaacctctacacccagcgcatcaacagattaaatgtattatatgttggatttcaggaattgttgccatgaaactctaggacttggccaggcatggtggcccacacctgtaatcccagcactttgggaggctgaggagggtgggtcacccggtcaagagacttgagacaatcctgaccaacatggtgaaaccccatctttactaaaaatacaaaaattagctgggcgtggtggcacactcctagactatagtcccagctactcaggaggctgaggcaggagaatcatttgaactcaggaggcagaggttgcagtgagccgagattgcgccactgcacttcagactggcgacagagtgagactccatctcaaaaaaaaaaaaaaaaagaaagaaagaaactctaggacttgtaaggattaaaaatctacagacaagggcatttctcttactaactttatctcgtgtgtgtgtgtgtgtgtgtgtgtgtgtgtgtgtgttttggcaggaagaaacaaagacttgtaaacaggttgttgtgtcagaatacatgaaaatgcaccagttcctgaaggaagaggagcagctgcaactccagctactagaacaggaagagaaagagaacatgaggaagctgaggaacaatgagatcaaactgacccagcaaatcagaagcctaagcaaaatgatcgcacagattgagtcctcaagtcaaagctcggctttcgaatctcttgaggtgagaataacattcatgagagtaatgggaaaaattatagtaactcatagtacttcaagccataggaaataatgttttctttattcatcttaaaaactaagttctggtccaaaagtagttttcctaaagaattgacattctatatgtcaataaagccttatagaagagagagagagagaaaaaaaaaaacacatccagaggaataactatcccaaacaagcctgagagtggcttcaatttcttctgtacctgcctctctgcaacctcagctttgttaatttttttttctagtttattaatgtgtatttactatgtgctgggcacattaaatttaatcttcacaaagacctgatgaagataagtaccattatgatatgaactctaggtctagatgactgtcatctacaggatgggttaatagcggcactgatttaattattcatacctgtggtactaacgagatctgcccgcctgatagttaataga

SEQ ID NO: 114211 - DNA, 1310 bp, Homo sapiens
aggatggtctctatctcttgaccttgtgatccatccaccttggcctcccaaaaggctgggattacaggcgagagccaccggcacccggccgtggactttcttaaacataagccatgtgatccaactccagcttcaggtctgttttgtagactggttccacagagtgctactatttaatttagtgccttccaaacacaccaccccgacctgacacaggcttggttagcctcagttctcaccagcccattttcctttgttatctctgcctctcactggatgatcgagactaacaggttggcttgtttgcagaacaggttccctggacaaggtgatgatacgagaaaaagaaaaggacaaagtattctctagtcattgtgagaaacaccttgtgttcaccacagcacatccctggaagaaactggggacgcttttctctgctctctgtgctcccactcatggtgtgcttcatgggaagcagattctgtgagctttgcaaggactgtatgcaaaatgaatttcgtctgtgttatgatcaaagcgcaccatgctaacttctttcttttttacccgtaggaagtgagaggagccctggaaaggtaggctttcattctgtgttcagttatgcaagctgcggggcagtggtgctgatggacagttctgagtggggataggaggtctgcgctgttgctgggggagaaatgaggtggactctccagctggagcaggtcacgcggtctgtgccgaggagtgaacctctctgctctcttgcaggagcgagccactcttgcttcagtgtccagaggccaccaccacagagctgagtctgtgccgcatcacgggaatgaaggagatgctaagaaaattcagcagtaagtcagcctgatttgttacccctccggggctcgaagaattaacttcagcataccttcttccagtgtcagacattcacgatctgacacgaggctcctggttaaggaatccgggccagcacggaacaccagggagggctggggccacagaccgtctctgagcgtgagcagagagaagcagtgagacttgactcaggctttatctggctttgttttctgtctaaagggtctttttttttttttctttgagacggagtctcactccgtgtcccgggctggagcgcaggggcgcgatctcggctcactgcaagctccgcttcccgggttcacgccattctcctgcctcagcctcccgagtagctgggactacaggcgcccgccaccacgcctgggtaattttttgtatttttagtacagacggggtttcactgtgttagccag

SEQ ID NO: 114212 - DNA, 1062 bp, Homo sapiens
actagccgggcgtggtggtggacaagactactactcgggaggctgaggcaagagaatcacttgaacctgggagacgaggttgcagtgagtcaagatcgcgtcattgcagtccaggctgggcaacaagagcaaaactgtctcaggaaaaaaataaaaaaataaaaggaggccccatatgtgactgtcggttcacagactatgtgtgcttcatcacatggtccctgggtgctgcactgaactcacaggaagctgcatttgtcatgacataatgaaaaaggctgattagggattgtgatttgtgatttgaacactcagtaaccgtgtaatcttggtgaagtttcctaaccttcctgaacctgttttcttttttgtaaaaattatagaaaagaatgcttgcagtgattaaatgagataatgtacagaaaatgtttggcacattagaagttcagccaaagataagtgctattttctctcccacccaaactgaagaaccagaacctcccatggctaatatgatgcgaacaaccaagggtgtccctatgtggacgcacagctcggagctctaaagatgtcctgtgaacagagcgacgcccattccacccacagggattctcctccccacctcaggcaggctaaagctccttctccacgtggctcttctctctgtctccatttagagcttcatgctatgtgttgtggaacagtcaaagaagagctcagaaattttgttctcaaccaaatactgtttttttctgaaactgagtcttgctctgtcgcccaggctggagtgcagtggtataatcttggctcactgcaacctccacctcctgggttcaagcaattctcgtgcctcagcctcctgagtagttcggattacaagcacgtgccaccatgcctggctatgttttgtatttttagtagagacggggtttcaccatgttgcccaggctggtcttgaactcctgaccttgtgatctgcctgcctcaccctcccaaagtgctgcattacaggcgcgagccatcacgcccggccccaaattacatttaaaaaaccaggactaa

SEQ ID NO: 114213 - DNA, 1048 bp, Homo sapiens
acccctgacctcaggtgatctgcccatcttggcctcccaaagtgctaggattacaggtgtgagccaccgtgcccaggctttttttttttttttttttttttttttgagacggagtagtcttgctctgtcacccaggctggagtgcagtggcgcgatctcagctcactgcaagttctgcctcctgggttcacgccattctcctgcctcagcctcccgagtagctgggactaaaggcgcccaccaccacgcccggctaagtttttgtatttttttttttagtagagacggggtttcaccgtgttagccaggatggtcttgatctcctgacctcgtgatccacccgcctccacctcccaaagtgctgggattccaggcgtgagcccccgcgcctggcccagcctttgtttttaaatggaatgttcccttgctagtactgcagaatgtccccggtcacagagggtatccctttacctcctctcatctctcagataagccattgtcctaaggcaggcaagacagtggatacgatttaaccaccactccagactgtgttattactaagatgtttaggaaaaatgtttatcagagttttgtctgtaaattggagactcggttggaaagaaattaataattcaacctgttaatcagcacacaaggccttaaaaagaggtctgtgaaataaagagggtttactgtagggtgcgcttatccttctcacccatctgaatctgctttctcttgccactctatacgtttcaatcttgtgtcctcgaaggcaggggagcaaagaagaaacaggctcaagagtctgggaaatgctgtctcctgtgctttgcattcaccatttaattcccaccctgaattcagcatttaattcccaccttgacatcacgcacaatcagagtttgagacttgcagaggggagcccagcacgtcctccttagactatctgtggcccactgtgtttccttcttatttatgtatttatttatttatttgagatggagtctggctctctcgccaggctggaatgcagtggcgccatctt

SEQ ID NO: 114214 - DNA, 1292 bp, Homo sapiens
tcttgcagatgggaatgaaggcccaggtgctctggagaggtgactctcctctaggtgaggggtgtgtgtgtgagaggagtgaggtgcggtgtgggagggtccttgcagggtccggctgctttcggaggctgtttttctcagctccccgttttgtccctccaaattgtgcccctctccttccaattgtcactctcctttcccccaaccctccctgtctcccagttgtctcgcttctcagaaaggaaacactggttctgtaaacctgtttgagaagaaaagctcgaggtttcttggcctctctgcttctggagccaggggaaaaaatagccccaggctgaagacaggagggaccagattgctgcttggtgatgcgatctcactgcagaggcagccaggagaccctcctgagacgaatcggagagtccatgctgcttttacacacatcctagttcttttataactagccttttcctattaacggacatcattcaaaagccagttttaagcaacataaatattgaaaacaatactatactatttagaattaattataagttttgtttttaaagcctaaatcttttattgttgtttgaaccctgggcactgaagctaataatgtaacttttctcccttctttcttctttggcatagatttaaagaactgttagactcatttaaaatgctattaggcattttaaagagtaattgttaaatgtgttgtctcttgtgggactggaaatgttctgttcttatctggcgctggttacatcctgtttttcatttgggaaagtgcattgagctggaaatttatatgttcaatttctgtatgtaaattgtacttcagtaaaaattttcaaaaaagtggctgccttttatagcaggtgtcccatgcgcatatatatatatatatatatatatttttttttttttaagaagatgacctcaagaccaagacctgtttaaaggtggggaaggaagcaggatttggcagagggataagtctagctgccatgcagggacagctacaggctgcctcagccacacacagggcgccctggagctaaattggctctgcaaactagcctggctggagttggactgagatatcctagccgttaggcactcttgggcaaggtggctcccccagccgaggcagttcctgaaggggctgacagctgcagtcagtctatctgcccaggggattcccagcaaaagaggcaaccaattgctgggaggaatctgggacatgcatcaaagtgtccacgttggcctggcgcagtggctcacaccca

SEQ ID NO: 114215 - DNA, 1034 bp, Homo sapiens
cggccggaaaaggcatggaaacagctccttcgcttatcttccagaaggaatgcaggactgcctacacctaatcttaatcgagtcaaaataatgtcagacttctgagacctccagaactgcgagataataaatttgtgttgttttaaaaccacagaaggcgtggtgatttgttagcccagctatagaacacttaacacgaatcaagggtggaagcagaggagaaggggaagaagggggaaagaccttcaattcgtcttggaaagtaaggctcacagtcaactgcacactgagtacaaatttacctccagggactgaggccaacctagctcaggaccagggcaaaagcaccttgaagtgctgagaccagtctcatcatatcaccaccaatagcacagggaggctcaattccagcagacacaccctgtgactccattgatgacacagtctgtctgcaattggcaaactcttctttgtctgtgagtaaaatgatgttgtttacaagcaaagttgaaagcatgaaagattttcgataaactcctcagggctcattacaattggaatcaattttatgcactctggtttgggtagcatccttctatgattagagggtggatgccaagcagcctatcgtgttaaaaataggaaaaagactataggattgtctaagcagagtggaaaaacaggctgaaagagttcagtgggtttgtgtaactttgtcttgtaacaaagtcagcaagtgaaaagctagggaaggttttttcctcctcttctgcctcaattttctttttttttctgcctgaatttgaatatagatttcatctatttaaacagaaatacagtctatcctctttgtatactgatctcttgtattccccgcttcttcacttttgtttcttcctcattacttacaagcaggatggaagtcaggtagagccgactgcattccaagtccttcactttctcttcgggtagctgggccctgggtctggcatcttgtgaatgtaaaatgaaggttgccttttgtctggtccttc

SEQ ID NO: 114216 - DNA, 1019 bp, Homo sapiens
ttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgtt

SEQ ID NO: 114217 - DNA, 1291 bp, Homo sapiens
tgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatc

SEQ ID NO: 114218 - DNA, 1058 bp, Homo sapiens
tgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagctt

SEQ ID NO: 114219 - DNA, 1049 bp, Homo sapiens
cgcagtggctcatgcctgcaatcccagcactttgggaggccaaggcaggcacatcgctcaaggtcaggagttcgagaacagcctggccaacatggtgaaaccccatctctaccaaaaatacaaaaattagccgagcatagtggcacgcgcctgtagtcccagctactcgggaggctgaggcaggagaatcacatgaacctgggaagcggaggttgcgatgagccgagatcgcgccatggcactctagtctgggggagagagcgagactccatcttgggggagaaaaaaaaaggtctaattgtatttttttaaataagctggagcttttcaacaaagatgaccttcatgacctctcaagaggagggccactcattgactgggtagcacaaggccccacttctattagggcatgctggctagagtcccctgtgtcctggccatagcacagcctttgactggcatcacacccattctatgaatgaatagagagattgactaacctgagtgactagctttgggaggtggtaggatgattaggaaaactgaagcctcaagaaaagaaaagcatttagctcagtgctctgtcctagaggctacattgtgtcgtctcttcttgtccatcagtttcattttttcagacacggtcttgctctgccacccaggctggaaggcagtggtgatcagagctcactgcagccttgaactcctgggctcaaacaatcctcctgtctcagcctcccgagtagctgggcctataggcatgtaccaccatgcccagctaagtaggtaatttattttgaaagcactttgagaagcacttcactgtcaaatctgtaggtctaaaaggaaaagaatacatacacataattgatttcacattgttttacatttcctttgtcttcttctggaatgtcatcttttttcttggtttctctttcagcacaggatctaatctagatattggaaaagagaatccaatgggttatatgtttatcttccaccttccccactttacgtatcacataagaacattcgagatgatttcttat

SEQ ID NO: 114220 - DNA, 1049 bp, Homo sapiens; identical to SEQ ID NO: 114219

SEQ ID NO: 114221 - DNA, 1021 bp, Homo sapiens
tttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacaggtagctatttatttacttatttccactattttcagtagccaatagaaatggcatgtagaaaacctacattctcttaaattactgtagtttttcacatttttgtctttatttctaatttatgagtgtggcaatattacctaaagaggacatcgtaagtttgggaaaagactgtcatgaaagaatatctaaaaattataaccgattctaagtatatacttgaagaaattcaggtttgactgtatctacttcataaatttatcatctttttataactattagaaccagagttagaagcagtttgactaatataaaaattatgtggattctgttagagtagttcaggttccttaaaataagaatagatcaactaaaaaactaagtataaaagctaaacaagtgaaattgaagcagttttattataagatttggaagagtgcaggatgtttatcataccacattattaatatttattactcttcctaggtagataagtaatgtcc

SEQ ID NO: 114222 - DNA, 1034 bp, Homo sapiens
gattagaatccattttttatagaaaccaaatttaaaagtatacatattttaataaaagtgttgtggtaataaccaaaattgaacacacagttttaaagctttttatatttagtagcagttgaatatatatggcatgttttacatagattaattttatttttctttgtttaaacaggagagccaaattgaaagccgacagatactgcaagtgactgggatttttgtttctgccttatctttctgtgtttttttctgaataaaatattcagaggaaatgcttttacagagttcttgagttgtgaaattattgtttagctagtttaaccaggattaaacaagtttaatcaggattcttcatggatgtactttttagctaactacagtttttcacatggaaatgaaacttacagttcacacttaatgtaccacagaatttttttctggatttcctgtcctgaagcatgaagtgtactagaaaccaattcttcctgcgctacttgtggaatctgtcttactggatcataatcttactttactttatataatagatgcttaatcagtgcctttaatagaagttagaaactcccaatccaatcaacaaggctttggttctaccttctaagtactacccagatcacagacaatccaaatatcagaactagggggctgggcagagaggacaaatcatctattagggagtgggacagaaagcagaaacattacaaaggagcaagtaggctcagaacagaggggagagtagtactggggaaactccctgctgaggacaggttagccacagtggatatgtatgtgatgcctttgtccttgtgggctggaatggaagctggtaagggaataggaacagctccagtctacagctcccagcgtgagcgatgcagaagacgtgtgatttcttcatttccaactgaggtaccaggttcatctcactggggagtgtcaggcagtgggtgcaggacagtgggtacagtgcaccgagcatgagccaaagcagggcgaggcatcaccttacccag

SEQ ID NO: 114223 - DNA, 1821 bp, Homo sapiens
tttttttattgttgaaacacatccaactcttacttgtgggatggacaaagggttggtggctctatacggagccaggtgcctgctggccagcaggctgtgtgagtcatccggtcttagaggcgctggatttctctgcagtgcaggccagccctgctgctccttggtgtagggggcagagccgggcagtgccccctccagcctcccagcaatcttcgtcccgttttcgtgagattccagcagtctccagtttgaggaaagaggcccactgtgtcttgaggctgaacttcttaacccactttatttttatgtgtccttatcagaacataagcagtgtctcaaactcaggccgtttactagtcgccaccgggcaaagctaaatacaacttttataagaacctggccaacggtagttgaagtcgacccaaacattttaaactttgccaattgtactagagccggagcaggcaaatggtggtagatcttcttagcaacaaacagttagaagacggaaagggctagggttagggtcttttggtcacccagcccttacctggttttcagataagaacttggcctgttacacattttcacgtagaagtgatcttcttggtacagccgaggtcttaagcttttactgaaacactatccttagctgccttatgatttaagtgaggattatagaacttcagccctaactttttcattatgtgtatttttcttcattcatgtcaggttggatttggtctagggagtcccagaaagaagtagaaaaagagagagaagcctaccgtcggagaactgctgcttttcaacaggatctggaagccaagtaccacgccatgatctcagaaaatcggcgtgctgtcgctcagttgtccttggaactcgaaaaggaacaaaacagaactgctagttaccgagaagcccttatctctcagggacgcaagttggtagaagaaaagaagcttctggaacaggaacgggcccaggtgatgcaagaaaaaagacaggtgcagcctttgagaagtgcgtatttgagctgcctgcaaagggaagaaaactggcaaaggagagccaggcttttgctgaaagaatttgaagctgttctcacagaaagacagaatatctactgcagtctgtttcttcctcgcagcaagcggctggagatagagaagagcttactggtgcgagcgtccgtcgaccccgtcgccgctgacctagagatggcagccggtctcaccgacatatttcagcatgatacatactgtggtgatgtctggaacaccaacaaacgccagaatggcagactcatgtggctctatctcaaatactgggaactcgttgtcgaactgaagaagtttaagagagtagaggaagccatactagaaaagtaagacaagagtgaaatcaaactgcttttagtgactcgaggccaggcagtcatgcgccttctgggtctccggcgtcttccgttcccgtgctgcccgtgtcatggccacaccgtcacccttcagcagcgacctccactcccgccaccgtctgagcagaagtgcaccgaagcctcagagacagagggtctcctcccgatgctctgccgctgttggggatatggtttcttgaagcatttttaggctgccagtattgtattaagcagaacagtataacctcgtattttagctccagggtaaaaatggttttttaaaaagtcaaatacaatactggtccttaccacaagtaattttctgtctgtttcatcactccctaaatactttctcctcaaattatttttctctgtcaccagattacattaagaatttgtca

SEQ ID NO: 114224 - DNA, 1030 bp, Homo sapiens
tgaacgcccagaccgcagggaatggggtcggaggggggcgctcgtccgcggaggtgggcgggagcggcccggggcctccgacctcttgtttattatacatcccttgattaactaaactattttgtaattgtgtgtgtttgtggaggtcacatgtaaacaaacttaaagtgactctactttgtgaaaatgtgaaacttcgtgtaggtactcagtaaatcagtaaattcttactaacgttagcccccagcctagctatggagggtgcatgctgagcccgaagcagagaactctgtaatctctgcattcatcaccaccacgaggaggcctcagaagcttctagcactgtttgcaccttccccacatcacccctccctgccttcctcacagtcttccttctgatcagaagaccctttccttctttctctgcctgtcaaaatgctgctcactcttcaaaccctagctcatatgaaagtgtccggtgtgagcccacttttatcgagttgattctgtatctttgatacaactgtatgagggttctccagagacacaacaaatagaagggagacgtgaggaattggtttaaaggttcaattgctaatctcatccaaaaacacccttacagacacgcccagaaataatgcttaaccatgtatctgagcacctcatgatgccgtcaagttgacaaacaaaattaaccatcgcagcagccatacatttaaacatatttgtaccagagaacttacctgattctacctgcacttcagatgcttaagacatgtctgttttctccactttccccaaccagattgtgagtcgctttcatcttaagttcttgttttttttttcctttttctttttctttttttttgggggggacggagtctcgttctgtcaccaggctggagtgcagtggcgcgacctcgactcactgcaacctccacctcccaggttcaagcgattctcctgcctcagcctcccgagtagctgggactacaggtgcccgccaccatgcccggctctggtctagttt

SEQ ID NO: 114225 - DNA, 1028 bp, Homo sapiens
ttaatcaagggatgtataataaacaagaggtcggaggccccgggccgctcccgcccacctccgcggacgagcgcccccctccgaccccattccctgcggtctgggcgttcaggcccttcggtctgggcgatcccggagaaccacccacggggctttaaaaatgttggtgcccaccacctccccggaacagggcccgctctacctcggtcggggagcgcgggacctcagcgttcccttaacgccaccgtccgcgggtccgctttgcgcaggcgcggcgcccccactcagtacccgctccgggcgtggcatggtgcgcaggcgcgatgtcccccactgcagccccgctcgactccggcgtggtgcgcaggcgcggtatcccccctcccccgccagctcgaccccggtgtggtgcgcaggcgcagtctgcgcagggactggcgggactgcgcggcggcaacagcagacatgtcgggggtccggggcctgtcgcggctgctgagcgctcggcgcctggcgctggccaaggcggtgagtccgtgccgcggaccggggcggggcaggcgggggccgaggcggcggtaggagcgggacggtccccagcgggtccgagcggagcgggcgccgggtccctgcgccctctgtcccgggatcgggaaggggctgagagagccctgggccggtgcgaggggaagccgcggggcggactcggggacccggggagctcggtccttagtagatagtccgcgtccgggtgaaggtcacaaccccgcgggcttgctgggcgtcccctccgccgccttggtccgggcctggggtcctgggaccccgcgggctgaggtagcccctcgcctcagtgcctggcaggtggactcggggaggagtcgtgtctgcccaaggtcacccgggcggatagcggccggtggccgccctggctgggctgggcctctgccgccctctgtgcgggttgtcctgaggagcagcccgcagcccgtgggtggggccggcggggcgggtgagaccgcccgggt

SEQ ID NO: 114226 - DNA, 1157 bp, Homo sapiens
atctcgttgagttaaatgtgaggattagtcatacagccatcctgccaacatcagaaagcgtgtaaaccgttctagtgtgttgctgtggttggtactgactgagcagagacccctgccgcatcttgggcttttaagagctgctaggagggcgtccacaagcaggaaggaaagcccatggtcagtggggctttttaggggaaatggtagcttgtgattggagaaaagctagagctagtgcctttgtcctcaacccagatggtgcccggtgttccttctgcagactaagaccctgccagcggcggaggcacctcagacgggatggcaagatagcaaaattgaaccaaaatttagtcttgggttttgtaaaagtctttttatcttgatgaagttagcttttcctacagaaattctgcctgcaagcagcatatttatcggcatttcagataggctttttttcctgaagaattggagtttacgaaggaacagcataatcaaaaaattagcagaaaaaagaaagaaattcgtgatagccaactgagaaatgtgtttggaaaatagatgctgaggataatttcagtaaagtccagagagaattttttaacctcattttggccagttctgtggtgttttgatcattctgtatttacaactgctttcaagtgacgaacttatcagacttattttgcttttggtttctttttatggcccagtgcactgacacagcttgcaaactgttcgaaagcagtttaatcagaggaaaaagaaaaccaagaaacttcaatagttactggttaactgcttacttcaggtgaagtttttcaaatcccttaacatgaacatccaatatattgttctaggacaaattgatttcttttctttgaatggattgttctgaatatgtttaatggtgttctagaaatacattatttaggccattatagtagtaaacctttgctttgcttcttgggataattgtaacaacaatggcattccattctgcattcctcatgatgtttttcctgatttatttgaaaaattgtgacttgttttttgatatgaaacctggatattaatattagttgggagtctcagagatttttcccaagggtctttagataggggggcaagtccaggatccagagccaggccggccgact

SEQ ID NO: 114227 - DNA, 1016 bp, Homo sapiens
gatacagatctcctgattcaatgttgagtgccttttgaactgaccacaagccctcctggacgattggaactgtaatgtggaaagggctatgatggagccagttaaaatgcttcattacttgcaaaataccacatacagtaatacaatatacacgtctttccccttctccactaagtagcatacattaagacttcacagaggaagtgtgcctttttcatttcgtatctgagtcagtgagtatcctgtttggaaacaagcttcatcctggttttctagagtgccaagtcagggtggaaacgaggacctgggggctcagtccttccttgccccttgggctgccttcagggttaagtagagggtcccagctgagctctctggatgcacaggagcacctgggtacataagaaggtgaacagtttgcaaggggaaattactatcccccacagcatttgttccttcaggacactaaccctctggatctgtgtcttctgtgtctccagtggccaacagtgttgcaaacaggaacccgaggttttcacttcactgttgatgggaacaagagggcatctgctaaagtttcagattccgtaagttcatgctttttgttccattataaatgatttttttggcttagggggtaaggatctataccagtttgttttcatatgagtcatagacataagggaaaaatttctcataggtatccaatgcatgctgaaattattttcagtgtaataatacttaattgcaagtacaaatataaacatagatgtttacatttttacttgtatctgttatgtatctataaactagatttaaatttagatcaagtaaagcaataaattaaaataaaatgaacagtgtctgctgtgatagatgataaaattcctactgaaaataggacggtggggccagtgaacagtatctgctgtgatagatgataaaatcctactgaaaataggatggtggggcccctcgggtgtgggttgctttgtatttagtgagcctatctctgt

SEQ ID NO: 114228 - DNA, 2461 bp, Homo sapiens
ctacttccacctcctggattcaagtgattctcctgcctcagcctcccgagtagctgggactacaggcgcacgccaccatgcctggctaattttttgtattttagtagagacagggtttcccatgttgcccaggctggtcccgaactcctgagctcaggcagtccacctgccttggcctccgaaagtgctgggattgcaggcgtgagccaccgcacccggccatggattgttttaatattaactgttaacactgaagaaagacttgaggtgacaatagttactgggtaatcagagtcaactttggcatggccaaataatattctgaacggtattgattcagagtaatcaatattctgaactttgttgttttctgatgcatggggacggatcgttaatttgcaggttgttagaacaccagtgacttctctgtggctgagtgcatcgacaagtgtgtggtgggaggagaccgcggctccatctggagcaggagctgtcatgtggggagctggcccaggcttacaagagcgacttgtgctggctgagggaacggcaggtccaggcgggcagcgctgtccggcgcctacctttctgcggtgccggaatctgctcgtctgcaaccgtccgctttggtagctgccagccacatggggctgttgctaatgtggcaggtgtagctgaagagctgaatgttttgacttattttaattaattaagtggttatgtgttgccagtagctcccatctgggctgtgactgcatggtctgcggacctcactctggcaccagactccgagtggagctgcatgcggccaccggacagtgtggagtgcctcttcgggttgtgtagaagtaggaaatgtgtcaccaaaataggagctgttgctgctgcgttctctagcacacctgccttgtctgtactgctcggcgtggaatgcctctcgggctctgacagtgtcactgacactgttgctgatctccttggatttacctggtccatttggatcaagttctttcacctattcacatgagcagataccaccttaaaaccttaaagtttggcttaacacttcttgccctttttttttcctttcttttagtctctgcgatatgataccagctattttgtggagtattttgccttggatctcctgatggagaatggggagtgccgtggtgtcatcgcactgtgcatagaggacgggtccatccatcgcataagagcaaagaacactgttgttgccacagggtaggaatctcatttctactttattttgtttataaaaatgaataaatttcatttagagtttctttattttaatgaaaatagaggcattgtagaataacggtttagacacaggccttgatataaccatgtgagggtgatggcctttcccagccgtggttcctcacctgtaaagggtgaggacaggagcacctgcctcagggtgagaaagcatggtcctcagtagatggtagtggttgccctcaggttcacagcttacctctcccaatttagatgagggaactgtggcccaaagagtcaacatggggttttctggcaaaatctctcttgttttagtgggtactgtattgatactgattcctcgggtgggtaagtccttcttctccacatgatgaaaataagtaactttaattttatacactgtcagttactttaaccattttaaaagttaaaaagtgtcagtacagccaaacaaaaaatcagcaaaactacaggttgggaagaaatattttccaaaccatatgtgtaataatatcttactatctaaaatagcaaaaaaaaaaccctactaaaaacaacctactaaaccctactaaaaaacaaccctactaaaaatgggcaaaggacttgaatagatatttttctagagaagacatacaaatggccaattgatgtatgaaaaaatgctcaacgtcactaagcaccagagaaatgcaaattaaaaccccaatgagatatcatctcatctcgctccagttagaatgactgttaccaagaggacaaaagagcaagtgttggtgaggatgtggagaaaagggaaccctgtgtgctgttggtgggaatgtaaattagtacaactattacggaaaactctggaggttcctcaaaattcataggactactatgtgctccagcaaccccatttctgggtgtatatccaaagggcatgaaatcagaagctcaaagagacacctggaccctatgttcattgcagcattattcacaatacccgagatatggaaacaacctaaatatgtgttggtgtttaatgacaatgtggtgtgtatacacaactgaatattattcggctatgaaaatgaaggaaatcctgtcatgtgtgacaacgtggatgaacccaaagtcattatgttaagtgaaacgagccaggcacagaaagacagatactgcatgtcactcatgtggaatctaaaacagtcac

SEQ ID NO: 114229 - DNA, 1036 bp, Homo sapiens
tcacaaaataaatcatcacgctgtacaccataaatatatagttttttttttaaattcatcaatcatacctcagtaaatctgggggagaaaaaaatccataaaaattttaaaattttcattataaaagtagtatatgcttattggggaaaccttttgaacagcacaaagctaaaatacaaatagggccaggtgtgcagtggctcacgcctgtaatcccggcactttgggaggccaaagtgggaggatcacttgaggtcaggagttcgagaccagcctggccaacatggtgaaaccccatctctactaaaaatacaaaaattaactgggcgtggtggtgcacactgtaatcccagctactcgggaggctgaggcggaagaatcacttgaacctgggagccggaggttgctgtgagccgagatcgcaccactctactccagcctggtcaacagagttagatcctatctcaaaataaataaataaaatacaaatggaagtcctttctttgatcccaggcttctatcctacctgtgcagggtagcagcaccagtggcgcggcccctagtgatatgtgtggggtgtgcgtgagtagggggttgtgtgtgcacagcactgagaagacggtgctgggggctgccgtgtccattctgtgatctcaccagataggaggtccagatgtgggccgctgtgtgcagtcactgctctctattgtttccagaggctacgggcgcacctacttcagctgcacgtctgcccacaccagcactggcgacggcacggccatgatcaccagggcaggccttccttgccaggacctagagtttgttcagttccaccctacaggtagggcaggacgccttgcccggcaggtgtttggcttgtgtgtgtcttgtaagcatgtgatgcctactcattgctcttccatagttttatgtaataacatggttttgaagatcagcttcctcagctctcaggtcctaacttcaacgtcatttacctaaggagacttttcccacactccccttcccctaaggcagt

SEQ ID NO: 114230 - DNA, 1898 bp, Homo sapiens
tctctgtcagtgtcagctttctgatccctggaagggatgaaaataagaaatgaatttgttgtagtgttttttttttatttgtttcgagatggggtcttgctctgttgctcaggctggagtgcagtggagcaatcttgactcactgcagcctttgtctcccaggctcaaacgatccttccacctcagcctcccaaacagctgggactacaggcatgtgttaccatgcccagctaattttcgagggttttttcgtttttggtagagacgggatgtcaccgttttgcccaggctggtctcaaactccagggcttaggccatcctcctgcctcggcccctcagggtcctgggattatagccatgagccactgcacccggcctgttgtattttttattactgtttttaatgaataaaatgtcactgagcccctgaattccctctgtaatttgcttagagctccactgctcatgctttgtcttcagtatgtgagaagtaaccacagaaaaaagagcattgaaacttagaaaatcaaaagacagacaagaatcacattcgttttttaaaagcaagattgccctttttgtatactaataaaaattgtagctttcgaaatacatttagtttagggtttttgatctcctttgttaaaattcgagagcttggcatgccctgtttctcatcgcactgaggagtcacagagccgctgtttggagcacagaccgccggactacccaggtttgggtttgagctctgtcctcagctgcatgactggatgttaccaagtgttaatttgcttgtcactgagaaagggggtcgtactacccagagttgttgtaagacttaaacgagttaatatgtggaaagcagctagaactgcccatagcaagtgcagtgtaaatattatctaaaataatcattattactgtccttgtcactgtttggataatttagatatgaatacttcaagctagtattcttaactagtcaccacagtatcatagtgcaaaagaatgttcaaaaattaaaacaaaatttgaggcatccaacgtacactgggctgtaatcagagtattggccagaggtctgtgggccggcctttctcctctctggggacaccgctctgccccagcctctgctgcagctgtcagccttgtcagtgctttttgttatccagactttctactgtatcttaactgtcttgctgtgcagttttgcacataatgccttctgcttatctttttcctctttcccccaaaaaatgtcttgaaaaaaataatgcatttgaaatagagatctagcaattgttaggtaataaatatgtgtggttttttgcaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtccatgactctggagatccgagaaggaaggtgcgtgtgatttaccaccagcactgtctgagcgggcacacgggccggggttgcttctgtgagtttcagcaccgctcgccctcaccttcgtgtgcaggcgcatgtgcacagccacctctcttagctgctggcaggcgtctgttagtctgcgatattttcctaaagacctacattttgaaaattttagccagtttctttctcaaatctgtggaacagagtttctcttagtgtgtgtgagtatgtgacggagtatgggagagagagacacacacccaacctgaagtcggcatgtgagccttgggtgttgtgtctgatacccacagatgttttttggcagctttcaaagtgtgtgggttatttggctttcagtaaaacagtttgcagctctttcattgc

SEQ ID NO: 114231 - DNA, 2430 bp, Homo sapiens
agctggaaagaaggctgggacgacggggcccacctcgcagttgtctctttagatcttacaggaaaagatagatgtttccttcaagaaagtactgtattgttttctagattgcactttaaatttctattaccggaggatggagggggcttaataatttattcctccttagtaaattgtcagagatacatcatttgcagctttttccattttgtaattactttcctatatgatcttgtgttatttctaatgatcttacacatcaagggatctttataattcattcctttgagtggtttgtggttcacacagagcttgtcagtcacttaggctccttgttgggcgaggtgggtggaagctgttgctctccctgcgtagacgaagaggtgaacggggtagaacagtctggaacatcagtctcccctgctgatgttcctccacctgccgtgctcctgggtctgagccggagcacaggtggtgagggccccgggaacatgggacacgggggacagtcgcagatgctgacattggaggtcctctgacctgcttgtaacagcaggtgctcaggggcagaggggaaactgggggataccttcggaagcttccctctgaagaagagtagctatggtccttacttccctcttagatacggtctttacttccctctctttttttttcttggagatgcagtctcactctgttgcttcggctggagagcagtggtgcgatctcagctcactgcaacctctgcctcccaggttcaagtgatttttccgcctcagcctccctagtagctgggattacaggcacccgccattatgccccgctaatttttgtatttttagtagagatggggtttcaccgtgttagccagacaggtcttgaacccctgacctcaggtgatcacccacctcagcctcccaaagtgctgagattacaggcgtgagccaccacgcctggcctacttccctctctctgacctgcagcacagacaccctgttggggaaggtgggctggtggaggcatgggcaccttgacatttcacctgaaatcttcctttccacaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggtaagtgttttcttcaggagccagactatttgagaaggcgcaggacgttagaaagtcttttttcttttttttgagaaagggtcagcccaggctggagtgcagtggcacagtcatagcagcctcaacctcccgggctcaagcagtcttcaacacctcaaccttcagagtcccaagtagctgggactacagatgtgcaccaccacacctggctaatttttaaaaaaatttattttgtagagacagggtctcacaatattgcccaggctggtcttgaactcctagactcaaacagtcctgcctcagcttcccaaagtatcgggattacaggcatgagccactgcacccagccaggttacaaagccttgatttcttactggaaatttgcttagtgatcatatagaggtagtctgggtttttcccccagaagtgattaaactgagaaatccagaaattatatggtggtaatgttgagactagatagaggctggttggggatcttaacagttaaggtgacatttttggggttacatttttttttaattattttgcagtcattatgttctgtttagaaaaagcactattagaaagttgttatttttaggggaatcattacatattacttgcctgataaaaatcacttatttgcaatgaaatattttaagtagttggcatgaatgaatatgtaacttcttggtacttagaaaagtaatttaggccattctagaaacaaagtacagctagcctctattagaggagaagggatgacttacagtgaacaggattcccaccctttacggacagattggatttcacttgctggttttcttttcatgatagcatcaaataatgtgcagtaaaggaaataccatgtgtgggagtgtgagtcttacgtgcactaagaacggggcagttagcatctctcccacctccagacatcctcacggtggttatccagcctcgtgtgctcagaacagtgtgaggtggatgaggcactggtggatgtttgcgtggcaaggatggtgggaccccaggcccatgttcttcccgttacctttctctggtgttaactgttagcatcatttctgctgtttttatacaacaggtgctttttgtatggattcaagtgaaataaaaactagcacggctgtaacttataaacgtgcccccttttgtatctgtagttagaaaggtgcag

SEQ ID NO: 114232 - DNA, 1062 bp, Homo sapiens
actcatagtctgaatttcctaatttttctgtttaatttatgtaacttttaagtgaaatgcaaaacaacaggtctaaaagttaagcagttcttggtatggctgcttctatggattaaaagtttacaaataatattttgtgccacagtcaatgcaaaatcatgctgccgtgttccgtgtgggaagcgtgttgcaagaaggttgtgggaaaatcagcaagctctatggagacctaaagcacctgaagacgttcgaccggggtgagcagacagtgggctctgtgcacactgttgggcccttccttctgcagggtgggctggtgtctgtcccgtcagtgctgacttagttccgtgcttgctgtctggatgggtcctggcccacagctataaagccacaaccagtgactccatggactagcaggcccaggctgacagctcggagggcccatgtgactgggtcccgcctgcccctgatggaactttttgtgtccccaggaatggtctggaacacggacctggtggagaccctggagctgcagaacctgatgctgtgtgcgctgcagaccatctacggagcagaggcacggaaggagtcacggggcgcgcatgccagggaagactacaaggtgggccttctcaccacgcccacctgcacctgccttttcctgccacctggtgggactcagccccacccctgcattttctctgcattttctttcgttgccccaaaagtaaatccaaaaaatgcctttttcccccctggtaactttgatccctgggttctcgccatcttctggatcactgtgaccttttccttgctttgggtcggcatccactgatgccagcagtggcatctccaagccaatgtgctttgctgttagaaggccaaggttagaagtgcagctagagtggcaagaccaggaaataaatgccagtttattaaataacgagtaagccatcatttcaagcctgccctgtggaggaaatgccagtttattaaataacgagtaagccaccgtttcaaacctgccctgtggaggaaatgccagtttattaaataacgagt

SEQ ID NO: 114233 - DNA, 1050 bp, Homo sapiens
cacaggaggctgaggcaggaggattgattgagcctgggaagtcaaggctccggcaagctgtgatcacaccactgcactccagcccaggtgacatagccagaccctgtctcaaaaaaaaaatttttttttaataaaaacaggctgaaagaaaagattgaggtagtctcccagcacatggagcaaaaagacaaagtatttgataaactcttaggtacataaaggatgcttaagggaacatgcggacatggattactgtggactcactgctggctgcacaccccctggccagccatgcggcctccgtgggttctgaacatgttgatggtgccaacctcctgggctgaagtggaaatggaatgagttctagggcatctgtctcttagatcatgttaatgtctgctgtgttttttctgtattgctctgttagagtaataagaaacgtgatggtgtttctggcctcaggtgcggattgatgagtacgattactccaagcccatccaggggcaacagaagaagccctttgaggagcactggaggaagcacaccctgtcctatgtggacgttggcactgggaaggtcagtgtggagctcgttctcaccacagcccagcacccacacggccccgcccaggcctgcgggctggccttgctgatggtgaacggggaagagcaggccagatttaaatcaactcccgacagattcgaggcaccgctgaaaaaggcactccgacagcagtcgggcttcgggctggaaacagaatccagttcctgcaggtggttcagaggagccttaaggaagggttgctccgtggtgtgcgccagatggacgtcactgggcaggagcaagtgtccaaggcctggtggtaggggaggagatgatgattgtggacctagcgagaaagcatctgtggggtggggacacacagccattaccagaaaccagtcccacgttaagggagcccagaagagacacctcccctctcctcccacgggctgggccaactggaagcgtctgcaggggagctgaggggatgtggtgcagcctttagca

SEQ ID NO: 114234 - DNA, 1221 bp, Homo sapiens
tcctgtgtgtgcatatttaatacacagcttgagtattccttctctgaaatccttgggaccagaagcgttgtggatttcaggcttgttcagactttggaatatttgcattatacttactgtctgagcatccctaatcggaagatctgactccatagcacatttcttttgaatgtcatgctggtgctcagaaagtttcagattttagagaatttcagatttttggattagggatgttcaacctatataaatatttactttgaagtagaaaaactggaagtagatggtttaaacataaagtgtcttggtatagacaagggttctcccactttacatgatgggagcatttttgtaaagcactgagaatcttaaagttcacatgccataaatctacttttatagttaaaatttttcaaaaggaacacaagagatggctttttgtacatttttgtgcttaacttaccactgactcttcttttcaaggtcactctggaatatagacccgtgatcgacaaaactttgaacgaggctgactgtgccaccgtcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgaacaaactttcttttatttccaaatccatttgaaatattttactgttgtgactttagtcatatttgttgacctaaaaatcaaatgtaatctttgtattgtgttacatcaaaatccagatattttgtatagtttcttttttctttttcttttcttttttttttttgagacaggatcggtgcagtagtacaatcacagctcactgcagcctcaaactcctgggcagctcaggtgatcttcctgactcagccttctgagtagttggggctacaggtgtgcaccaccatgcccagctcatttattttgtaattgtagggacagggtctcactgtgttgcctaggctggtctcaagtgatcctccctccttggcctcccaaggtgctggaattataggtgtga

SEQ ID NO: 114235 - DNA, 1031 bp, Homo sapiens
tgccctggcccagagaaggggtccattcagatggggtggggccttagaattttacttttggtttacaactttatgaagagaccattagaaaccacttgaattcacatcatgaaaaaaaatccacactgtaaaaaaggtttgtagattaacacattaggtgaatgccaaagccacagaatatctaaatttctctgaggaatttgaaaactctcaggtatatgccttgtggacaagagagacagaaaaatgggacagaggatgagatagtttggagaatggatagctgatcagatctgtagctgtgcccagagtgctgaataatggatttgcgtccacagggaagaaagtctcaggtgccactgataaaagaccacgtccttggctctgggtccattcaacatcttggtagacaactgagtgaaaattcagagacaaccctaggaagtatgaggatgaaaaaagttagcattcatggaatgaggcactgaagaaactgaaaagctgaaataaccccatgaaataatgagaataattgtagtattctgaaccggggcacaggacacaggaccggggtggaaggcggcacgagactacgcgcgtgggaaagacccagggatcacagtggcccaaagctgggcacttcccaattccgggatttgtgctacaggcactccaggctccaccttagaactgtgtccagcacgaaggcagtgctgtcttgcgggaggcagggctgcaccaccaccggggtgtgaaggggcccagcaggcaggggtgtgaaggggcccagcagtgtttccagctgcacggggtcaggggccgcgctgatgcagagcacgggggcgcaggttaaacctaaaggagggaagcttttgggggcggaacagacaaccgagaatgctgcacactgcctttcccacccgaattgtgttttgacttttttttttttttttttttgagacagagttttgcacttgttgcccaggcctggagtgcaatggcccgatctcggatcactgcaacctcctcct

SEQ ID NO: 114236 - DNA, 1063 bp, Homo sapiens
agctctgggaattagattcgcgttctaggccgagacccaggagccaggggagctggggccacttaccttccccgtgcctcggaagctgagtgtgaagctctgctcttctttctgtcgtggctgcggctggatttcctcacacatcccattgcacggcctgcctcacagctgcaagtgcaccttctcctgggacttagggggtcagggctgggggacaatcccccacacccccacccagggcgaaggtgacaagactttaagggatttcaccccattcacagacaggcatgcattgcccagtccctggttagtggtcagcagtggggccccgccaggctctgagggctgaggtctggtgggaagcctcaagtgagtttgctgcaactgatcttttgctgcttgaccgttcctctctgtctcagccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggtaactcactcactctggcttgtgtagcgtgtttcattttggaaccttggagccgttgaagttctttaaaccttgttggacttaactgattgtctaaccaggctacgtaaagtttttgttgacgtcatgcaggttcatatttgatattgctcatgtcggaaggcgatcctcgacatggatacgtttattcaggtttttatccaaaatgagataagggctatgcaagccgttcatcttttctgaagtggaatgatgtcgtgagcaaaactgagaatgtggcttttgaaatcatttaaaagtggatccatgaaaataccgtggggcagggcagcttatatttcatgatagatcaaagcacgttgaaaaggcaacagtcacctaagaaacagctgtcagtcaccaggtccaaaccgtgcgcctcagaaggggcgttaggcagaacgcgtgcccattctcaggtgtgctcggcgtgtgtgtgctcg

SEQ ID NO: 114237 - DNA, 1160 bp, Homo sapiens
agccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaacgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctg

SEQ ID NO: 114238 - DNA, 1040 bp, Homo sapiens
tgtggtacctggtcgggggagttgtccacgctgtatttgtcttcactgagggtcctggtgcagctgcccacaggcctggccaaggtgctgggggaaagctcccgaaatgagaaaccagccctgtcttggggagagatgtgcctttgaggctgacatctacatgctgggtggtctgggacccacatctagaatcttcgcaatgtccatgtctctcatgcctgtgaaacgcccctgctctccccttaaaggtataacttctgcatgtttgtgttacgaaggtttgtttatcttatcaaggagttcctcatcctagttcagctttctttgaggtttcctggattaatgatctcagaggctctgcttgtagctccactgtgatcacctgatagtttgggggaggttttgtacctaacatttctaccgtcctaacaactcctgcagtgcacagagaacacccctagcatgaacagtgtgaggattccaccagctttttcaccatgaaggagacagaccgggaggccgttgcgacagcagtgcaaagggttgctgggatgctccagcgcccggaccagctggacaaggtggagcagtatcgcaggagagaagcgcggaagaaggcctccgtggaggccagattgaaggtgaggccacctgccccactcccaggatctgtcttgggcttcaggttcttgcttgacatcaccatgatgattttgctaaactagcctttatggtaatgtgcaaggaggcagagctggactttcttgagcagttactttcagcagtgtattaccactcagtagctttgcttagaagacagtgggaatggtgaaaacaccaaaggaacaagcttttaaacaccctgaggccgggtgcggtgactcatgcctgtaatcccagcacctcggggaggccgaggcaggcggatcacctgaggtcaggagttcaagaccagcctggtcaacatggtgaaaccctgtctctatgaaaatacaaaaattagccaggcatgatggttgacgcctgtaatcccagctact

SEQ ID NO: 114239 - DNA, 1049 bp, Homo sapiens
ctatcattggctctgctcacccgtgtggcgtctctctttaggccgccatccagtcacagttggacggggtgcgcacaggcctcagccagctccacaacgccctgaatgacgtcaaagacatccagcagtcgctggcagacgtcagcaaggactggaggcagagcatcaacaccattgagagcctcaaggacgtcaaagacgccgtggtgcagcacagccagctcgccgcagccgtggagaacctcaagaacatcttctcaggtaccagccagacgccgaggcacttgcccccactcacgctgtctttgcatgactcactgagtgctctgtgtgcagtgtgctttgcagcccgcactgtagacctgtagacggtaagtgtgattcttgtctgctcagcgtctttttttgaacgtggatggaagtgatcagctgagcatgtaaaggctaggagaaggcttgtagttcagtgtcaggacagaggcccagaagcgggctgcccagcaaatgcagtgtggagggattccctggctgagtgtcgttcccttgcttgcgatgtggctgttagactctgtgagtgcagaagaatgaagacgccgtggcccatgcttaaaaggagctgcaggagaagccaccctgtgcatgggacagagcaagcagatcccagagcagaagggttgaggcgagcagcagctcccaggcaggaggagaagcgtgtgtgcacaggccagggcagaggcggggctgagcgccgtgggggagtgaccctttcagtcttctccctgaatgcctcagttagaaggatgccaagggccctgtaacctgtccctgaacggtgccagctggccctgggtggtggctcccagcatttgtgttcacagtctcctcctgcttgctgtgacaggagctgcttccacagcctcatccctccccttggtccccgctctgtgtcaaggtcagcagcatccttccagtccccaactcagaagccttggcagggtctgattccttccctttctttgttcctgtctctggcctcttggcaagttctt

SEQ ID NO: 114240 - DNA, 1044 bp, Homo sapiens
atttgggctaaaccaactgaacaggattattgcgaaagagaggccagggtgagcagacaccacctatgggatctggggatgaggaacctgagcagatactgagggtgggggttttggccgcactaaactggactttacaaggaagggcacagatggccgaggagaagattcaggagcctgagtaaagttgaattaaaccaagaatctgtgtcagtttctactccatatccaacaccaagaacttgaccgttattataattgttttcaaaataaaagattaaaatcttacaatttttctattcttagctgagcttcagtcattgtctattcctggaacttaccaagagaagatcacccacctgggacattctctgatgagtttaacaggtctgaaatctttggatctctcgcgcaactccttggttagtctggaggtaagttttaggtctctttcttaaaatttattgctatcaacatcagtggaaagtccattcacagcagaaacggagtctgttttgtaaccctctgcttacatctgtatacggtacactttgtgttgcgtatttttgtgtttaccgtgggctacatttcatacacatcacgttacgttgtgttgtcgccctctgatgacgatgattatatctttaaaggaaatgaaatgagaccccagagacttactgagtggcagtgcagtgggcctggggctgcctcctgggctcctggcagggtcaccctggagagagatgcctaggtggtggtgaggggagctgtgcacaactaccatggcctgattggccctgacagaaccgtgggatgcgcctgccctgagcccgatgcctgagcattatggaggctgcgtctgcatggcctgattggcccggacagaaccgtgggatgcgcctgccctgagcctggtgcctgagcattatggaggccacgtctgacaccagctcgggagtctgctccaagtcagatgcggacctagcccaggctacacccagtgctgcctcatctttccccgttcccaggcctcagctttctcat

SEQ ID NO: 114241 - DNA, 1440 bp, Homo sapiens
ataggcgcctgttttatagtgtttatttggccaattaaccaagtaactcataaacagttgagtttggctgtttcaggagctacagtccttattctaggtaatttttggagtcttcagttctaaatcattgcctctgtaatccaagttttagattcagaatcttagtgtttctgcagagaaggagcgcagccgtctcccctcttagtgtttctgtagagaaggagcgcggccgtctccctcttagtgtttctgcagagaaggagcgcgaccgtctccctcttagtgtttctgcagagagtttctgcagagaaggagcgcagccgtctccctcttagtgtttctgcagagaaggagcgcgaccgtctcccctcttagtgtttctacagagaaggagcacaaccgtctccccgcatgtgagagatgcttcctgcagtggcgctggcagtcagaggcgctgcgggaaccacggaggtgcggggccccgggacggcctgctgccctgcgtggtgcctcctggagtgggctcggtccttggctccgcgtgggtcatggaaaggccccggtggtggaggaggcagatagcaagggcctgcgtgtgggatggaggcggcgtctggagagaccttgccagcaggagagggtgggcttggggtgaaggtgagtttgcagttggcttcggacatgctgcattagaatttacacaacagtccagagaaatgttcttggagtacgggatttggaactgactcagaagggaagcgagtcttggtgggcagagagctatgcgtcgttagtgcggggctggtgaaggccggggtggaaaggttgcgggagggtgggattgggtgcaggtctcctggcgcacgtgtctcctgagggtgccctgtgtgctgggtggagagtgccccaggttgcagaggcctctgactcggcatctttgtgtgattatcagaactcctccgtttttctgctttgaacattatattatgctattactcactcatttcttacagtgattctgtagtttttggggcgtgctgtaggctaaatggaggcagcgtgggaacttgtcacagaattcacattacaaatgggggttaagatgtgttgtaagttccaaagcgccaaggttgaaggcctggggaccttcttatcttcagggatttacatgaggaagctccaggagttcttgggtgggagcctggtggccccaggtacgcacgtccctgaggcccagccctaagcacagacccaaaaggcctcctggaagttgcagcctctcgggccgggcaggctccctccgtggaggcttctctgggttacctgagtgtgacttgagaatcccaccccgcacccggtgtgcactttagagaaagggtgtgcgtgtgtgtgtgtgagcctcatctgtgtgcggctgctcccgtgcgcagcagtgagctc

SEQ ID NO: 114242 - DNA, 1028 bp, Homo sapiens
gaggcgtggactgtgaggcgtggactgtgaggggtgactgtgaggcgtggactgtgaggtgtgactgtgaggtgtgactgtgaggcgtggactgtgaggtgtgactgtgaggtgtgactgtgaggcgtggactgtgaggcgtggactgtgaggcgtggactgtgaggcgtggactgtgaggcgtggactgtgaggtgtggactgtgaggtgtgactgtgaggtgtgactgtgaggcgtggactgtgaggcgtggactgtgaggcgtggactgtgaggtgtgactgtgaggcgtggactgtgaggtgtgactgtgaggcgtggactgtgaggtgtgactgtgaggtgtggactgtgaggtgtgactgtgaggcgtggactgtgaggcgtggactgtgaggtgtgactgtgaggcgtggactgtgaggtgtgactgaggcgtggactgtgaggtgtgactgtgaggtgttactgtgaggcgtggactgtgaggtgtgactgtgaggcgtggactgtgaggtgtgactgaggcgtggactgtgaggtgtgactgtgaggcgtggactgtgaggtgtgactgtgaggtgtgactgtgaggtgtgactgtgaggcgtggactgtgaggtgtgactgtgaggtgtgactgaggcatggactgtgagttgtgaatgtgaggtgtggactgagagttgtggactgtgagatatgacctgtgtgcagtgtgaccaggggagagaggtgcatgagagatggtcgggcacggcggggcaacctggttcccctgggcggtagtccggcagctgtgcttcccccttcactgcagtgcgtgttcagttggaaacacggagatttcacctttactccctggctatagggggatggtgagaagggggctgggtgtgaggggatcttcaaggcagaatcttagtttgtcttttaagaattgtgtgccgggacgtggttggaggctgggtgcagaaaggaagaggcgagctgctggaggaggcaaggacaggtcgctctgggcagt

SEQ ID NO: 114243 - DNA, 2002 bp, Homo sapiens
gttcctccccctcccctccccctttcattccctcttcctttcccccgacctcccattcccgctccctcccccactcctcaggctgaggctgccacacttacctgggttcgaccacagtctggtcataggcgtagccaggctctgccccttacaggataaaggccacagacccccatggggcccatcacaggtgtaagttacagaggggaagggtcctgaaagatgagactgggccaagaggagatgcagcggagcagaaggaaggggactgtggcggccgcgggtgcagtgcccagtcgtgggcagggccatgtgactccctggaacctggtgggcctgtctgtggcaggtcaaggtacagttgggggtcattctccttgagcactgtggcctggatgtggacaaggcagggtgcacagctcccaaacatggtggcattgggcttctgcccccaggattcatgctggcttcatccagtcctggcctgcggctcctttgctgtccaagtgaacagggcctgggcctgcacagtggccctgtcagtggggtgcccatctctgtggctaatgtgaccgaggtcagtgggccctgccttgtctaatacttgtaatgccctgagtgtcctcaggtcatcgctgactgggtgattagggcaatttggaggtgacaaagtgggtaaaatgtaatagcactttacttctaaaataaaaatggtcaacagcattaaagactaggactcttctattgcactattatgatgtcaaaattattatatttgactgggaattagaactatttcagtccccgtatattttctagaattagaacattgttttgctagccatgaagtttatcatcttctcataaaaccatgcgtagctggaatagccaaggcgccattcagtcactcattagcctgttcagctcattcattcattccataggtgctgagccgcacctccaaggctgctcccaggggtcaggacagtggttgggaaggaggaggcaggtgggcggtagccagtgggacacagaaggtgatggggccacagagataggtctgtgtgcagggccagggcaccttcgtgcccatgcagggaggtgggcaggcccagcaggtgagggccacaccgctggagaggacggaagtgccaagcagccgcttccctgttgttctgcagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaagttaactttttcagtggctgtatacaaattataactgagtttgtcattgagttttttatagaacaagctgtgcaccatgataggtgagtgggaataattaagttcaaagacttaacacaagtgacacttatagatgtgggggaaaaaaccttaaaaatattgtcttatgatattaacatatcacagcggaaacatctacccaagccctggctcgctctcttgtttgcagtgtagttctgaaaattatgtcataat

SEQ ID NO: 114244 - DNA, 1045 bp, Homo sapiens
ctcccggggccaccacagccccgcccagctgcgccgggagctgggggtcctaggacctgctggggccccggctctgcctgtgtgtgttggggtcctaggtggaggtgtcccccacacaggaacatggttaggaggggctgccgcccccggacacttggcagcatgggcgcaggcccacgcctcagatgccctggctccaaaacccgccaggcggccccgctgtgcccttgcactgctctggcctcagaggtgcagagcccggtgggccggaggtgccatgagaagcttctggtcacacaacacgccacatctaaacacagtccacgccttacaacatcctcccaccacaggccattcaggcaattttagagggttctaaactgactcttggtttttatataataattctaattagaaaacatttttctcctctgaccagatctaccacaactaacccaaagtggggtttttcagtgtttaaaacaagagatcctgtggatgaggctcagctctgcaaaaggcacctgcatttcaccagggaagcctctggacagcgcgagaaaggctgcacccagcaggccaagcattccgagggcactcccagctgcagaatccacagtgaccaagagtcaggggacaaatgacccataaaaccccagcaagcctttccagaagtcagtgagcagagggcctagaatagccaaaacgatttcaagaaatgagaacagagtcagaagactgactacccaactccaaagctcatcgaggcttgactgcaaagtggcagcgacgtgggcacgggcacgcggccagccccgcagcccagggggagtctggctcagccacatgcatgctgcccccccgatgtctacaggtgcagaggcaagccagagagaaaggactgtttcttccacaagtggagctggagcaactggtgatccctgtgcaaattaaaatgcactttggtctatactgcacactatatacaaaactaactcaaaatagatgacggtcctaattatgaaactaaaacttctagaagaac

SEQ ID NO: 114245 - DNA, 1028 bp, Homo sapiens
agcaattattgtcctgagcagagaggcctgtctggatgggcagtgtgctcctgcccttagggtagacgggccggctgagctcagccgacgtggggtcatgtcctgtttacacagggaaggtgaagaaggagctggaccctgacgacagccatttgaacttggatgagacgacgaagctcctgcaggacctgcacgaagcacaggcggagcgcggcggctctcggccgtcgtccaacctcagctccctgtccaacgcctccgagagggaccagcaccacctgggtgagatgcccccacccacgccgcatccccagagaccccagcacagtcagtgtgacgtctagacgaggtagtgggcagcattgtagttgtgggaaggctggaggctgcatgggcagcggtgctgttgtggaggtcggtttccacagatgtccttgggtcgcggcctcggtgcagagccggagcggagctgggatgctggcctggccgcacgctgggttacaggctttctgccagataccgtccccagttctgtccacccctgtgccctctgtggaccctggttccagtgtttctgctggggagagagcatggcttccttggccatgtgtcctggagtggttttggtgggtggggttttgttcccacttgtaaacactggatcactctgtcggcagagtgaatcttggcagttcttcagctgcagaggtttagctgcaaccatctgcaaaaaggccggtattttcgattccattgaccttgtgatcagggtgttaacagtgcatggagcaggctttggagggccgtaggtcaaagtctgaggcccccgatatcccagtatgactttgggaactgccctgaggtctgggctgtgtctgagggactcctggccaaggagcgttctctccttcagaagcagcatccgtgctgtgtgctgggtcagggcgacccctggctccagggtctctacacacagctctccttggcagggagtgagaggtgcccctgtgtcctgggagtccctgagc

SEQ ID NO: 114246 - DNA, 1048 bp, Homo sapiens
cccttgaaggaactcaagattttccttgatttccatgcttggagggctcgcaggcccctgaagagagggttgcagccaggcgggagtccccaagcagatttctgcagctctgaggagcagccccctctgcagagcctgccccaccagctcgtggttctgactctgagctctggtcaccctcccgtgtcgtggcctgcaggctccttccaggcaggaagctggcccccccaacacagcgttagaatcaggcattgctgtggggtagggaaagtgaccccctcacagcccggaaatgggaaggctctgtggtttcctctctgggttccagttagattcctttcgggaaagtgaacttggatatggagttgagtgaccccgagtgcacccccgcagtaaatgatgctcaggactaaagtgactgaaggcttttggggaaacagatgcgaacaaaacagcagtattcattttctaattaaaagcttgtgaaaatcgatgtcattgaatctgagaaacattatttcgaacaaagatcacacatgatagagtgcatatactacagcatcgctccaccggagcacaggacgggtgtgccacggaggccgacagttgtggaaggagacaatgcacggcccggcccacctgctgcaggcaccgccaggaggtgtctgcctccttcgctcctgcgcccacggcaggcccacctgccacaggcactgccaggaggtgtctgcctcctttgctcctgcacacacctgcccctgcaggactcgagctggtctcaggcaactggtcatattccaggtggaacccacgagacccttcttatcctaagcttcccataggatctaggcacatcttttttcttttgttttaagccacccaaggctgccgaaacagcatcggcgtcctctctctgtccgctccatctcgccctgtggagcgctgtccccggcacacaatcctggcgctgaggagggggctgggcgtggttgggtcagtgactggtgatgaagaaggtttggaggacccccagccttaatccattaag

SEQ ID NO: 114247 - DNA, 1047 bp, Homo sapiens
attgtattatattttattttttaagctgtttcatgtatatggccaagaatcaggatggtactaaaaggagtgccttggaagtgtcggcccacccctgccccacgcgcccattcctcaccggcaggcactgcccactggtgtgcttctgtccacacccacttgtgtttttaaacgcataacgagtggaaagataggagtattcttttacagatgataacatagcacacgtgtgtttctaggctgtgtgcatgtgtattcatgcttttctccctctccccactgagatctttttaacctttttgggtcatggaccactttgaaaatctaatgaaaactatcagccactccccacaaaatacccgctctgggagggtcacggggaccgaggagctgcgctggcacggcaggcttctgtgatcagggctgccgcgagggccaggcgacaagggctcctttcagcgtaccttctcccgcggcccctctagcctgcaggagtttgtgaaggatgctgggagctacagcaagaaagtggtggacgacctcctggaccagatcacaggcggagaccactctaggacgctcttccagctgaagcaggtgggctgcactcgcaccggggttggggggcaggtgcccttggggtgctgctggcgggaagagcctgcagcctgaccaggctttcggggacgaggagctgtcgcagggactctgctgccggctcctcgtcaggatctgcgtgcttctctgcacgggcaggtgtcccccggagaccgtgactgtgtgctcaccactcccagcgcactcgtaactctctatttccatcttcatctttcatctctgtcactttccttcatcctgaagagtttaaaaaaatatttcctgtagttcagatttactgacagtgatctctcagcattggcttctctgaaagtctttatttcatcttcatttttgaaattcattttccctgtgtatggaattttagatgaccttttttcccatctactgtaaaataggtttgacttgcattgttgctataaaaaagca

SEQ ID NO: 114248 - DNA, 1121 bp, Homo sapiens
attcgattctgtggagaaattctagagatagaggctatcactgtgccgcacgcctgccttcatcccttgacttgcacttgaaagaatcgggtcgttgcttctcgttcctgtttatgttctggagaaatgcaagaagcgcaggaaacgctttttcctcacacagcatttgtatgtgatgcttagaaagaagttacaggcttggccaactgtttgctgtaatatttttcatgcaagaccaatgtgcaactaagaaaacttctcttaagttcttaaacgttatgtttagatcagagagcccagttgaattgttttctactcgattgtagctttttccttttggtctcttggtagtcatctagagctttgctgttgtctgtggcatttcaaacctgataagtctttcctgttttcttttcaggcagatttcaagctgatgtgtgataatgcaatgacatacaataggccagataccgtgtactacaagttggcgaagaagatccttcacgcaggctttaagatgatgagcaaagtaagaaactcactggcagcagcgagctacggaaagcaggggctctgccccccgtcgcttgtgcccgaagggagcctcacagtgaacacgtgctccatccacccgccaccctcatggtgttgccccctttgctctagggtagacgtccccggccgccctctctgctcatgacctagctgtaacatctcattgagggttggtggaaagttccgcatctcttgatcttaagcctgggtgtcaggtgtcagtcttgctggatggcagccagcattgcgggcttgttttgcgtgactgcctcactgaatccagacgggacatccttgtcttccttggccatcctgagtggcttcccagatctgtgccgtgagccaggctgcatgcatcccacgtaggagaaggtaaaggggaggtgcggcacctgccgcgctctggcggtgggtcaagcccccacaaccacctcccgctgctccgccgtggaaagttagctcttaggccaggtgaggctgtgaccatccccatcccatcccatcgtcacggcaccctggctgtgagggagaggtaaatccctgctgctctgtcctttctgattcta

SEQ ID NO: 114249 - DNA, 1091 bp, Homo sapiens
ctgaaatacctatcacaataaattaaaagacgctcgtaacttttttatttttaagaaacaaaattcggtcagttgtatccaatttttggattgtaagagattttgtatcatttagaaatctagatttttccgctttaagatgtctttgctttcagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggtaagttactttcattgcccgaagtaatcgtggcatagttctgtgtattcatgtcttgtgaagacttcattcaccttagatcatttctagtttttgagctttcacaggtgtttctgtgttcggatgatgttttacagacacagcattaaggaaatgattggtcgtgaacgttttctctgtgctttggtctagaaactaggtcaggttgcacgctgttagaagtctgtttcttttctttctaagttactgcgctggcgtaaataggacatgttgtttcaagcagtgaggtgtccggtgtggcacggcttgagactagacatttttaaaaacatacttctttttaattcttagttttgtcttacactaattgagcatttagtttttttagcatagtaagtttttctgtctcctgagtactttgctcttagctctgtttcttgctactggctgtgagaattagcaactgctcattggttttgcaacccaggggaagaaagcaaaacaaatgcttgataaagttggcattagtgtagtttagaaaggcattagatttctctcttaggttccattcccctggggaaagcttgacttttctattttatgcttactgaagggtttgctgactcacagaaacacaacagaacagacttaaaggagagtgggagaaaaggaaactcgatgagaggatcaggcagcgcctgagggtagatgttaagagcactccatgcccgaaagccctctgtattccctgcttcgggccccagtctggccattcctagcaacaaagtgag

SEQ ID NO: 114250 - DNA, 1021 bp, Homo sapiens
gagactagggaagcatctgtgctggcttttgtgtggagctcagggagaagctgggctgccctttctcccgcctttccctccctctcccttgctcccgcagcagctccatgggtgtcagcgggcagcacgggcgcctgcaggaagtcaggcgagggtgaaccgaagtgctgggggtttctaggagggagatcgggctccggggttccaggtccctcttaatccatcttcttgaacgagtaatgtgaacaacatcccacagggcctctggtgaggacaccgtggctcgaaagggacctgaagctccctgcggaggggaagggagaacaaggaggcagtgacatgccgccactgtggtcttcccttccgtctttccctgctggttggcagccccgctgtactccttagggaggcctttccctcttagcaccttcacgtctcacctggctgcgtggcgtttgcacctgagcacgcgggtagaactcggtctgtgtctgtgcagattatgccgacaagcccctggagaagcctctaaagctagtcctgaaggtcggaggaagtgaagtgactgaactctcaggatccggccacgactccagttactatgatgacaggtcagaccatgagcgagagaggcacaaagaaaagaaaaagaagaagaagaagaagtccgagaaggagaagcatctggacgatgaggaaagaaggaagcgaaaggtaaaggagcagcggcggtggcccggacgctgcccacgaggagcccgtggggagcctggtcccaggacccaggcagagtgcgcctgcgtggctggaggaggggagggggtgttccgttggtagcaaaacgcgaaccgctgaggcccgcagactcagttccaggatcctgggtgtgctgttcctcagcagaccctgccagggtctctgtgaggagggagcctggcatgaggaggatctcggagggggtttcccttagttctgtccctcccctgagaactgcgaggggattgggcagacctgtccggat

SEQ ID NO: 114251 - DNA, 1070 bp, Homo sapiens
attgctacaaattaatgattaatattcatatataatcatatctaagatctatatctagtataattattcttattttatttattttattatactggaacagctcgtgccctcggtctcttgcctcggcacctgggtggcttgccgcccacatcatgctaggggacgcttggcaggcaggcgtgcaagaagagtgctggcctctgcctcttctagtatggggtatgagcccactgagaattgtcttaggaaagagggtggttctgggggcaacaggaataacacatgacccctccacctccatttatcaagaaaggtgtgtttgatctctgaaaggtgccttgatgagtggatttcataaaggaagagtggggacaaggacaggtgtcagcaaagatgtaggctagaaaatgcaatgttcattcccgacgctaagtgagactgtaggccgagaagctgggagcagtgctgggggtggggaggcgatggaggctgagaccagaaatacgaagttgagtacaaataagaaagagggggagacgtaagtgtattggtaatatttcatagcatttaagtttctaagcagacttcattgtagtaataacattaatagcttttaactgtattccttatattttatggataatggaagttactgttgttttaagaaatttgttgtagcactgacttaaaaatatatttgcttggatctttgtcacaggtcctcctggcactggaaaaacatccctgtgtaaagcgttagcccagaaattgacaattagactttcaagcaggtaactttcggtaatctgtgagaggagagccatgggaatgggatttataacgggaggttgtttttttttttttctaaatcattttacgcaaataatagattcctctccactgtaagtcacttgattcctctgtattcagcatagttttgagttatgatttcagtcttttaagatttgagacttacttgattgccagcacatgatctctgctggtgaattgcacttcagaagactatactttctccccttgctggatgcagtgttcgtctctaattacgg

SEQ ID NO: 114252 - DNA, 1049 bp, Homo sapiens
ccatcctggctaacacggtgaaaccccgtctccactaaaaatacaaaaaattagccgggcacggtggcgggcgcctgtagtcccggctacttgggaggctgaggcaggagaatggtgtgaaccggcgaggcggagcttgcagtgagccgagatagcaccactgcactccagcctgggcgaaagagcgagactctgtctcaaaaaaaaaaaaaaaggaaagtgagatccttgccaaggttgaaggcagtgagggaatgagcgaagtggggctgtagaattcccagaaggccaaggagcagcgagagcaaaggctggggggtctgcgtggcctgtgttggcacaaggccactttccttcctgttggcagcctgctggccatcgtcctgccaacctccttgccagatagggcaggatagaattgggtcaccgacagccgtgatgactgtggtgcttgcttctcggccacaacaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaaggtacctttattttttttttcctcttgatacaaatggatttcttatatgttcttaattaattaagatagcttaaaataagctcgttccagtacggaggatttcaacatatgcattaactcccttcttaaattgaaaactagttttgtatgtgacaggttgagctgatagttgaaactagggccactgactcaatatttttgttcttttggcacaatacagtcatcattgttcattatttgaggtaccagtcagtgtaggggacgtcagtgaccggctgtgtttacctggctggctgcacaaaccttagttctcagcttaccccgggcttttccaatgccctgcctctcgggggcctgtatccttacctgaaagaggaaacatcacgggcgtagtatgggcctggttttggtcacggggtccacat

SEQ ID NO: 114253 - DNA, 1054 bp, Homo sapiens
gaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaactttaagcctg

SEQ ID NO: 114254 - DNA, 1845 bp, Homo sapiens
gggcagagccctaagcgttacctttatgtgtttggagtctctgtgagcctgtgtttgtggatgggggtggctctgtataaaggggacctgtgaattttcaagttagccctgggctggaggatgtgtgagatgctggcccagcctaagtcactgccacgcgtgtatgcctcagtggcaccagtcctacctgtggcgcgtggcaggtcagcacttggcttacctgtgggtctgtgggagggtgctgggaggccagcaagcagggccaccttcggatggctgctgaagccaagagaggcacccacaccccctcagtgggaaggcaggcccagagcatcgtcccagctcaggctcgacgtgcacctgtctgcaggtgctgagcccggacagtcccacactcctatcctggggacgcagcttgcaagtgctggagaataacggaataattgtgctccagaaaccagaggactgttcatccatcctgcccagaggctgcggggagggggccgcctgttgacacactcagtgcacaggtggcctgtgtggcctgtgggctcagtgctaggattctggagtggagggccggagggactgtgtctatggggagggggcccaatgatgacacagggagcatctcctggaggcccaggctatgttcccctatctgtgctcctcggagtctgctgcacccccagctctgaggtggtggttgcagttgggggccaccgtgggctggtgagaggagggcacacccggctgtggctggccgggatagggcctccctcccctccgcaggggtcccaagatcgggctctcagctcaggcccgtctggacaggatcatggtgtggtgaggggagagcagcgagggtccccaatggcgggccacatcctccatgtgccctctgccagccccttcgcctcctcttgtccccctagtggcactccccgctgagaaagctgagggccgcgagcacccgggacaactcctcagcgcagatgacggagagagggcagcaaaccgcgagggcccgcgaggaccgggcgggcagcgcctcaacattgacgtgggtctctctccggcctcacttgcgggaacacgtccctggggccgggggctcagggacaggcatgtgttgccctaaactgggcatctgtggacacggcgtagttcactcagtcttccccacagttcaccccgtttaaggcattgaagcagaacttgaatgtgcaagccaaagtcagcaggagccagagagtgcaggatgttgctgtgaatttggccaaaactgactggtctggcatcaaataacttgagccgcattcccagccttggtgcccttggcactacaggagtaatgccaaagctgacttgacggacagcccgactctctgcccgctggaggcagggcacagggcttccgtttcccgggagggctcagggaggactggggtctccgtgtccagtcaagatttctggaattgacaacacttgacggccagtgtgtcctcttctccttctgggtgacgtggagtgcttgcatgagctgagataggtgtcactgtgggggaaccgaatcacagggcacaaagctgggtccccccaagaagggctggagctgggcaagaaggggtctgctggttcagggcttgagctccagccacgctgccctctaggctccgcctttcctagctggcatgagggacccctgggaaaggccccagaagatccttccccctgtggagttgggcgtgttggcgtgggtaggaggcgaggtcccggcccccacgtccccccacaggcactccagtgcgatgtctcggtggaggaggacgaccgccaggagtg

SEQ ID NO: 114255 - DNA, 1941 bp, Homo sapiens
tgcatttctaccccatccagaacattcttggaagagcacccggagctgaagctgtccctgatgatgaaggtgaaacgtcagccctggccatggctccgctcagggccccggtcacctccgagtcactctgttccttgactgtctttgtgtttctgtacctcaaggcactgaagctggaggactctgtccatgcccgtgtcaccctcgtgtgggagcctctgggctcggcaggtccacatttcatgagctgaggcgtgggccagggccatctggaaagggaactcggcttttccagaacgtggtggatcatctgtcgggtgtgtggtgaacacgttcagttcatcagggcctacgctccgggaaggggcccccagctgtggctctgccatgccgggctgtgtttgcagctgtccgagtctccatccacctttagaaaaccagccacttcttttcataagcactgacagggcccagcccacagccacaggtgcgatcagtgcctcacgcaggcaaatgcactgaaacccaggggcacacgcgcgcagagtgaacagtgagttcccccgacagcccacgacagccaggactgccctccccaccccaccccaccccaggagcacggcacacagttcagcctctgagctggctcacacgtgccatccccaccccggtgctccagggaaggaggacacggacccgacgtgggaggtcctcaggcagcagtggcgcctggtgtcaggtctgtctggctgagtcccgggcgtcccctgccatggcctgtgccttgcatggaggcggcggtggcactgaagagatagctttcaagggcccaacactttgcacttcggctggctgtgagtttctgctttgtaggttgtggtcacatttgcaggctgcgggcagtggcaccgacttgggcctccctttctatgtggcatatttatttatttaaacaccccagggagttacgtggtaacaaggttgtccataaagaggttgcttctatatactagaggccccagatggccaggccttgggctacgtctggcttgcatggtctcccaagggaatcagccccatcaacaaagttcaaatcggggcagaggctgcacttgtgcccccagatgtttctgaggagccagactagggctggcattgctgtagagtgacggctgctgcccagagcgtgtcccagacatcacagcggggctcagcagttcccacagcctctgcctgccttggctaagcatgagttaagcagcaaaacgctcctccatgtctggatggggccggcaggtcctgtgtcccctgcacctggaggagagcaggctagaggcacagcggccacatggtgctggctctgaacgttggttggtggctggaaaacagccctgcttctgagggccgctcagttctgcacacgaaaccacctcctgagggctcagctctgcccccgccctgggctgcagcctctgcacgcaagcaccaggcatcctttgtgttgtcaactccgtgtaaccagtaactacagccatttacaattgactccgtttccttttgtaggtttccctgtctgtctgtgttagtagaaaaataaaatcctatgaaatctgagtacgttgaagaatctcttgagtctcattcagcatgaaagacagctggagaaaatgtactggccgccccttttctagcaggagcgtcagggctgaccagccacagccaactcaggtggctgaagagtgaccatatgaattggacgagggcttccaaatcatgtcatcggcttggaaatgaccttaccccaaacttcctagtgctgtgtgttgaagtgacccaatctctgtatttctgagacagtctctgttgcctaggctggaatgcagtggcgtcacctcagctcactgcaacctccgcctcccaggttcaagctattttcctgcc

SEQ ID NO: 114256 - DNA, 3357 bp, Homo sapiens
cagggcctggatgctggtacggccccacctgccccaagcctccctgagacggggacgcctgcgtgctggtcgtgtgggcgagcaggtggtctggggtgaacacgtgtgtggagccccgtcaggtgagggggagactctgccagcacgtgtcacctcctgtcagtacggggtcatggggcctttccagttcagggccagggcgggaaggtgagggggtgagcgtttggtcgggaagcctgggaggagggaggcagtcacgggggcggcgcaggaccagtgtgggacgccaggctgggtcccgggtcaggcacacagggcccttcaggttctgtgagctgccctcacctccggcctggcatcccgggtcgctctcgcccagaggagttttgagaccggctggtctcaccaagtcccgggcccgccaggcccagctgatccacgacaggaacaccgcgtcccacaccgcggcggcagccaggacccaagcgccgcctacgccagacaaggtgcagatgacctggaccagggagaagctgatcgctgagaagtacaggagcagagacaccagcctatctggtttcaaagacctcttcagcatgaagccgtgagtgtccgtgcgtgtggcctggggggaacagatcctggcagtgctggcccggcagtgaggacagagtcccttccctgaccactgaagagcttcggggcaaccctgcaggccagtgggcccgttagagaacagggagccgcctgagtgggcactgaggggtccttttggtgccaaggccgggccctgagttcagccctgtggccgggcgctgagggatccttctagtgccaaggccgggagtccttgtaagacctgggtgccaagtgctgaggggtccttctagtgccaagcgctgaggggtccttctagtgccaagcgctgaggggtccttgtaggacctagggtgggtcctgatgttaaccccacagctgggtgacgagcagtcctcctggtacctgggccagccctgaagtcagccctgcggccaggcctgctttactcaggcaagcctcactgcagcaggcagatgggtctgttccatggaggcgaggaggcttgtgccgctgggcacagaattcctggccttcaccctgtgggtagttcaggctgctgtcgggccttagggcctgccctacgccaaggctcccacctgtggccttgggctgcgaacaccagggctgtacagggtccttgcgggtgtgggtttggttctgcagacgcagcctctgagttccagatgagagcgcaagagacacctctcacccggggtcagagccagaccctaaagccaggttctcaggaagggctgggggctcctgggccctgtggggtgggatgaggcggcgtcctcctgggcagccatgcgatctggaacagcctggtgctctctcctgaagtcagtaacacactcttgtttttttctcctgcatagagaatggggaaacctgtaagtccactcgctacaaccaggtcgccttccgggcccggttgccctgcatgcctgtgtgtgtgtggcctgcgtgtgtctgtgcgcgtgttctaggcctgtgcctgccccgtgcacggtggcttgtgtgcgtccgcgtacagccagagctcacccagagctgctgcggctcccacgtcagtttcctgttgccttcgctcccctctgttcacggtggctccagcacacgcctgaagcctcttcctaagtgaggcccaggaactgagacctgggaggtgtccgagccgctccggagtggaggggaggcgtgcgcctcgcagggcccgtcagtgagtccatccacgtccttctgggtcaggcgctagctgagtcgcgttcccacctggaatgccttccatgttaaagctgtccagcctccaggcggagaggggtgcagatcagttctctgtgtggtcggaccctcggcaggagctacctgcgtctgagctccggggcaggtgggagggtgtaccctggacggacccccagggtgctccctgggagtcctcgatgccgtctctgtcccctgcctgcccccgccagtaaccgcctgggccatgttttccttgtgggcaggcagtgcctggtgcctgagtgaggaacgccttggctgagtggccacacttcccttccctttttatctttaaccccgaaacctgaattaatcagactcaagaaactgtgcagctatgtgcgaggcgtgcagggaatccctgtacttcctgctccgttctgtaaatctgaaagtgccttcagaatagcgtgttaattaaagccgaagaacgacgtagacccaggagtagggtttgacacacacatgcacaggcacacacactcggggaccctcagtggcacctgtgcctcctcccagcgccggggcttgcctccccttggtcggggcgggggcaggtccccacaggcctgtagggtcaggagaaggtgggccagaatggacaacgcgtgggctttgtattcatgtgtggcgtgcgtctgggatggcattgactctcttggcccagcagtttctcggggttgggctgggagaagccctccgaagatctggaggtcggccctgacctcttctgggcagtgcgggcgtgagatgtgcgtggcttactgtgacgtccccgggagcacacttaacggatgtctgtttgtgtgcgtgctcgcatgtacctgtcagcgcacctgccggtggacgtgtacctgcctgtgtgcacgtccacgtacgttagtgtgcatgtctgtgtgcacatactatgcatgtcttacatgttagtgtgtctgcacgcatttgcacattgtgactgcatgcctgtttgtacatgatagtgtatgcacttgtgtattagtgtgactatgcctgtgtgtgtacacatcagtgtgtctgcatgtatgtgtgtgtgcgtatacacattagtgtgcgtgtctgtgcctgtgtctgcactggtcctccttgctgtggcggccggcatactccaccagtagccaagggccaggtctccgcctcaccccagcactcactggctgtggacacgctgcccactccgacccccctgtgctcctggcctgctttcacttcctggagctgctctttgtccccaaacacactggtaattgtggtctatccagaagtcgaattcaaagttccaagttcctggcacgaaagccccttgactgtgctgtggacagagaccccatctgtaattagaccaggctggagagaagatagaaggtctctccctgtgttcctcctggaaattggtggttatgatcacgtttatgtggcttaagcgtcaagcggatcaaagggcgtgagcctgga

SEQ ID NO: 114257 - DNA, 1049 bp, Homo sapiens
ctctggctggtccttggaggagctgacggagtgagggtgggggctttgtggggacccccctcgcctcgccgtgcccgcccctgcactggctgtgagtccccggggaggccccttccgcaccctggcctcagatgacctgcggacggccgcctctctccgcagacaccgtccgcgacaccaccgccgcgcaccaggctctgctggtggccaagaacgtcgactcgtttccgcaaaaccaggagcgcttcggcgggggccacatcgacgtgtggtggatcgtgcacgacggcggcatgctcatgctgctgcccttcctgctgcgccagcacaaggtggggcgtgcgacggggacacgccagccggagcacggccaccccacgtgctgcgggccgggacgggctcctctgaggccccacagccatgccctccctgtctgcaggtgtggaggaagtgccggatgcgtatcttcaccgtggcccaggtggacgacaacagcatccagatgaagaaggacctgcagatgttcttgtaccacttgcgcatcagcgccgaggtggaggtggtggagatggtgagtcccgagggcttgaggggaggaggccggggggaggtggggaggaggtggggggcggcccgggagggctgtgggcctcgtgaggtgggggtggagggggaagtggagatcgggagggctgtggcctcgtgaggtgggggtggagggggaagtggagatcgggagggctgtggcctcgtgaggtgggggtggagggggagatcaggaggtggaggtggaggtggggaggagaaggtggtggcgattgtggcgggggctgccaggccttgcggggtggtcaaggaggcttggttttggaatcgccaggacatcacagaaagcacagagccccgtgtgttgcttgtggacacctcgtgtaacacgggtgtgggtgttgccctagagccggcatcagcatctccgtgtcctccatggtcccgtgtcctcctcggcccgggaccccgtccaggacctcacacctcagtggtgttgccat

SEQ ID NO: 114258 - DNA, 1020 bp, Homo sapiens
agctgctaatttggcccattttcgggtgtttctgatgcaccaggtggatgaacctggcccagagcgtccgagtgaactgggggtgggtctgggatgttgtggatcgcctcagagaactgcctggcgttgtgtccccagagcagccctccacatcccctgcacgtggcatcagtcacacctgctctgtgtctctctccccagtgtgtgagcacgcacatacacacatacacacacagcggccgggagcaccgcagcacaccgttgagccttcgggccttccctcctgctgggtccacaggggaggtggtgcgggtgccctggccaccgtgggtggtgggcgtgggtctgtgcaccccattcctgctgtagcaccaacctgtcctgtctcccgcagaacatacggtccctaatgagcacagagaagaccaagggcttctgccagctggtggtctcgtccagcctgcgggatggcatgtcccacctgatccagtcggccggcctgggcggcctgaagcacaacacggtgctcatggcctggcccgcatcctggaagcaggaggacaaccccttctcctggaagaactttgtgggtaggcatggctggcggcccttcggcatcccctcaccgtcccctctgtgtcctctcagtgtcccctcgctgtcccctgtgtgtctcctcagtgtcccctcgctgtcctctcactgtccccttttcgtccccactgtccccttggtgtcccctctgcatcccctcgccgtcccctcactgtcccctgtgtgtctcctcagtgtccccttgctgtcccctcactgtccccctctgcctcccctcgctgtcccctcactgtcccgtgtcccctcagtctcctctgcatccctttgccatcccctcgctgtcccctaaccgtcccctcaccatctcttcgccgtcccctcactgtcccctcaccatctcctcgccgtcccctcgcggtcccctcaccatctcctcgccgtcccctcgctgtcccctcgccgtct

SEQ ID NO: 114259 - DNA, 1025 bp, Homo sapiens
cgggggcctcaggtgtgtgccccgggccattgtcccctcaggggcctcggcgggggcctcgggtgtgccccgggccattgtcccctcagggcctcggtgggggcttcaggtgtgtgtcctgggccattgtctcacctgtctagcatgtcacctgtcccacctgtctaacctacctgttctcctgtcctgcctggctagtgcccacctgtccatcggccctgcctgtcccacctggcttctgtggcctgtctcacctgtcacctgttcaacttaccccacgtgtgtcacgtttccccatcccatctgtcacctgccccttttgtcccctgtcccgcctgtcatgtatctcccgtcccacctgtgtcgtgtgccccgcccgtcccatctgccctgcctgttgatgggccgtgccctggtaagcgttgccgtggtaacagccgccccaccctggctgcaggccccaggtgctggtgatgctgaacctggacgcggagcaggccgtgaagcacccccgcctgctgtccttcacgtcgcagctgaaggccggcaagggcctgaccatcgtgggctcggtgctggaggggacgtacctggacaagcacatggaggctcagcgggccgaggaggtgggccgggcggggtctgggggccaggcctctttcccaccccagctgcacaggaaacgtgccctggcatgtcctcatcgcagcgtgtcaacacggtgctgtgcgtggcgctgctgtgttttagccgtggcggtggctttgagctcagagcagcgcgctaaggcctgggagcaccagccgcaccccgggaagcttgggaggtgtgagggccattagctttccaagggcgaaccctgggaccgcctcctcccgccatgggtgagccccgtccagagccgtaatcatggttctgctgcaagctcagtctcccgctgttcaggctcactgggggctgcataagtgtgatgcccgtgtgctgggggctcactgggggctgcataagtgtgatgcccgtgtgct

SEQ ID NO: 114260 - DNA, 1016 bp, Homo sapiens
cgtccttgactgttcctttgcggagtaagcccctgcgcagctgatgagactgcacctgaggaaggcctctggttacgaggatgcccaggtgtctgcatgtgccttgtacctcccgtggtcagcccagccttcccaggcttggggcgtagcccatcagggctgtgggtcttcttaactcccctccccaggaatcaggcgctgggtggacgcttcagccccttgttgcatgcacagccgaggtgctgtgtgcacgctgggagctggagctatgtactgggttttggagtgacagctcccacaggggcccagggagccacgtcacccctcagaggtggttgagtacagccatggtcgtcaggcgtcagtgactgttttcctagtgttaacagagagttttactgagggaggggcagtgtccgtgtggtggtggctgaggtgtgggggctgcatggcgttgggccgccccgagccacttgccccgcccccaggaccctgtcctttctgggtatgagcctgtgcctggcgctgatgttcatctgctcctggtactacgcgctgtccgccatgctcatcgctggctgcatctacaagtacatcgagtaccgcgggtaagcgctgtcagccccccttacagacccggcgcacgggagggcgggcccctctcatgctatgcctggggcagctccctggaggggcctccctggggcttgagcgtcgtgtgccctcacaggggcagctgggagcacgtccaggtgggctgtgttgtgaaagctggggtttccctcccacttccagccaggccgaggtgcctgcacttgtggacagggtctccagcctggagctctgtctcgtgccgtcctcagcaggcggtgagcccacggctgactattcctgctacgtgtctcgcgaggtgtccccaggttgtgtctgtactcactcggcagccacaggcgtccttccccgtgccccagcacccaccctccctccacctgcacccgcctcgtgcccggggtcca

SEQ ID NO: 114261 - DNA, 1395 bp, Homo sapiens
ccgctggccagtgcatctccccacccaccccaccccaccccaccccaccccccgtacctgaggaccctgcacccacggacctgcctttccttgacgagggctgtggatctctcctgcattgtgctgtttggggcctgcattgaaggcgtggtcttacgagataagtacgtttccacctgcagttttcgtgcaaagcctgtagtcttcaagggttttcctgaggatgaattcggctttgaaattacatcgccctaggacttcatgtccgcgtgcagagctgaaggcgtcctggtcccagggttgggatcccttggtctgatgtgtcgtctcttccgctggagcctagggcctggggaaccgttcagagccaactccaagccctgatgcggctgggggcgcaggcccttcctggggaggccacaggggtgtggacgggtgaggcttggccctgggagatccctcagccctgctggcaagtggagaagtagtggggtcccaggcaggtcatcactgaccctgcatcctcatggggtgtgcgtgtctggcagccccaaggccccgggggtcctgggtggtccctgactgaagctgatgccaggctgggtcttccctgctcccaagagcgaccctgaggtgagcaggaccccctcccccgctgaagaccctccagagcattctggccatgctgggcagagcctggtggaggtttcagccaacggggactggaggccgggcctcagctttccaaggagtcgcccccactgcactgggcccctcgctctgggtgggagaagacattttgtctgactcaggctcacttctgaaagccgcccgcccgcctgcccgcctgcctgcaggttcggggaggccctgcaggggaacctggtcatcggcatgctggcctggccctccccctgggtcatcgtcatcggctccttcttctccacctgcggtgccggcctgcagagcctcacgggggcaccgcgcctactgcaggccattgcccgtgacggcatcgtccccttcctgcaggtgagtcccgcaccctcgtcggggggaccctggaaggtcagggtcgggggctctcctcccctgcgggatcctcacagtgccgtgtgtgggacgcatgcccgcggcttggaccccatggtggtcattctgcccctggccactgcacagagcatgggagtggtgggaggtgggtggtgggcagaggcaattctagccctcctgcctgcaggtccctccgagctcggccccgggtgtgtcaggagcggctgtgagggcccacagccacgtgtccagaggtgcctggtctgttgtctggtcagaagccctctgcctgcctgccacatctttctctgtgtggctgagctcttcagcccgtgggaggtg

SEQ ID NO: 114262 - DNA, 1060 bp, Homo sapiens
aaacatccccggccgtggctccctagagcaaggtggtgccacagcgggaggggtcgcagcgtctgctggcctggctggctgggctgagtcgttctaggatctcattcccaaagtccttaggtcctgggggcctgtgagccattgctcagcaccgtctctgggctgacccttggccatgggattaacacaggctccagagaagccctgggtgtggggggcgtgggggtcagtgacggggtcggttctcgtcctcggatccaggggagcagtagacgtgggtgctcatccgcgtgcctgggcccgcatcccctcagccgcagtattgcagcgtgggctggcggagcttggactgcagcctcggctgcagctcacgctcggggtctccccagagaccgcctttccagctttctgggcaggggctgccatcacatggcactgactcctcagatgggtctttgcagcattttccatgttcacaggtatcatggcgggttcaaaccggtccggggacctcaaggatgcacagaagtccatccccacggggaccatcctggccatagtgacgacgtctttcatctgtatccttggaggggtgcaggcgagggttccagcctctgcctggggggaggcccccatgccctccccggctcagcatcataccctcggccaccagcatgtgacttcccaggttaggctgtgctctcaccacgtcatcctccctgggagacggggcaagggctgctgtcaggaccctggcttcttcaccactgtgtgatgcgatcgtagagaaaacagaagcagtcaccctgccgcgtgtggacagtgatgcgcagcggtgtgtggggtgtgccgccggcaggctgggcccgcggggcctctggcttctcaatcccaaggctgcctctttccagccgagcattgtcccctcagcatggtcccctgccaatccctggcggtcaagcaccaggccaggtgtgtgtccaccaccccagggccccgttctgtggcgctggacagagccccaggagggtgcgctgaggacacgggggacaggacgtgc

SEQ ID NO: 114263 - DNA, 1687 bp, Homo sapiens
caggctttccagaaccctagagaggaagcccggactttccagaacccgagacgggaagcccggactttccagaacctgagacgggaagcccggacttccccagaacccgagacggggaagcccggactttccagaaccctagagaggaagcccaggctttccagaacccaagatgggaagcccaggctttccagaacccgagacgggaagcctggactttccagaacccgagacgggaagcccaggctttccaggagtatgttgttccccacatgaggcttctctttagtgctgaccttccctccgtagacgcagacaggcagctttcccagaggtaccatctcgaaagcgtgtttgaattggagcctgcttgcggcgcacaagctgtgacccttcccctccggccaccagtggcacctgccggggagtgggcggccccatggcgggggcactgcacagaaggtgccagaaacccatgggatcttccttgcccggcagagaacctgtggagtacgtacgcgcacgcgggggcgtttgtggagaagaaaggtgtgccctcggtgcccgtggcagaggagagccgtgccagcgcactgccctacgtgctcaccgacatcgcggcctccttcaccctgctggttggcatctacttcccttccgtgaccggtgagcccgctgctccaggcttccccttctctttctttctctccctctcttttttgaggcaaggtcttgctctgtcacccaggctggagggcagtggtgtgatcacggctcactgcagcctcaactcctagacacaaatattcctcccacctgagtctcccaagcagctgggaccccaggcacccagtaccacgcccggctaatatctgtattttttgtagaggggggcagccgggaccccaggcacacggtaccacgcccggttaatgtctgtattttttgtagacgggggtctccccacgttgctcaggctggtctcaaactcctgagctcaagccatcctcagcctcccaaagtgctgggattacagacgtcttgagccaccacgcctggcttccttctttctcttcctttgtctttgtccatttctctgtctctgtcattctctcctccggcactctttctctctccccctacccttttccctctctctctgtctgtctctctctctctctctgtctccctcttcttccctccctccctctctctctctctgtctgtctgtctgtctctctctctgtctctctctctgtagtgtgttccttcctgcccctgcttatcttgcctgtttggctcaggggaagtggctgaggtctctgccctgcgtcctgatggatttgtgagaagcctgtctgctgctctcccaggcagccctgtgtcaggagaagctgttgtagggttgctgggaacacctggcaggctgttaggagacacctaggagtggcctcagtgtgagctcagaggccggggacctcggccctctgtgtcctcctcaaacagtgggccttgttccggcggtgggtggggcccttggttgttccccagggggtggggccaggccccgtgctcttcgagtcgcacacacacgcccccggctgtctccactcggccttcttgtcgggacgcccctgacaggcgctggctgcttgtgcagcctgcagctgcccttctggtcccttct

SEQ ID NO: 114264 - DNA, 1073 bp, Homo sapiens
agaggttgccccccgccggcgtggtcagaccctgtgtgtgtccaggacgtccagccggggtgggccgagctctctgggcagcagtcacattcctcttagcagaaggtgtttcttttgagtgcggacatgcggatgccccgggtcctgaagttgctttactctaaggctcccgggtggttcctgggaaacgttcaggcccctggctgtccatggcctgtgcgctgacccccgcgggctccgtccctcgcctgtgcgctgacccccgcgggctccgtccctcgcctgtgcgctgacccccgcgggctccgtcccttgcctgtgcgctgacccccgcgggctccgtccagcacggatgcgtcccgatggccccggcacctgttgggaggaggcccctgtgtggcgctgggggcttgcgggagggacgggcactggggagttgtgtccggggacggcctcccgaccggccttgttcccacagacgtacatctccccgggtgcggccatcttccaggcggaggctgcaggtggcgaggcggccgccatgctgcacaacatgcgtgtgtacggcacgtgcacgctcgtgctcatggccctggtggtcttcgtgggcgtcaagtatgtcaacaagctggcgctggtcttcctggcctgcgtcgtgctgtccatcctggccatctatgccggcgtcatcaagtctgccttcgaccccccggacatcccgtgagtctcggggcctctgagccgtgggtgggtgtggggctggggccaggtcccatgggctctgcccgcctctcgtccatcatccttgacgccgagctccccgcaaggggtgggctgggtgtgaccgtggcgggaacccccgtgggctcgttctggggattacaggaaacccaacggtgaggtgggccgaggtaccctcgtggccgggtctgagcatgaagaccctcctcagtggcaggagggctggtgaggggtctggcaggtttcaggggtggccggtggccctgagcacggtcaggtgcagtgagcgtcatgggtgtggccctggctgctgctggggcctgggtgtcttc

SEQ ID NO: 114265 - DNA, 1050 bp, Homo sapiens
agtgatagcgtgcgtggttcacagtacacgagacgactcctgaacatcctagtttctcttttgcctttttcataagcaaaacttagtggaagtgggggctggggctgccactgatgtacgcgggactttttctgggacctgctggggcctcctgctccccagagagccttatccctgatctcacctggtcctcatgtccatgagagcgcgtgctcttggtgtggaacgtgtgccgagcctcgggaggggagagttcaccgtggaagcgtctccatgtgctgctttgcgggtggacgagggtctacacgctgccttcgcagagacaggccctcctttgcccgtgaatggcagcgcagaccgcacctcgggtccgagtccaagtgcgcccctgacccgcggctgccgcctttgtctccgcagctggcgggtcctactacatgatatcgcgctcgctgggacccgagtttggaggcgctgtcggcctctgcttctacctgggcacgacgtttgcaggggccatgtatattttggggaccatcgagatttttctggtaagtgtgctgctttggaagggttcccaccccacagtctgtggcaggatgccaaggggccctgcctgacccactctgtggcacacacagcacactgagccatcctgaccccactgccctggctgcccctgggctctcctgggctctggccatggcggaagccactgggcagcgtccactcagcagcgacctgtgtcccccttgagcaccattgctgccctccgtgaggcgtgcctggcatgagctgggtagacatctggactgtagatctgagccccgcgtaggtgcagtcctgcagtcggagctgttttaggagcagggctggaactcggcttagaagaaccttttgccaggatcccagcctcttctctgcctgatctgggcacttggccgagggtcccagagcccagcaatgtacaaccaggtgatgtcatcaccttctcaaaacaggcatgctcaaagcatgtcccacatcacctgagcacagctgagagctgtg

SEQ ID NO: 114266 - DNA, 1045 bp, Homo sapiens
ttgtgctggcaccagccgtcctccaggtctgagccacgtgcctctgctcatggcgggagtggggctgagcaggcagtggggatggagctgaaacttctaccccagcctggcccgtcccgagtggagctggggagctgcctggcaggcgctggcctgctcctggctgtgctgctgacccttgcccatgtgggttttctcagggcacagggtgtgtccccctctctggcacaggtgtctgaagcaggctgcctgctccgtgctggggcaggcggggtggcccccacgtggatatctgaacctttgctgttatctcgtggtgacctccgtgcccggttaagatgtgtcagtttctgcccagggccgacgctgagctgtggattttttttttttttttttttagctttatgggcagcagccgtctcatccctccgctggctctgcttccattcctgaagtctcaggctctcccagggtgtcagatctcaggccctgagccatccagggaacggagccgggggccctctcgttctccctcttgttttttccataacttttccagtgtaacaggtttccctccgtcggggaggcacagcggagcagctgcatcttggttctctgccaaccatgtggttctgctcccctcccctaagccctcattccgggatggtcaggggtcctgtcctgggcctctctctgaacctccatctgttctgggaaggactcctgccccctcctgcccccacggccgctttgcctgcccagggcctgagtgcagcctggggagggggctccctctgggtgtggggtacgagcccctgggacacgctatgctctgtcgcaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtgtgagtctcccccggccaggtgtggctgtgccttcgggcggtggcagctggacagta

SEQ ID NO: 114267 - DNA, 1042 bp, Homo sapiens
cgctctccccttgggcggtgtctttttgaggaaacagttgtggggaggagagtgctgcttctgaatcacgtgtggacctggggtggtttgtttcctgcgttctggggttttcttgggcagcaccccacacgcaccccacacgcaccccccggtgggcctcggctctgtggggagtggtcctggggtccgggatgagagtgggccccgcccaggcctgtgttgacccctggagtcagattgccatccactgtagtggttacagtggctctgggaagtttgggggctgggacctgagcccaaggctggccatggatagccgcacgcagcatgcccgtgtgcttggttggcatgcctggtttgtgtgtctgccatggcctggagctgtcctcatggtggggtagccccgctggccctcccagcgttcctgtccatttaagtcccgtgcacaggggatgtccaccttgcagacgtgcagccgggaggaggttgttaaagtgatccttgaacatttgctctgtgcctcagtttcccttggcaggagccagcctgtcacgagggtggcggtggctgtgacctctcatctccttggctctgtctgcagacctctggcgccagcgggtcgggcctgggctttcagggaggctcagagacgccctgggcagtcactggggagggattgagtggagtggaaatcggaggagggaagtgcgccaggccaggcccctcctgggtcccctccatgccgccaagggtccccgaccgcagcccagaggcagcctgtaacaggagccgccctgggagggcctggcaggtgcgctgggggccctgcctctcccgccttccttcatctctgctcctgcaggctgcctgggccccgagtctctggaactaggggaccccacggcccctccatggctcagacgtcactctggctgctgagggaggaggctggaccaggaccagcaaacagccacgtgacagagggttcgggaagtgagttcacccgaggccaccttcccgcgagcaggcgtgtcctttagat

SEQ ID NO: 114268 - DNA, 1050 bp, Homo sapiens
agcagaagggcgtgcaggaggggcagggggctggagcaggagtggggggtcggggaaggggacaagaggggaggcggggagggggccggggagggcggggagggcggggagttccagcaggaggggcagggggctggagcaggagggggtgcaggagactgagcggggattcgcgggctctgcgatggtcgggagcgcaggcagcgaaagccccgcgtcccgggtcgcggcggtcagacagacgcagcctgggttggggtccctgcaggaagtcgccgcgggccaacttttcgtggggccgcggggcaagcaggtgaagtcacgtggcccgggcggggcggggcggctcggtcggaccccgcccctgcctccaagtcccgtggcgtcggcgggagcggcgcagcgcgggccgggccgggacggggactgtcggctgcaggcggccatgcccaccaacttcaccgtggtgcccgtggaggctcacgccgacggcggcggggacgagactgccgagcggacggaggctccgggcacccccgagggccccgagcccgagcgccccagcccgggtgagcgcggccgcacctggccggacaaaggccgagcgccccgagcgcgggtctgggcccggcatccgggagcggaggcgggcggcggggccgggggtacaggaggcgccccttcccgcgcccccaccgcctgttctcggtcccccacgagggcccccaccccacgttagtggcagcgctagggggcgaggggccctgccagggctcccggtacggtcagctcgggtgggaccgggggcagaggtgtggacgccgctgctggtagccatggaaacggggaggggctggagcgcgcctccggagggagcccgggcccctgggtggtccctagtgggacaggggtggcggtggagacccgggcggttcgggagccggggcgtcctgcgtcccccgcgctctcccttcccctgcgccgcggccgtccggtaacactagcccgggccggcccgtcctgcccccgcctgaccctggaggagccgcc

SEQ ID NO: 114269 - DNA, 1026 bp, Homo sapiens
aggtccacacgtcctgatcggaagaaacaagtgcccagctctggccggggcaggccacatttgtggctcatgccctctcctctgccggcaggtctctaccttgacagacctccagccgtacatgcgacagttcgtggctcacctgcaggagaccagcccgctgagggatgccgtcgtcatcgagcaggtctgggcactgccctgcagggttgggcacggactcccagcagtgggtcctcccctgggcaatcactgggctcatgaccggacagactgttggccctggggggcagtggggggaatgagctgtgatgggggcatgatgagctgtgtgccttggcgaaatctgagctgggccatgccaggctgcgacagctgctgcattcaggcacctgctcacgtttgactgcgcggcctctctccagttccgcagtgcctttgttcatgatttgctaaatgtcttctctgccagttttgatcttgaggccaaaggaaaggtgtccccctcctttaggagggcaggccatgtttgagccgtgtcctgcccagctggcccctcagtgctgggtctgaggccaaaggaaacgtgtcccccttcttaggaggacgggccgtgtttgagccacgccccgctgagcgggcctctcagtgctgggtctgtccacgtggccctgtggccctttgcagatgtggtctgtccacgtggccctgtggctctttgcagatgcctgttagcacttgctcggctctaggggacagtcgtgtccaccgcatgaggctcagagacctctgggcgaatttccttggctcccagggtgggggtggaggtggcctgggctgctgggacccagaccctgtgcccggcagctgggcagcaactcctggatcacatatgccatccgggccacggtgggctgtgtgggtgtgagcccagctggacccacaggtggcccagaggagacattctgtgtcacacactctgcctaagcccatgtgtgtctgcagagactcggcccggccagccca

SEQ ID NO: 114270 - DNA, 1006 bp, Homo sapiens
actctgtcacccaggctggagtgtaatggcacaatctcggctcactgcaacctctgcctcctcggttcaagcagttctcattcctcaacctcatgagtagctgggattacaggcgcccaccaccacgcctggctaatttttgtatttttagtagagataggctttcaccatgttggccaggctggtctcaaactcctgacctcaagtgatctgcccgccttggcctcccacagtgctgggattacaggtgcaagccaccgtgcccggcataccttgatcttttaaaatgaagtctgaaacattgctacccttgtcctgagcaataagacccttagtgtattttagctctggccaccccccagcctgtgtgctgttttccctgctgacttagttctatctcaggcatcttgacacccccacaagctaagcattattaatattgttttccgtgttgagtgtttctgtagctttgcccccgccctgcttttcctcctttgttccccgtctgtcttctgtctcaggcccgccgtctggggtccccttccttgtcctttgcgtggttcttctgtcttgttattgctggtaaaccccagctttacctgtgctggcctccatggcatctagcgacgtccggggacctctgcttatgatgcacagatgaagatgtggagactcacgaggagggcggtcatcttggcccgtgagtgtctggagcaccacgtggccagcgttccttagccagtgagtgacagcaacgtccgctcggcctgggttcagcctggaaaaccccaggcatgtcggggtctggtggctccgcggtgtcgagtttgaaatcgcgcaaacctgcggtgtggcgccagctctgacggtgctgcctggcgggggagtgtctgcttcctcccttctgcttgggaaccaggacaaaggatgaggctccgagccgttgtcgcccaacaggagcatgacgtgagccatgtggataattttaaaatttctaggctgggcg

SEQ ID NO: 114271 - DNA, 1061 bp, Homo sapiens
ttacctgcaccctgtgttttgatgtgaagtaatctcaacatcagccactttcaagtgttcttaaaatacttcaaagtgttaatacttcttttaagtattcttattctgtgatttttttctttgtgcacgctgtgttttgacgtgaaatcattttgatatcagtgacttttaagtattctttagcttattctgtgatttctttgagcagtgagttatttgaacactgtttatgttcaagatatgtagagtatcaagatacgtagagtattttaagttatcattttattattgatttctaactcagttgtgtagtggtctgtataataccaattatttgaagtttgcggagccttgctttgtgatctagtgtgtgcatggtttccagaactgtccattgtaaatttgacatcctgtcaatagtgggcatgcatgttcactatatccagcttattaaggtccagtgcaaagcttctgtctccttctagatgcatgaaattccaagaaggaggccatagtccctcacctgggggatgggtctgttcatttcttctcgtttggtagcatttatgtgaggcattgttaggtgcatgcacgtggtagaatttttatcttcctgatgagtgaatcttttggagacttctatgtctctagtaatctagtaattctttttttaaattgctcttagtactgccacactgggcttcttttgattagtattttcctgctgtgtctgttttctgcctttaatttatatatatatatatatattttttttttttgagacagagtcttggtctgtcgcccagggtgagtgcagtggtgtgatcacaggtcagtgtaacttttaccttctggcctgagccgtcctctcacctcagcctcctgaatagctggaactgcagacacgcaccgctacacctggctaatttttaaattttttctggagacagggtcttgctgtgttgcccaggctggtctcaaactcttggactcaagggatccatctacctcggcttcccaaagtgctgaattacaggcatgagccaccatgtctggcctaa

SEQ ID NO: 114272 - DNA, 1010 bp, Homo sapiens
aggtggggacgagaaccccctcttcctgggggtgggaggtaagggttttgcaggtgcacgtggtcagccaatatgcaggtttgtgtttaagatttaattgtgtgttgacggccaggtgcggtggctcacgccggtaatcccagcactttgggaagctgaggcaggtggatcacctgaggtcaggagtttgagaccagcctgaccaacatggtgaaaccctatctgtactaaaaatacaaaaattagctgggcatggtggtgtgtgcctgtaatcccagctacttgggaggctgaggcaggagaatcacttgaacccaggaggcggaggctgcagtgagctgagattgtgccattgtactccagcctgggcgacaagagtgaaactctgtctttaaaaaaaaaaagtgttcgttgattgtgccaggacagggtagagggagggagataagactgttctccagcacagatcctggtcccatctttaggtatgaagagggccacatgggagcagaggacagcagatggctccacctgctgaggaagggacagtgtttgtgggtgttcaggggatggtgctgctgggccctgccgtgtccccaccctgtttttctggatttgatgttgaggaacctccgctccagcccccttttggctcccagtgctcccaggccctaccgtggcagctagaagaagtcccgatttcaccccctccccacaaactcccaagacatgtaagacttccggccatgcagacaaggagggtgaccttcttggggctcttttttttctttttttctttttatggtggcaaaagtcatataacatgagattggcactcctaacaccgttttctgtgtacagtgcagaattgctaactcggcggtgtttacagcaggttgcttgaaatgctgcgtcttgcgtgactggaagtccctacccatcgaacggcagctgcctcacacctgctgcggctcaggtggaccacgccgagtcagataagcgtcatgcaa

SEQ ID NO: 114273 - DNA, 1039 bp, Homo sapiens
gtgctcatttgtgtcattgcaggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcattccgcatggactctgggatcaaaggctctttcctcttttgtttgagagttggttgttttaaagcttaatgtatgtttctattttaaaataaatttttctggctgtggcatttttcttgacctggtataatgaaagtatttcggatatttgagtttaacccttttccagaaagtaatacatgatatggatttatttatgcattaaaagagcaaatttaaagagccctttgcaagcctttgagtcatgagtgttcttagatacgtagcatcttagttgtttaagactaaactattgtacagagccatgacccatcaggtcaagcttatcttgccctaggttgaggcagagagagagaaatggaatagaaagatgggtggagaactgctggactcggtgtgtagtgaagtttaatgtttgttgaagttagtttttgtggggtttgttgttctcagctcacagcagcctccacctcccatgttcacacaatcttcttgcctcagcctcctgagtagctgcgactacaagtgtgcaccaccaca

SEQ ID NO: 114274 - DNA, 1540 bp, Homo sapiens
atatcactgtgttgaatttcacaacagtttggcacttacagcgaatctgagaggaaaaccgaggagtacgatactcaggtaagtcacttgtgattcagggcacgtgcatgccaggcaaatccaacaccctcaaagacgggtcttttactgtcattgctcagtgcggaagtctccttggagtacgggtcagcccgccttgagcagggatcccaagagtgaacacataaaacccaaatttcttactgggaagggcgggggctcgcagagactcatttcccagtccttacaggcacagcctgcctgtgtcaccgtatagtagggatattttcatcgtttgtaagtcacattcgccaggcagctgacgcaggccatggtgtctgctgtggttgctgggaacgcacttgccgtcaccaaggccataatggccgcggccgcacagtggcctggaggaatggccccagcagcacagggcgtcacctttccccattgctgttgggggagctggaattctcagttccagttaatagaacatttctgcacagatgattttagtttggtttaatcttcaccagcttatatccaacttgcatggcgttgtaaagctgaaatcagaatggatacagctggcgatgtaactacattacttagtaggcagttttttccggtttctttccattatgtttattgatctgttgtgggttggttggttttgaccaaccagaattgatctattattgttaactagcgcctgtagttacacccgggctctggcgtgtgcggtgcctcctggggctgtggcgagtgtgcgatgccctgcctgtgcccctcacgccgccccctgcagagcagccctgccaccctgagcgctgtagctcgttctgtctgtccctgtcggggtgagctccatgcagtgtgtttacagaggcttggcgtttgggcctctaactggaagccatctttgttccctgcaggccatgaagtacttgtcatacctgctgtaccctctctgtgtcgggggtgctgtctattcactcctgaatatcaaatataagaggtaggaggccgcacacgcttcccctgctgcgtctttcccctgagaaagccatttggatgactgagccagagcggggtgcgactggagggcaaactcggggccggggcacttgggccagcgcctgggaggggtcctgcccctgcagctgcacacggtgggctctgggcctcagtgtccccctggtaaggtgtagctgagaggactgactccagccaccaggcttcatgggaggcttgggcctgagctgagaggggtcctggagcccctggcctctgctgcccgtgtggggtgctggccctgagctgagagggttcccggagcccccggcctctgctgcctgggtggggtgttggccctgagccgagaggggtcctggagcctccagcctctgctgcccgggtggggtgctggccctgagccaagagggatcccggagcccccagcctctgttgcccaggtgggctgctggccctgagccaagaggga

SEQ ID NO: 114275 - DNA, 1048 bp, Homo sapiens
ggatctgcttcccctgcttgccctcagggcttgcaggaggaggaagacgtgttgaataagctggagtggttcttaaggtacagctggggaggaaacaaatccagacttgaaaagccacgcacttatcacagaactggcataagacacgcccggaagcaaagctgtgctggccccgtcatccgacctctgcccacgttccatgctcatttgcaagtgtggctcagacacgtgtttgtggagctggtgtggggccagctgttcagttcagcagccttccaaacactttcctagctgctgaatgcttcattgttctttttaaacggggtgacgtggactggggagtacctgaagcttcttgggcgtggtgggttgggatgggggactgggggtatgtgtgtgacttggggaacacaggtggggtctgccctgcaccccctcccagcccgaccatcctgtccccagtgctctggcgctgcttcagcaccgtggtcatctttctgttcctgctggacgagcagacgagcctgctggtgctggtcccggcgggtgttggagccgccattgaggtgagttccgggcagtgacctgaactgtctgaggtccatgtgcctccacgcactcaggaaaggctttcagccccgggacctgagaccttctgtggaagcctgtgtgcttgttcccgatggcctcagtgttctggaagctgtaggatggcaggcagtgggtgtaaaggctttgaacaagtggagagcaaggaaatgcgtgttcgggtggtatcagctcatgaggctctgtccaccaagcagtggtgagtcctgaggccctgtccaccaagcagatagtcctgaggctctgtccaccaagcagtggtgagtcctgaggccctgtccaccaagcagagagtcctgaggccctgtccaccaagcagagagtcctgaggctctgtccaccaagcagagagtcctgaggctctgtccaccaagcagagagtcctgaggccctgtccaccaagcagagagtcctgaggccctgtccaccaagcagagag

SEQ ID NO: 114276 - DNA, 1020 bp, Homo sapiens
ataatatgtgaaatgccatgagtttggtcaaatgaaccttaactgttgatgagatttatttttattgtttgtttgtttgtttgtttgtttgttttgagacagagtctcgctctgttgcccaggctggagtgcagtggcacaatctctggttactgcagcctccgccccccggattcaagcgattctcgttcctcagtccccccagtagctaggattacaggcgcgtgcccccacgcccagctaatttttgtatttttagtagagatggagtttcaccatgtttaccaggctggtcttgaactcctgacttcaagtgatctgcctgcctgagattcccaaagtgctgggtttacaggcatgagccactgcgcccggcctaaatttttatattgaaaactgtatttgtaatgttaggtaagattgacattgcctgttttatattgtatgtttttttttccttgacagggttttcagagaaagatgctgatgaggtgaaaggaatttttgtagataccaacttatacttcctggcgctgaccttctttgtcgcagcgttccatgtgagtcatccaccggggggcttgccgcaggcacttggggggctccctgggccccgggcctcctgcaggggtcctggacctggggtttgtgggcgccgtccagccctgtggccctcaagtgtccactcccatcactcagcagccagcacgcctgacaccaggcgaccattgtcccagtgggcggtttctcccagttctgaaaagggagggaccataaagctccgtccacagccttggcgacttgggctgtgctggctttgggggcggttttgaaaaggatccagggtactctgagcagtgtccacaccaatgagatgaataggtgcaggcatctcactctcccctgcccaggccccgaccccatgcagagccaggggcggagctgggcagcctctagcagaaagtagttctcttgtataaattctaacacactgatttttaaatgtaaaaagtcagtcct

SEQ ID NO: 114277 - DNA, 1049 bp, Homo sapiens
tagcagagcaggtggattagagcacagccctcgctggatgttccagcacgtggagggtggcgggtcagggcttgaggcagggcaggtggattagagcacagccctcgctggatgttccagaacgtggagggtggtgctcaccgggtgtggtcactgcccacgtgctgtagggtgtgggctcgcgcttgtgaacccgttcctcaccctcctacctcggcaccctgggacctggcccacagcctgtgtgcgtgaggccccggcaggctgcaggactaagctcgtggttctgagacctacacatccaccctactgcccctgctagctttgcgttccagaagctttctgttgtccccacggccaccccctgctctgtgctttaggccctgaggcactttgcccatgtgctgcagggctgtgcttgtcccgtggtctccaactcttaggacaggccagggctctgcaggccaagctcagcgccgtatgctgcgccatggagtcctagcagctgggtggcaagcaccacctccggggcaccaggacttgtgcggcttaaaattgaaggggcacgtgcagcaaaacagaccaggcactgctagcgctgctgagctcacggggtcctggtgggggtgggaacctccctgtgctggaacgcagcacgctggggcctgaggcctgtggtgacagaaggagggaccgggggatgcttgctgggcccagtcatggctgacctggggccacacagggatgggaagggggatggcagggttggcgagggctgccaggcagctgggtgcaagggtatgagggcagggccctcagtgtggctttcttcatcaggtcataaaccgctccaccaccgagctgcccctcaccgtgtcctacgacaaggtctcactggggcggctgcgcttctggatccacatgcaggacgccgtgtactccctgcagcagttcggtatgtgccgcacacggccggcgcctgggtgaggccgccctggagcccctcgggcatccaagtgcgaatcctgacacaggccggggcctcctcg

SEQ ID NO: 114278 - DNA, 1022 bp, Homo sapiens
ccacattaaatttctgaggttccagtagtgtgggccgaggcacctggagccctcgtggctgctgcccttcccttctgtcgcttcggagttgggtgattcagtgtgtgtggtcagctggtaccctggccaggcccagaagctgctttccatctggctgcttcagccttgtggcctcaggtgggttattgacctctcagcctcctgagatggaggcaggaagtgcgggccgttttgctttcggctgtaggcgcccacacctgtgccgagttctcaggacgcgcacgcgtgcgcgtgcacacacacacacacacacacacacacacacgactcgtaaagccctgggcaggtgggtttcatttttagtacttctgagctaaaattagtttattgaagcagctttataaaggtatttgaataggttctagagacccagaatataatatgtatgtagtggaaatgattgttctgtttcaggacagttaatgtttctgtaccaaagaaaacgagaaacaatgggacgctgtatgcctacatcttcctccatcacgctggggtcctgccgtggcacgacgggaagcaggtgcacctggtcagtcctctgaccacctacatggtccccaagccagaagaaatcaacctgctcaccggggagtctgatacacaggtgagggtcttcatgggttactgataacaggctgtgcctctccgtcagaacggacatgtctttctccacacaggtgggcgatgtctagggctccagtgactttgttgggagtaaagccaaaagccattggaatgttactggcgtgcatttctgactttcagctgaatcatatccatgagtttgcagacaagttttatctaaaattagggacagttgaagtgatcgctggcattctcgatgcagagtccctcggggaatgggccctctcagtctctgggggcacctactgcacctggtgggatggagcgctggtcctgcagagctggcctgcagcttctcaccaggagctctggggatg

SEQ ID NO: 114279 - DNA, 1030 bp, Homo sapiens
cgggcgggcggggctcgcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcaggtgagcgtccgcggggccgggggccgggcgggttggggtgggggcctctcctccaggccccagacgtcgccttcccgtcccagttcggagctgtggccgcgcgagtcgagatggaacctttcctggttccccagcggccaggtcttccgccctccagctggccgtgggatttgagtgcgtcctgccagggcctggccgagctgactctcgacgccccctcctttccagctgagcgtgtacaccacgacgaggtcccacctgggtgctgagaacaacatcgacctggtcttgaatgtggaagactttgatgtggagtccaaatttgaaaggtatgggcgtaggacaaaatgccagtgaaagggaaaacattactcatgttcagattgtttaaaagttagctttctgtacataacatgtttattttagagaactagtcttaccgaatgtcttgaagtggtagaatatcctaactggaggcctatgcgtggcctgtaaacattcagcctggaaggtgacaggtgatgaatgtcgtttaagaagtagttctcagcagagtgtgatggcagtgggatgtcctggacggggaggctccgaaggagcaggggccacgcttggtgaaccagtggagagcagacaactctgcagtttcactaccggggaccaacttgtcttttcctggtggaagtagttcgcttaagttacttgtgagggaaaagagatgaggatagaggaagcaattttgtagaaaatcataaataagtgacatgtgacgttagaatagatcaatgtccaaatatgtagagtat

SEQ ID NO: 114280 - DNA, 1076 bp, Homo sapiens
gcctcaatgatcctggatgactcttatggatcctgagtggctgtggtggggatggatgaccatatgtggctgggggtgaccttggtgtccctgggggtctctgggtgcataagggtggccctggatactcgccatagctctgggtgaccttgctggctctggatgtctctcagagacaccctgaaagtccttgtgtaggagtgcatggttttggggagtgggcagcttcttctctgtggtcacagtgtgaaatctggtctcaggcctttcacgggccttccctgcatgtttgaagatgctgtctggcatcagggctgtccaggagttgtgggctcagggtaatgtctcccgtgaggggaggtggaagggacacgttgctgatggtggctctgtgctccacctgcgtgggctccatggcctcccccttcccgctaggtgtgggcttcacggtcatcctcatctcactgtatgtcggcttcttctacaacgtcatcatcgcctgggcgctgcactatctcttctcctccttcaccacggagctcccctggatccactgcaacaactcctggaacagccccaactgctcggatgcccatcctggtgactccagtggagacagctcgggcctcaacgacacttttgggaccacacctgctgccgagtactttgagtaagtgggagtcgggtcctcgggaacgggagagatggcgcagccaggtcccccatggtagccccttggttggacaccagcccttgctgactcccagggtgcggggagggggaatctgttcctgcactccatccctttagtgctctggaggggcacatttctgaatcactgtggtggtctccaggagctcagcaaagctcctgtagggcgagccctcagcaaggatggggcactgagcagctcccttggctgctcccagcggcagctcagggtgggagggggctgatggggaacacagcagaccctgtgcagaaggtgggcaagctccagtctctgggagctgcagtggcgcctctggagtgagtcagccccatgtctgggctcccttcctccctacccttcctct

SEQ ID NO: 114281 - DNA, 2621 bp, Homo sapiens
gaggacacccagcctgccccggttgtcagggtgacttcgtgcgctgcaaagaaagtaagcgcaagttcttctctccaccctgaaagcatccgtttcacagacgattctaaccctccctggagggcgtgaggtggacacccaccagggccgtgggaaaagagcctccaaatcctagacatttgctcgtccccattccataaccacaggtgcctttgtctttccagctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgcggatcccccgcctggcctggaccccgtggggtcaggttccctgccgggcggggggcaccggtgccgccccgtgttctcccacggggccctggtttcgagtctctgtcacagcctcttccggcggcagcgtgcaccgggcgggcctccgtgcacactcagcacacgcctgccacacagcgtgcgcttgcgtgtcactctggcacgaaacctgtctgcctctgtggatccacagcctggcagagccgagccgtcacctgatttttcagtgtttctacctgtgtgctggagctcatgagtattttataaactccatttaggtacttcaggaaacatgcagcattttttaaaaaatgaaaattgtttttctacttcatttttccttttagagtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgctgccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggatgtttgttcctcctgattctcttttctcttcgtggcgacttagagttggcggatattcggaactgtgaatgtacatagcgttgagttaaaccccttgtgtgtgagacaggacgcagcgggcccctggtggcctgggggccagacccgtgggcaggtggggcatgggccctggcctgcggggacctgctggggtgtgagggcagagggagggttgccatgaaggaacttgggattttcaatggaataagtaaaacataaagtc

SEQ ID NO: 114282 - DNA, 1033 bp, Homo sapiens
gcagaaagagggttggggcactgggctgtcggaggcgtgagtgtggccctgggagcagctccaaatgtctcccatgtcaactcctgcggcaaaggcatggtgatcctggttctgaggttgggaactctggatccaggctggaggggtggcatgactcagggcctgtgctgcctggggacagcgaggagggacaggtgtggagggacaggtgtgggctgtacgaggtctcctgagctggagaacaagcaggagatggtgtcttgctagacgaaccaaggacataagcaggtgttgaatcggaaaagcagcatttccacccacggctgtacgtcacactggggctcgggctgggtgggcacggcaccccctccgtgggagcgttgactgcccagtagcgccctctggagggcgcgtctggaggtttcaccccagaattgggagtaatttacttgttaacccgagttgtaaatctgctcaacattgtgcaatctgtttttaaggctggaaatcctgtggctcacgctgtgtcagtttcacaaccaagtggaaatcgaggttcgtatggatacagagttacacagcgctcttcacagtggttgatgcagacacgagcttacaccaggatgcccagataagccttgtacaatgtggcatatcacctgtcttgctttcccatctttccgtttctcagggctccttcgaggagcctctggttgctttacctcaatgactttatgtctctcttatgagtctgaaccacttggataagatttgggtttttgttttttgtttttctgagacagcattttgtcttgctctgttgcccaggctggagtgtagcgatgggctcactgcagcctcgacctcctgggcccaagtgatctccctgcctcagcctcccacgtaattggaccacaggcacacgccatgcctagctaatttttgtagagatgggtctcactttgttgcctaggctggtctcaaactcctgggctcaagcagtcctcccgccttggcctcctaaagtgcgggg

SEQ ID NO: 114283 - DNA, 1044 bp, Homo sapiens
ctcagccctgcctggcgggagccgtgcattccacgtgatccgtctcccctcctctcttccagctctgatccagtatatacggcctgtgttcgtgtcccggtcagaccaggattctcgcaggaaaacagtagaagaaatcaagagacgggcgcagtccaacggaaagtggccacaggtaatgcacgtagccctgattgtgtttcagtggttttattccgaaagatgcgaacttcgcgagtggggagaaagaaactggggcccttcctccggggctggattctgattctcttctcctagtgagtgcgtgaactcaggagggtgctgtcaggtgcatttggtttcggtgcccgaaatttaaagttaaagtaaagaaaaacaattctcaaatgcatctcagcttcctgaatcatcttttctgaactaagttctgactcagatagagcattgctcacccgccctcctggtgcagtgtgattttggagttgatgtgtcagcctgctgtgtgttgggtggttctaaaagtcctggagtaaacttcctggtctgtatgctggttcccaggcattcagaagccctgaacccagctgtaggggcagcctggctgacattagcttggacgctgtttttcttctttccagctgagccatcattagaagctggaaattttacagaactgtctgggatctgattgctcacgaagctttgcagggtctggctgggggcagccccttagagggctgtgacttccagggtgccccagctctgcccccacaagcacaggcagtctcctcccccacccatttggcctgcctggccctgggcttgccagggtgagcccacgccggcccccctgaggtctgtcttcctcacggggcccagaactgaaagcagcctgcggggctgggagtttgagggcagtttttgctactgcaggccagtgtgagtcagaggaattgaaaccccggtgtggagggtgctgcctgactggggctcggctctcctgctcatccagcccgttgctggggtcccagccctccttcggct

SEQ ID NO: 114284 - DNA, 1127 bp, Homo sapiens
ccgcctcctctgttctgtctcaggaggcaggagccccgtgcgagcacaggctctcacttttcaaaatagatggcttggggcaattttccgtttccccatgctaaccctggtggcttttcttgtctgtgaataattgacttggcttcaacaggcgataaatggaccacaacggactcttattctagcagctgtacttcagagacgctttcatatgtacatctcatgcacgtgtgaagtgtcccgtgacagtgacacgttggggtttctgtcacctctgcttcatgagatctttgggcatctgggtctgtggagactcactgtgtatcattctgtgtatgtgtgcagagagggtgtgtatgtgtgtacatatgcgcatgtgagtgtgcatacatatgtatgtgcatgcacgggagtaggtacacgtgcataggcatgtggttgcattactgtgtgtatgtgagccaccagtgcaagtatgtatatgagtgtgtacatgtgtatatgtgtgtgctgtgtacctgtgtgtgttgcatgtgtgtacatgtgagtgcatgtatatatgtgtggatggatgtctgtatcgtgtgcacatacatgtacgtgtatgacagtatgtacatgtgtatgagtgttgtgtctctgtgtacatgtatgtgtgtatatgtgcaagtgtacgtgtgtacaggtgtccacatatgtatgatgtatgtacatatgtgtatgagagtatatgtgtgtacatatgtatgagtgtgtgtgtgcatgtgagtatatatgagagcgatgtctgtgtatgtgtgtgaatgtgtgcatgtgtgggagtatgcacggatgcttgtgggcactcaagctgcccgtgctgcctggcattgaatcccacccctggagcccctggcgtctccttcagcagcactgatgaaagctcccttggtgcacagtcctgggcttggcttggtgcttgaagggaaacagaagagagaacaaaccctgaattctgaactccccaaggggaaacctagtcacaaaagcaccgtagttagggacgtaagggatcaggaggaaactgaatttgaagtagcagattcagagtgtaccgctgaataataattacgtagtcggtttgggac

SEQ ID NO: 114285 - DNA, 1017 bp, Homo sapiens
tgaaaaagtggccactcaggagccctgcttcaggagccgggcacgggactcgactaccacacttgctgggtgtctggcccatgcccggtgcctcctgtgcctgcaggggcagagcgcccttgagtgctgggagggcccaggcagcggagaacgtggctccctgtcccactccgtctcaccgctcttgtctgagaaggcgccctgtgctgtactgcttggacatgactggttgggagtgtccaagctaggcttccacgaggtcacctgtcttgctaagccatgtccctgcctctgacacagagactgcaggaggagccctcctgaccttcctcttcctgtttccagggccctcatccccacgcggcccatgacaaaagtgctatggttctcaggatggccaggagccgcgaccgtcccctccaagtcctgtgggcctcctgtgggtgctggggcatgcttaccattcccggttactgtttccagcatttccagtgtaaacctttaatctagctgtgaatcattctgaaaatgagcccaggaaaaaagcatgatgctaggcttgtgtttggaaataacattattttctaatgtgatcactgtttgtccctgtgaaacccacgtcattttgcaaccctgggggatactttttgctgtattaaaaccaatgcatccctggcttctcagccatgtgccagcagcatgagcttaggtgtgttaaaggtgaggtgctgttcttgaacttccagcacagtcagctcccagcttccctcagtgtggtctttcctctgctgtgactggtggccctctaacctcatcccctgtgccctcgtcccctgtgtggggagacactgctggggtgggggctggtacctggggacagcagccttttccaaaccttgattttactcttgaatttcacacttccctcttagagccagaggagtgagttatttcctcttaaagatatttgccacatacaagcttaaaaaaaaaaaaggaaagaaagaaaacagtttc

SEQ ID NO: 114286 - DNA, 1079 bp, Homo sapiens
cgagaggctcctggtcccgagattgaaggctttgggcagctgttctcccttgggccgaagccaggcagagatcctggcttgaggtgttggggcctctcagagagggggcttgctttgttgccacttcagaggttccatctgaggaattaggtgtgtttgtacatccagtcgtttctgctggatgtctgcaatgtgtggctcaagggtttagtttgtaaacgttctcaaagttctctgcagaaacattttgcttttcaccaagcattgctttgcaaagcttttactttgatgtgatatattcttgtaaagtttccacagagtgaaatagcctgtctttcaagccaagaaagccttcttccccaaagaaagaaatgggtccagtagtggctgacacactcaagaacccgcagaaacccagctaagttcccagttgagataaaccagtgagtacctgcatttacctgtgagcatttgccgcctgggaggggctgctgtgtgtcttcggattagcgccatgcggggacacctcctcctccagccagcccatctgtcatttaactacagatttagtgaggagcttaagtatctctttggacagaaaacagcacattaagatctgaaaagaggtatcaaagccatcagggtctgtaatacgtgcaatgttttaatcctctggctaaagcaaggatatagatttagtagagagcggtaaatggtatggtacaggatcttagtgagttcagctgaggttcttcatagtcacacattcatatatcgttttggagtcatgaagtggtttctgtcacccagggttttctcggtactttccttggaatctgtgggtatgagtatttcccactatggttctgatgcgttttccccatttcttttttttttctttttctttttctttttttttttttttttttgagacagtctctctctgtcgcccaggctggagtgcagaggtgcgatatcggctcactacaagctctgcttcccgggttcacgccattctcctgcctcagcctcccgagtagctgggactacaggcgcccgccacaatgcccggctaattt

SEQ ID NO: 114287 - DNA, 1049 bp, Homo sapiens
attttagataaatctattccatcggtatcatgtttactgaggtggataactgcatggaggttctgtgagagaatgttcttatgaaacgcacatgggagcctgtgacagacaggcccgagcaatacaaatgtcctcaggtgggacagaacgatgtggtggggagaagagggcgtggcagagcccacggggcacgtgtcagcatttgctgggtccacggggacagaagggaaaggctctgtgctgctgggattcttgcagtgcctctccgcgtttggaactttattccagtgaaaagtagatgtgtgtgtaggccctgaatttaataaggtctacaatgataatagttaaatgaagcatgcaccatagattcgtgctgatggtacatgaatttgtgtgtggtgggttaaattgtatgtagttagcaagtttgtgtatttgtttacgtaagtctttcttcttgttccaggtgaatgaaaactttgccattgatttgatagcagagcagcccgtgagcgaggtggagactcgggtgatagcgtgcgatggcggcgggggagctcttggccacccaaaagtgtatataaacttggtgcgtagctggccacctgtgcacatgttagggcagcctgctcgtcctcatactccccttcactcccagtgcctgttctttctgtcctcttctctacctgctcccgaggcggcccttacggggttcacactgctggcacattcaccctacagcgccacactacagggcctacatagagccgcctgtccgaaaaccccctttcaactgtgaagtggtgggcggcatgtttctcttctcggacgcccaagcgtctttcctctctgggcccttctcggtttggtcatcatctcagctcaggctgccacacacagcaccgcaggctggggtcgaaaacaacaaacacatttcccacagcgctggaggctgcagcccaagaccaccgtgccgctctgtgggttcctcctggggcctcgctccggggcttgcagatgaggtctcctccctgtgtcttcacagggcc

SEQ ID NO: 114288 - DNA, 1023 bp, Homo sapiens
agtgattatgtcgtgatggtgaggaggtggaggatctggaagtgattatgtcgtgatggtgacgaggtggaggatctggaagtgattaggtcgtgatggtcaggaggtggaggatctgggaagtgattaggtcgtgatcgtgagtaggtggaggatccgggaagtgcttaggtcgtgatggtgaggaggtggaggacctgggaagtgattaggtcgtgatggtgaggaggtggaggatctgggaagtgattaggtcgtgatggtgaggaggtggaggatctggaagtgattaggtcgtgatggtgaggaggtggaggatctggaagtgattaggtcgtgatggtgaggaggtggaggatctggaagtgattaggtcgtgatggtgagtaggtggaggatccgggaagtgattaggtcgtgacggtgaggaggtggaggatccgggaagtgattaggtcgtgatggtgaggaggtggaggatccgggaagtgattaggtcgtgatggtgaggaggtggaggatctggaagtgattaggtcgtgatggtgaggaggtggaggatctggaagtgattaggtcgtgatggtgaggaggtggaggatctggaagtgattaggtcgtgatggtgaggaggtggaggatctggaaatgattaggtcatgatggtgaggaggtggaggctctggacgtgattaggtcgtgatggtgaggaggtggaggatctggaagtgattaggtcgtgatggtgaggaggtggaggatctggaattgattaggtcgttttggtgacaaggtggaggatctggaagtgattaggtcgtgatggtgaggaggtggaggatctggaagtgattaggtcgtgacggtgaggaggtggaggatctggaagtgattaggtcgtcagggtgcagccctcctgaatgggattagtgcccttaaaccagaggccccagaggcatccctggctccttccactatgaaccagaaagtgggacctcaccagactgcaagtctgctggatga

SEQ ID NO: 114289 - DNA, 1048 bp, Homo sapiens
ccattccctgctgctgctcactctctgccctttacggatcctcaacaccagcctcctgccccaaagcctccctttaccatgctgcctcgcacccaccaccagaatgtcttcccagagcgcagcacagctgcaccgttgccaaatcccagggcttttgggtgaactgctaccctgaagactgcaacccaaggctgctggacccccctggaaaaccccagttttgccagtttccttctgctccactctcctccttcatccctgctgggattccagtgggtgcattgctatcatctgaaaacacctcttccttctggggctttgcgtagactactagctgcatgggcccctcgtagaaaaccatctgctggaggcttgtgtagacagtcaggtgcaggaggcttgagtagacagtcaggtgcaggaggcttgtatagacagtcaggtgcaggaagcttgtgtagacagtcaggtgcaggaggcttgtgtacacaggtgtaagaggcttgtgtagacagctgcaggaggcttgtgtacacaggggtaagagccttgtgtagacagtcaggtgcaggaggcttgtatagacagtcaggtgtaagaggctgtgcagacagtcacagcaggtgttgtgttggctgcagggccccgatgcagacagctgcctgtctcagagtccctgggcctcctgactggaggaaagatctttgtgtttgggccagggaagcagctcatgtgtagaacaggggattctcggggtgtttcatgcaatctcagaatctctaaagtcaggctctcagtgagcatcctttgctctctctcctgcacaggagactcacatgaccctcttcacattctcagaccctcttcctgtgaatgctttttagctcaatctaagatgcagatagttataatttattttcaacatgtgcccttattaaggtacacatttaaatgatcctgaagtcttggaatgccataagctgatggaaagatttttaacgtgagaagcagaaggggatgtgactgagagaaggaggagaggagaagc

SEQ ID NO: 114290 - DNA, 1012 bp, Homo sapiens
agacgccccagggcagccggacgtctccgggcgcgccgccccccgccagcaagcccaagctgtggtcgctggccgagatcgccacgtcggacctcaagcagccgagcctgggcccgggctgcgggccaccggggctgcccgcggccgccgcgccggcctcaaccggggcaccgccaggaggctcgccctaccctgcctcgccgctgctgggccgccccctctactacacgtcgcccttctacggcaactacacaaactacgggaacttgaacgcggcgctgcagggccagggtctcctgcggtacaactctgcggccgcggcccccggcgaggccctgcacaccgcgccaaaggcggccagcgacgcgggcaaggcgggcgcgcacccgctcgagtcccactaccggtccccgggcggcggctacgagcccaagaaaggtaggcggcccgcggccggcggcgcccgggaggggagggagagccagccccggggaggcggagcgcccgggagacccgagggagggtccgggaagaagatccagggggccactcctgggacccagaattagcagagtgagggcggagggcgagatggaagccaaagaaggtgtggccctctttttagacttgccctgttattatttatttttacttaatttactgttattttgactattactatcgtggctgtcttagtttcggcaaacccagattgccacgaaattcaaattacagcgtgtcgccctaatgagcctgggtgtgtttcggtgtcttgttaaggagtcagagttgaatccgcttttctgccgttggctagaggcaaacagaacgttccagttactctcagaggcgttttgtcttcaaaagataaaatcaaatgttttttccgctttttgttgttgtcgttgttcggaaagaaaaccgttttttcccctgtgctatgttgcctgtgttgctcctaagtcaggctacccgaaagaggagttcaaggggggaagttaagaactaggga

SEQ ID NO: 114291 - DNA, 1049 bp, Homo sapiens
ctcatttcccacgactctcctagctgcctgatgtcgggggtctcttttaacttcctactatcgcggtttcagtgataaaacggaactcaccagcacctcattacctactctgcctagtgttctaggaactacagacattgtggtgaacaaaataggatctctcataagtaagatgcatatgtgtgaataaggcctcagaagattttaggtgttagaaaataaaggaggatgttggaatattggtcttgtctcttagctagagtagtcaggtagggaatttttgagtcagtaactttcagatatttgaataatgggaaggatcgggctgtcagaagagatgtgggaagagcttcctggatagagggattaacaggtggaaaggttcctttggtgagaaggagcagggtgtctttgatgagcagaacatggtatggttggcatgagcatagtgcacacggaagatggttgatgagaccagacgggagtgcaggctaggtaggccatgccgagaaacttggtttgcattttaagtgcaatatctgtgaactgattgcaaacattttaagtgttgaaggaaggggaggaaggaaatgtgctgcttttgtgagtagaaggagaactaacagatcattgccttcactgagctgcattgtgtaggtatcttataacgcccccccgcccccgccaccaccaccccaggaacgtgattggagttctcccgaatctttaatacattgtatttattattcgagccaattcactcaacaaacatttattgatcacctgccgtattttagacactgcaattatggcattaggggagaaaaagacaaaaattcttgatctcttggagcttccgttctaggagggtggcaggataaatgaaacaaatgagttatgttagagggtaatgaaaacgttgttgatgaattgaacagagatggggagggaatgaatgggtgaggactaggccagtggctgttggaatttaagtagggagtcctggaacgtttatattggagcaaaggtgagagaataataagctctgt

SEQ ID NO: 114292 - DNA, 1041 bp, Homo sapiens
ttgcatttcctgatatgaaaaaggtggaatacgttttttaaaaaatgtctattgactattccaaattcttaatctgtgaattgacagtttatatcctttacctttttcagtgtaaacctctgaaatgcataagtctggtccagcagtaccagtatttgggctttattctcaggaaaaatagaactgtttgacaaaggaatgggcaaggaaattcatggcatgctgtctgtaaagactggaaaaggacctaaacctccctcaacaacaatttgatagatggagtacatccaaaaatatattttatatatgtggtggcagttctgaaagttgaaagttaaaaacacgctgagtgatttttgacagatggtgagattacaagagaaactatgcatttgactttattttaatgtgtagatgttttaacagatatgtaacataactgagaagaaaaggcagacattatcataaagggaaatattactgtaactatcaaaatcatttggattatctggaaaactattgggataatcagtgaaaattgaacatagtttggataatttcaaattattacttggtgtaattattacttgtgaagggctattgtggttatgtttaaaagtaagtccttatttctgaagtatttagtgatggaaaaaggagacattaaaggaaagaagttaatgaaaagaaaaaattagctcattttaaaatcttaggaacatttcaacagtgtaactaaggatgtttttccttttgggttgatagcggtaatttagagccaaatttgtgtttttttttttttttgttttgtttttgttttttttttcgagatggaatctcactgtcactggagtgcaatggcacgatctcggctcactgcaacctccgcctctcaggttcaagtgattctcctgcctcagcctcctgagtagctaggattacaggtgcccaccaacacacctggctaaattttgtatttttagtagagacagggtttcaccatgttggtcaggctggtcttgaactcctgacctcaggtaa

SEQ ID NO: 114293 - DNA, 1050 bp, Homo sapiens
aacactagagtttctcctttggaggcctgcatggtactgattataattccccgtgagctttgggacttgaaccttttgttacaggttcacaggcctttaaaacaaagctcgtgggttagtaggaagttgtttttaccaaactggacttcttaaaaaatctgttttctgtcttcaaagccttcttagctttactgctggacctcaaacctcctaacagtattttatagccatggtgtgagatttcctattttttttgttttcagctttgtaatagtctcatgaatgtatgagccaagatactactcagatctaaaggtttctaaataaaaggcttgtatatcaacgtgatgcttttgagaaatttaaggtgatatagtcattaatttagcatgcatttgtttcaggaaatctaggaagtctagagggtgccttgcatggattgaaacataattttaacatagtatattttctaaattaaaaagtaacctaatttttcttttcttttttgcagtaatttgttaacagaatatcagaagaaatgtgatgatatccttttactggctttttctgttgagttttggaactaacttatgtttaattcctgaaagagatgtgagaattgttcctcataggccttctggaagatagtacttaacaggcttcagtagggagcatgtctcacaagcacagtaaacagacagtccttttattcttaatccatgtttaatgatgagttttaaaaatgagattacttttcttgttgattgtgattttcttaacgtctcataagctttttagtgggtgggtttctcttaatttgtactgaggatgtggcatgttttttaggtttacgaataatgtgaaactgaatgtgatacttgctgaatgttatttttgaatctgcaagaagtacagtatgggaaattcaaaatgttgggcaattgactttcattaattatttttgtgatttacagggaaatgtgtgtgtatatatatatctccaaaatcatagaaatagcgttgctgtatattcatgaacgctgtgggcag

SEQ ID NO: 114294 - DNA, 1029 bp, Homo sapiens
agaagtgcatttaaaaagactttttcatccttttttttgttccaagttagcaataaaatctgaaattataagcacatatatttaatacttcgttatagatccttttctgtaataatgttaattcattgtctttagagagaatagtaatctgcatcaccaagtggaagagatgcttcaaaaaatttctcctctacagaaatgtcaggaagaactgggatctttaaaagcagagctagaagagaaaaaggtatgaacaataattttctgtaaagatttacggtcaataaattaggatgagcttattcggtataattgggacgagggggcttttgatgtgttaaaggaaataaaggctagtcaagactctcagtgtattattagctttagagaacattgaactaactgcttagtagcttagtctttacagtgattattagctctgcaatactgtgtcagttgcttatgctttttgagagggtcagcagaaaatgcttctcactatgaatttgtgtggttttatgtgttctgcattaattgatttttatacctttgttttttgcttaaatgtaaaataacatgcaaaaattcaaactttaaatgtagaggaatcgttgtacataagagagagggagcaggagagaattttatttcttcagtggctctggcctatctttggagagcccagtggtgaatgaagcgtgtagggcttctgctctggtatgagttaagatgtcctttaaagaacctactctcataattcataaactagtcaatattttaagcaatgtctgtatactttacctctgtaaccctaactgctttgtttgatccctttttaaaaaatctcttttcatttctttttttggcagtcatgtatagtctcttgtggtttctcattgtctgtgagaggtacacaaaaatgagtctttcaataatgcttttataagtaagcgttcaggttaggggttatttcttttagggcatgttcgatctttttgggtgatacttattaagctgagatggagcatt

SEQ ID NO: 114295 - DNA, 1011 bp, Homo sapiens
gaaatgtatagttatcataccctgctagaactctcaataacagtgtctttcccattttatagtagctgctagggtgtatatatcagtgttcacacattttccccagttatcattaagtataatgatttgttttaaattttccctagcaataccgttagctcatatttattatgctctaatattttttcaggatatgttgaattttaattagttgaggcaaaaatattagctgtttgatatttaaaccaattatgaaggtttagaattgcaataaaattagtatattgtttttaagttttatagtttttgttggattatattgttagtcatatttcatctattaagaatctggttacctctattaaaatattcagtgactattttttctgcctaatgtctgtttatttggttaatagcttatcaaaggcaaagcaagttatgaccaatggtcagtgactttcattttgacaatatctgttttttttctttttttaaagagttctttaaagttgtatcaggatactcatcaggaatatgctcgtgtaaaggaagaatgcttgaagagtgatgctcagtaagtagttactaaattactatagaaatacggttttcagttttgaaaatacgtaattcttaagtcggtagtgtttttttttttacagtctttggatttcttggccataattagctgcatggtcttgaactagttagtctctcaaccttggtttccacatctgtaaactggaagttatatctactttgaagggtcataaggaacattaaataaattgtcatatgttaaagggctgcacaaagaactccataaaggtgtttgtctctgtatgtatatgcattatatttgcatgcacatgtgtctgtgtgtgtctaaaggtgtttgtctgtgtatataatgcattatgtactcattcacttgtgtctgtgtgtcagaacataatgactgaccccttgctttgtgccagtgctttaaccgatagcatgtggaatgggtat

SEQ ID NO: 114296 - DNA, 1086 bp, Homo sapiens
aacttcagctagtctcatgaatgatgccactgcagttcaggaagggtcccagatgtactcatggcagaaatttgacaggcccatggcatgtgtttcaagtggaaagaacagaattttttaatccactgtaaagatatttcatactaaatagtatattattctctcttaggatactagttcagactgaacatttgttatacaaatatttgtaatttaaaaaatatgtgccacaaattataaggcatattttttcctattctctctttcttgccatttaacttacacaatttcgttattaggaagaagaaactagaagctaaggtgaagaagctgcaaggtaagtggcactattgttacctgaagttttcggtcagtacaaaaatcactggtaactgtatgaggaggtacttcttgatcaaatagttgaattgttatggtttttgatggtacatccatggatgactgcatcaaggggtctattagaaagaagtgtgaatactactctcctctcagttaccaaatggtaacatagagatggaatgtggcaaatctccgaaatgttactgcactcaaagtaatcgcagcccatacttttgctataaaaagcagtaattaatgaaagaatttaatttggaaagttgaatctcatagggctttttctttttttcttaatgaaataagtagctggtggaaagggtggctacttttagtaccaagaaacatgtatttagatagttataacacacatacagagatttcgatgaaattttgtacattagggattgtccagtttgtacctgatcctcacccgtgcctcaccctcttgttaggggttctagcctacagtgagtaggtacgagtgcagagggaccatgcgagaatctaagtcctcacatttcagctaataacctttcaggaactggtaggaattgaactcaagatctttttatttgctttttcctcccttcattgtgtgggtgggacacagacctaataccaagtagagacaaaggggctctgccagatccatcctgcacacgatcttcctgtcattccagcctggactgcagcgggcatcttacctgc

SEQ ID NO: 114297 - DNA, 1077 bp, Homo sapiens
gaactccttggcttgagtgattctcctgcctcagtctcccaaagtgctgatactacaggtgtgagccactgtgcccagccaaggaaattatttttttgagacagggtctcactccgtcacctaggctggagtacagtggtgcagtcatggcttactgcagcctcagcctcccagactcaggtgattattccacctcctgagtagctgggaactacaggtgtgcaccacgacacccgactaatttcgactaatttttgtagagacagagttccactatgttgcccaggctggtcttgaactcctgggctcaagaaacctgctcatcctcccaaagtgctgggatcacagtcgtgagccactgcaaggaaacatctttaaagaaatctgaagtgccagtgagactatatatacaggttttagaacagactttctgtgaagcaaaatgccgcctttatttttcgtgtataaaaagtagtttttctagtaaaaaaaatttatcggtgtgacttaataaagattactgagaaaaaaaatatccaaacttgttagaggagtcaggagaggattgttactgaggtgtttcatggagttttagttagtaattgtatatgagcatagttatgtaaagtcagtactggtcagattcttaatagtatgtctggaccatttgaggcttcagaaacaaaaatgaaaatgaaggattacctaaaatagatctctaataaaggtcctagggattatgtttagctaacttgttgaagagaattccagggaagaataaccatatctataataagcattgagaaaatcgcctctcccctccctaataaagaggctatattctgagataaaatcacatttctaaaatttctaggactttaaggttgccagtgattgaaatgggacggcaactcccttttatgccttgaattcttccttaactaggggttgggattgctgtgcctggtttggaaagaattcttaaggcctgcgctagttctgtggtttaaatgacagttaaagaaaaaagtacattgcattcagccctgacgataaaatattgaaggagcaatggct

SEQ ID NO: 114298 - DNA, 1047 bp, Homo sapiens
tttccccaaatcagagatggcagggagtgggagaaggagcaggacattagcattttgccaggtaattgattaaagggtgaaaggaatgccaagcttctggtttcaaaaactgtttctggcctttgctcataaactgtggccccagtttcattttctaaagttttagctatgacaatggagctcctcagagtgggcgtggatatcagaaaattgggtaattatggccactttaagggctagcccctcctcttcccagaaaacaagatgtttatatactccatgtaaaccctcacaactgcgtccactttccactgcttcccctgcaaggcagggtcccacagatttatgaaatgagaatctacatttactgctgaaggaatagcactaaaaatgtaggctgaagaaatacactttgtctgccaaagatgttctgcctaaactctcatctaaaacttagagaaaaagcagtgagaaaaaagagaaaagcaacagacgcaagaagactgagagaaacagtctttaattatgaatgagaaggaaatgctgaaaactgattgcatttcctttagagaaagtctaagaacatgtccataggctgctgctatgaaattgaaccagatagggatcttgaaaattaaaaatccaattgtataaataaacccagtagaaaggtggaaatactggatgaacaaataaaagatcaattaagttgatcctagagactgaatcctaggcggttgagagcatcatacaaagggacaaacaaattaaagatattagagaaaataacaagatttggaggatagagccagatgtctcaatatgcgtctcctaggacttctcagaggggagaacagaaacagaaggagagaaggtgatcaagacatgacagaagggaactttcctgagcagagaacacatggaatattcatattcataggggccaccaagtgttgagcgtgatttttgtgtacagtctccgtctctgacaccttcgtaggaaatatacctaaaatcaaatgaaacagactgaatattagagggatg

SEQ ID NO: 114299 - DNA, 1054 bp, Homo sapiens
actggaccacagcatctcgatccatgagtgatagaaaaagagacattttacatgagacaaaaacacaaatggaggttagggagatggataagtcagtacaaactgagaagaccattcataaactcactcgaggtctatgcattgagagattgtctgccagccctgcacaagagaaggaagctgcccctgggaagtctgagttgtgttcttctccccttggcaaaaggccattaaatgaactcatggaatctgaaggaaaaaccgtattgtctaaaatgatgggatcgcccaaatcagagtttactaagtggacacgaattaatgaaatcacttctgaaccagaccgtatcacagtttctggccattttcacagactatctagagaattggaaaaggaaaaagaagatactcaagggttcactttaggagaatcacctgaatcagaagatgatgactcaggtgatggaatggatgtagcagggcttgacattgaaaccagtttttcttcctcttctaccttggtagcattgtctgttggcagtaatccccagtcttcttctgggttagactgtggtaatgatacagatattactactaaagtattctctactgaaccgcatcattcagaacataaattgcaaactaaaactttaaacacattacatctgcagtctgagccaccggagtgttctataggaggaaacaacttggagaatagcttgtgtgccttgagccctgaattgggagcatctaattttaatgatcagaagagcagtgggatagaatatacaaaagtagtaaaaggcttgaccaaaatacattcacttcctcggtcagtatttatgaaagctacaaaagatgggcaatgtgaaagtcaagatccaagaattgagctcacactaaataagccagatttcacatcattaataggttctcaggctgccttgatcaagagtggtttgggttttgttaaaagtacttcatggcaccatagtgatttattaaggaaaggtggcgaagaaagtctgagagccaaatcagaacatgaacagaa

SEQ ID NO: 114300 - DNA, 2233 bp, Homo sapiens
aataacaacatgaccactgagaatttaaaagagaaaagtccatttcgggaaacgactggctcctcatcacatgcttcagaaccaaccccacaagcagctgccttggacactgagggcagctctcccatcagcggtatgcctcagaatgaaaaccctcagagcagaccagaggcccgttcagatgcaggcaggcaaaccgatggtggggaagaagacctgccagaacctgtggagccatcagccttgtgctctgactctgtgatggagccatccatagagcaaagttctaactgcgaggccgaaacaacatttcagtgtcagatagcaacagtgacctcagaagttataaacgtacttataaataaggatcagaatctagtcattgaaaagggggacaactggacaatcatcagtggtgtagctgtcttgccacatgtggaccaggtcacactgtgtgacattcctggagacatccctatttctcaggatcaaggagagctggaagctggttgcatcccagtgacttctgctgagaagtccccagaggccagtcacactggccctgcatttcaggaggctccatgtggcaataatctttcatgtccccaagaggatgtttcaagcagtggtcagagcaccaactttgataagagtcgtttgcgaaatagacccgttaagcctagtatatggattagttctcaaatctatgatcaaaacttcgagactcagattgttgcgtctgatcacacatattataactcaaaactagagccatctggcaaaaataagaatcgatcaaagatttcaaacaaagatcagtcaaacaaaccagtaaaaacttcagcgtcgagcagagttgaaactcatcagagtgaagttgctcagtcattttcaggggaaaaagctaatacaaaaactcaaagaagccaaactcagaccattttagcaaatgctgatacatccactcctacagattgttctcctgacacactgagtaaaatacggcaagaggtggggcctcctttgccgcctctgcttgctcctctgatagctacacctccaaggacttcacagccactgtctccactgatatcgagttctagtccttcctcaccagcctctcctgttggccaggtttctcccttccgtgaaaccccagtgcctcctgccatgtctccatggccagaggaccccagacgtgcctctcctccagatccttctccatctccatctgcagcttcagccagtgagagggtagtgccgtctcctctgcagttctgtgcggccacgccgaagcacgcacttcctgtgcctggccgactcccaccctgtgcatctggccacgctgctgtgggagggcctcaggagaattctgtgaaaatccttgacaccatgtatccagagttatctgccagggcccggaccctcaacatcctcaaagggaatattcaactcacacgaggtccgcctgctgactgtaagaatttaccgggacctgccagtgctatgataggattcaaaacgatcacttcagcagcaactgcttttgtcaaaactgggagcagctctggtggtgactgtaaccaagacaagtcaagagatttggggactcagcaggattcaagcgggaaaagaacactgtcaacgtctacactgagaagtgctaaaagactgcgcctggacactgggtccccagaaccagaaaccaggggagtcactgcagaaggaatccacaaaaacctcccagggaacctccctccagctgaagttgcaacaacaaatgaggaaagaagttgttctagtccagccgtcagtgcagtttcacagttgcctttaagcccaaaagaaactgtggagtcccatgataaagccatagctaatgccctgaagaaaattgcagagttttcttttgatctgttacctgtcattcgtagtcatgtgtatgtgggaaatatctccaaaaagcccgtaatgagagatcaagagaaggaagttgtttatgaatttagcacaacaaaaaaggtatgtggctgctcttttctaagtgcattagggattacatgtcctcaaagacagatgctgtttactgtcagcaaaatgtgtagatgaccatgaacaaaagttttacttcaaggatgagagttatccatgtaaacattacgactatatttctagccagcattttacagatttaaaatatgataagacactggagatttggtcatttctattc

SEQ ID NO: 114301 - DNA, 1170 bp, Homo sapiens
aaagcataaggagctccgtaagtcactttgaaaggaagtgaatgcatatatcaaattatgtaatgctcctcttaggacaaaaaatgttacttagtattttaaatttaaacagtatatagagtaaattagagtttagaaaacaagaatgagagtagaattacatactgtatttcatatactcacacagattacataaggcaaaacccaagaaattatgattatttgactagtggtagtgacagtatgcagctaggtcttttgagacttgcattctggcatctgcagcatttaccagccataggaaacagacaggcgtggggatttcttcagtacccccgacctcgattctcatgatttaccatgctaggtaagttcttaccagttactatgctctaccttctgatgtagcgcaagttttattttttcaatagatacttaagttttgtaacttttagataatctttggtaggctgaagataagtatgagtgtacattgcctttttaatttttttttcaatccagcatttagcagagtgcttgcttcactctattctctcagaactaaaaattcagaagatatctatggaccacaattacattcacgccctctgcagggtgtatgtgggtatttgtcggcaactcggagacttggaaagagctcgtttgttttgctacagcctacttaaagaaggtatgcttagattgtgacaattttgtattgaaaatatacgattgcctttttcccttatactggagtctatattttcagctctgattactgtgtgtcttttaaaataatgttatgttttgtccattgaatagctttagctatacccagctgcacctggtctttagtagggcttacttatatcagcactatatttccacttgtaaataaatgagtatctctcattactgtgtatttgttctatgctctgtgcagctgctttagaattagatatagttgccttaaagtatgggatactttaaagtaagtgacaagccaaactgctgtaccactaggtggaaagggcagcaactttaagatggaattgtaagctgatgaaaagaagtagatgagagaaagctgaaaggagacggtgacatgagggttgtcctttgattctcttttctctttactatttcttccatccctactagtggatcaga

SEQ ID NO: 114302 - DNA, 1050 bp, Homo sapiens
attgaactttatactttaaaagagtttattttattgtctgtagactacacttcaattaatttttaaaaaagagacaaagagtgtaggagaaagtatttacaacaaaagaattgtcatctagaatttattttaaaaaattcttcaaatcagaagctttatgtgttcaatgagtaaatgtaatgcataaaaacctatgtaatgtaatacaaaacctatgtaatgcaaaacctatgtaatgcataaaaattgcctgtaatgacacataccaaatgggagaattctgagactgaggaagttggagaacggattttggaaatgactgtgactggagcctcatctgggctccccatttacagcttcctccattgcaggatgcctgcaaggcaccagtgaaattaatacaatttgttcttaatttgcaatttatttactcgatcatacatcaaagagttattgtattattttatttctgatagattttccggagtctgaaaaattaactttgtttattgcaaacatgtggcatgatatatttctctctcaatcggtgattaataaagcaatgcagttagttgccaggcaacgtgctaaaggagaggttctgaactgcttgagagcttttcttaattgggaaaaggtgagccatatttctgtttcttacagtatcttacttttagatattatataaatgttaattattttgttgtgtatttagttttatattagttcataggcattttcttctttctagatcttttaaaatttaatcagtttagcctaagcttatccattttgttaattaagaatgcatgagacattcaaggaagaattgtagaccaaaggattgtgttaattaacagtttgtgttatacactaatttgtgactgatgaaacccacgcataggtgtatatgtttaaaagtctcagagaagctacaaaattatttggttcttcaatagatacttaggtaaaaatatatatatttcagttttttcctattaggatttttaaaatctaatatgcttaatttttctttccagttgatagaat

SEQ ID NO: 114303 - DNA, 1040 bp, Homo sapiens
tactgaagttacagttttcctctggcttagctccttttggtttacatgcacagctttatttgtctgtgatcctgccggataacttggcttctaaaacacaggggctgcttttgcacctggagagtccaagtgaaaactcaggctctaccacttcgtagttctgggacactggggatgctcttcagcttctctgtccaaagccttgttcagaagaattagaacaagatgcaagcactgaatttgcagccacgtttaagctagcatgggcacaactatgctgttggagaagatgtgagcatccagtatctgttctcacttgaacttacaatgttagatcctcagcagttatcctctttcacttattgcttaaggatcatttataagatattagtattatttgagtgatgatgagcatacatcttttcatgttgtttttttatagtaaggagctgtggcctgtgatggataaatggataaaatacagaaaaggacatgcaaacattgcgtatactcctgatattattatagcctcaatactgaggctgattggtaagttgtctgttttattattgtttttttcttgttattgatatcttggtggaaggctggggggttaactgtataataaaatatgctgactttgaaaatttctgattttacaaccatcagagtagatacttttgtacttaagtcattctcctttctctctccttgtaaattagtgttttattcatctttttcagagattaagatttttcatattagtacattttagttacaattgagctctttttagatgctaatactaatatacataaagactaggatatataagtcgctataaattatactgtagtttcatttggtttctaaaataaggattgtattaagccattcttgcattgctatataaaactacctgagatgggataatttataaagaggtttcattggcttccagttctgcaggctttacaggaagtagaatgctggcacctgcttggctcgtggggaagccttagggagctttcagtcatggt

SEQ ID NO: 114304 - DNA, 1031 bp, Homo sapiens
taacctgggctctctgcgaggcctcctgggtggagctgtgtcttgacggaatgaaatccgtgatgtacagtgagatgccaggtatcacagagtacttagcatcaaggggggagagcttggaaacctggagaccttgtgagcaaggcttcgtagtggggatttctattatcatttacgtattgcatagcatgtaattttatctcttgtgggagaagcttaactcaaagtaactcttataagggatgaatctagtttttattttgaatattgtataatcaaggaataatacagttaagcaacatgccatcagaaatgcacagagttacattttaaatactgtataacacccaagatgatcttaacatggtaggttgtcttcagctttcagtgggagactgtatatttagcttaatgagaacagtgtttctcatttaagctgctttatctgaaataccttctttaactttaggatagctgctgaagtggtacacatttcttccatattacagtgtacttttttacaattgaggttgtatattgacataaaagaaagtagccagaataatggctaatgagttgttttgccagcagatgcagtttactctgatactacagtgggtgtaacctagaagctgtggtaatcctcgtccccatgagggagaaggaggagctgatgttggggcctgctatagattagaccttgtgcatggcactgccccacagcctaacgggatccccaagacagccatctgagtggatggcattgtccttcttgtatacaggaggaaaccaaagctcagagagaagagtgatttgctgaaggtgaggctaggaagtgccatccctgctgtttgcccaggtctgtccctctccagagctagctctttaaatagtgccacatgctgttatttattaaaattatttttaacctcttgtgtttctcttactgttacacttttttatttgtttgagtcatggccttactgtgtgccccgtgctctgtgctttctcattgcttgtggtttatgggg

SEQ ID NO: 114305 - DNA, 1308 bp, Homo sapiens
cattttgaacacaaatagtttgatcagctttcagaatacaaagggaggtttcaaaacaaaaagacataaaatagataaaacagaccagaggctctccttattgtttggcaaggagacaggagaaacaagcagtcgcatagtcgtttttccctaaatctaatacgtttcacttaaggctgttgtgatctgtgacatatgggttatattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagcccttagcagaaacccactttaatgcattttcttcatatccctaaagttccttaaaaatatgtgacaatgcatcaggaagaggagaactgaagagtagaagttcccttgcagatttttttatcagtgacatgtaatgagcaattcacagatgagcgcaggcagagctctgtgtgccgtgtacatatggaccgtgctatgatgtgtctcacattggatgatattccactttgggaattttagtatttgtatatagaaaatgggtttaataactcaccatggttttgatttgtcttatattcgttatttcttaaaactcttgtatgtgtttttataataaaaaataaaagtaagccatggatattactgttctgattattagagtgaaactgggtgttacttctgctctaccaagggtgaagaagacatctaaccaaagatagaagaaaatggtcattcctaaagagacctgccttctggtgatagaaacattgcattgccagtacttacccagctttgagtatttacggagatgctctttagtgataccagatgccagataattaagtgtttacaggccctcatgattggattttttgtttaattacagctgctgccctttaacaattgcatttggcagcaattttgttactccttccttaagtaattataacaggcagaactgaaatttttaaatcacttggttgtcctttcggaagctttgtgttgatagtcattcttactaccaatatgttgaacatactctgccaggtgccttgctgggaggagctagtcacatggcatttgggtagagga

SEQ ID NO: 114306 - DNA, 1128 bp, Homo sapiens
attccagacagagcaggagctctatgtggatccaaaagcctgggctggactggagagcaaagaagattctccaacaatgtacaaaccatcatttgagttttaaatcagagagagatctctcatgatttgaaaaactggtgatttgggtgacatgaaaaactttggggaatttcgctagtgctcagaaacccacacactgcagaatggaaaatcctgagcccactttcaaaacatttgaacctagtagtaaactgaagcaagcttaacttgccaaatagctcagacacagcttaactgcagaatacgtctattgagtgacatgaaaccagtgcctgacataagaagggaaatcgtgtgcactttgagctctgctgttctgatatcttacaataaagaatagaacagttcataactagacatacagatgggccagatgttgaaattatttgatgggggctttaactaaaagtgtgctaaataatattttggaaaaagtgtacagcatgtaggaagagatgccgaatatcaccagagatatggaagctgtggaagagaatggagtggaagtgctacacatgagaaatataatatcagaaataagtaccttattggattttgtaatagagtgacttagcagaggaaataatcagtgaacttcaggacaagttattagaaagtatccaagctgaaatacaaattaaaaattgacaaataaaaaataaacataaaaagaccaaaaaaaaaaaaacccacaaaatccagaataggttatgatgcctttctttgtgagacaatatcaaatgacccaacatacatataattgggacccaagaagaagagaaaatgaagaagaataaatatttaatatgatatttgctgagaatagtctaaaattgataaaagacataaactcacaaatctaaaacaatgagaaaacaccaatcaggagaaatacaaagtacctaagcacatcatagctaattggtgaccaccaaaactaaagagcagatttttaaaatgagccagataaaagatgcgcattatgtacaggagaacaaagataagtgcagtcactgacttctcaccagacttaatagaaacaacagacagatatcctcaaagagctga

SEQ ID NO: 114307 - DNA, 1034 bp, Homo sapiens
agttctgcgtgaagaccctacacacttccttcattgacttctgctccttccggtcggctatcacctggaccctcctggactgggcttttgcctaagaactttccaaaaaccacacaaaatagtgaatggcagtttctccaataacaattccaaattatctgaaaatagcaaaccatggctaatttctaatgaacaataatactcttctctatgactgaaagggaagtgccaagcacagatgtgtgagaggccacagatgcatggccctgagctgagggggaaaagcggaatgactctgagctgatgtacggctcagttcaaacagtcagcatggatggtaattgctatctgttttcctgagatcggaaagttgcttgtaatacgggtaggtaaaaagaatcaaatataatagaactgaataacttttcagtactagaataaaatcaatatgttgcaagtaatttcagaagcaacagcagcttccaagaataactatttatcaggatgggcacttacgcatgtttagggatcttgtgaaataatttagtggtgtttggtcaacagtcaaccgttcattcattttgctgttcctgagcctccattgcacacacggcaaagtgctcacaggtgcttgcatggaaggattccctccgcagctagaaacttacatttagggatgatcacgtgttacaaaattatgtttacatttaaaacgccaatattctatcacgattgtaaacacagatggagagcaagggaagccactgtttattcaccacttgcctgtgctctctctgttcttgtgacctgatggattgtgcagggtcgtagtaaggaaagggaggttgtcctggggccaggtcgctgagtatgcagtgggccaggtcccactctgcagcccctaagggcctcacccataatttgaccttgaagagaaacctcttcaagtctctctgcctcactcttctcttctgtgaaacaaggaggacaacagaaccgccctcacaggtaaacgaagaattggagatattgaa

SEQ ID NO: 114308 - DNA, 1170 bp, Homo sapiens
aaagcagcttggcccttgtctccaggactttgtgtgtgggcaggagtgggttcacccttcggtcttcaaagaaccaagtctgagcaggatgtccatgctgttgaagaaacgaccgtcagctgacatggttaaccttattctgtgagcctgtcaggtttttcttgagaaatggatagattttgtttagaattaaccataattttgccacattacattatttcaaaaacactgaaatgaaatagaatttctagaacttgtgatgtttttatcttttgctatctatcaaggctactttttataccattagtagtaacctaatgatatcttgttctgaagtgattatatatttttggcctcaattataaaattcgaaagtagagttagttttcagtttttgttttttgttttttaaataatgaatgattcagtttagttgaatgataaggatttctttagggtacagaaaaaggtaggtggcctgctcttggtaaaatataggtattgatctaggcagtatgtttaattaaatcttcaggatactgaagataatttctgggggaagtgtcagaaattctaagtaacagttttatactgtttagaaataattggccagaatgtctctgttatatttaagttacctaggtgtatttagtaaagtggtatatcaagccgcctcttctttttaaagcagtggaatggtttgtaaaaggatcttggggtcgtcagggctggggctcttgtgcttgtagttctcctttcctttcccctgaagctcctccacagaggaggaggggctttgccaagcagcagggctgacctagaatggaggctgcatcgtggaaggatccgcctatgtcacccaggcccgaacccctggatctcatttagttttttcttttgtcaagagttgccttaccatacaagctgctgtaaggatcaaaaaggtaataaatagcatgaacgaattttgaaaagtgcaaatgctaaacacatgtaaagtggtatggcttgtgaagcgtgcttgggtttatcagtgatcattacttgattttatgagctgttcgtattatcagaagtaatgaaatcagatgatctgtacttgtgtaaatgagggaatattaattcccctggttcctacactgagttttgtctaaacaaggccgtgtgcag

SEQ ID NO: 114309 - DNA, 1050 bp, Homo sapiens
cacggacatagaaaatgttgcactcgaggttccatacctagtgctgtgggaatagccagaccagcctgatgctgtaggaaggctccagagaggagaggaagctaaaccagacagtatggctttctttccctcagactttgagtatagtccgctgcctcatgtgttcgctgaaaccgcacacacagtcatatgcacagtcaggtaattgtttttgagagaaggttcatatttttcatcaggttccctctccatcccccttactggcaatttctagttgagaaggaaagtaacaaatatttaagggtattttgtaactctaacggtgtcctaggaatcctgtagctaaccaaagaggtcagaaccgtgtgtaacccgcatagctgtgaggagaacgaacttgcgtggagccccggttggctgggtagctctgtgggtggtgcttatgctgtcaagcgaaattaaccagatgcctgtgtgtttgcctttcccccaggaattttattgttactggcttacaggatattgacaagtgcagacagcagcttcatgatattactgtaccgttagaagtttttgagtaagtaacattcttgatattagtcttgggtataaatcttgttcagttatggtgtggtatcgtgacttcttcatcactggcattcgagtgcctgctgtgtggtaggcacagcctgggtgctggggatgtgccagtggaaaaaaaaatagacaaaaatacaaaaatacctgcccttatggaacttccgttctaatggcattacaaaacgaaaaaaaagaatatccttaatattctattgtggaaaaaaagttacatgtaaataaaagcttattaaatatatgaaatacatcataggtcctcaaagccctgcttaggctaaagaacagccacaaaactttcttttttccttaagaggtgaaaagtcctatgagggctatattgtaaatttttaaaaaatggcagccagaagcacctgaaaagcaagctggtctgatgttcccaaactgcccgtggagtgctagttctgagaggtg

SEQ ID NO: 114310 - DNA, 1095 bp, Homo sapiens
tgtagaaaagctggcaaatcaaaaaagtccttcagtcgcaaggaagctgaagctacctttaagagtttggtgaagacgcatgaaaaatatggttgggtcaccccgcccgtgtccgacggctgatgtctgccacgtgcagtagacgctcgagcgcctgtccacacacacaccagtaccctgacatctcctcaatgctgtgcatcctccacccgtttttactccagccagaactgcatcctgaatgcccaggagacgtttaagttatttatgaaaagatgtgtgtacagagaggaagagggagcaaatgccgttcggattatgtttcgattataaatgaatgatcacctcgaagtcactttagaacacatgttgagatggtgacatttcccagcctgcctgcccctctgcccaccccggtcacattgccctgagcttctttccatgacagcagctccgacgagccggcaggaaactcaatgcccctgctggctccatttccatgtaaatggcgccgttcatatttcacagggacgccgtgcatctccgccgtgcgtccccggcacgtgtttgctgtgctctgtatctctgtttttcttcctggaaggtcaacataacttgaaaatgtgtctttctgtggcccatggtccgctgtgatgacatttagacctcatttgtgctatgacctttggctcatgaaaacacaaatttaacattgccaggttctagtgatttaaaaccacaactgcccacttggtgaaaacgtgctctcgatgctgatttgtggtgtgctgctgtccacagataaaccagtgccattagatggaaggcagaggatactgcgaccacccctggcagacggtggcgtagacaccaggtgcgccctctggggctcagagcaacggatggtcagctgcgaacagtctcgtccgatgttaggaaatggtcctacggccgcgcctttgtgttcctgtcttctctccaccaccaaaagcaaaagatgatttcccattcactgcagtcatctgactcattttaatatctgtgctagtgacaatgaatgtcagaactgccaaaggataccaagtgatcatacga

SEQ ID NO: 114311 - DNA, 1014 bp, Homo sapiens
tcaaagaagccgtaaagatagcggccttagggttcctgggaagtagcccactcttatcaccctgtagcgacgctcaaagcgaggagtcactcccacactcagcactgcctgtgagcaccttgccttgtcagaataggcaaccccgggtaaccagacacagagcagcctccagtgttggatggatgtaggggtcaaagacaacagaatagcagctagcaagtacagaccacacagggagaagaaaacttaaaaattgataaataaggtggacagttattatggtgtatggataagcctgaggaaacattcaagagaagactgctcctaacatggaggattttctttctctaactttaatcagcattttggtaagggtcttccgattcccgaagagtgcacggcagaagaaaagacatcagctgaaggagttttcgcttccacccagcagggttgtctctgatgagggcctctctgaagtagccagccccataggttgggagtagtggttgccttctggtgggggtgcttaaatgggagaaaaactttttactgaaaactctttgtttcctttgaactttgacgtacctgttgagtagatgaataaaataaatttcctaaaaagaaggacaactttgagccagcgagtccacttcacaggcccacagatgagtcaaatgtgtctgcagagtcatttgatgcaatgttgttaatagcagaaacctggaagccctcagcatcaatgacgaggcactgggacaccaatggtgcagagcccccacgtggacactggccagcaaaggggctgaagcagctcgctgtgtcctggagtccagtgaccaccaagaaagaaacgcaaggtgtagagaagaatgtgcattctgctgccattgtgtacagggggaaaatacacaggcttggagacatgtgcttttgaatttatgtaaagtaactggaaggatacagaagaaattgacagttttggttgcctctgaggagggcatctatgtgggctgg

SEQ ID NO: 114312 - DNA, 1164 bp, Homo sapiens
tgagtggtcctgggttctgctctggcagccctgctaagggcagagtctcccggtggtcctgggtcctgctctgacgccctgctaagggcagagtctcccagcctctcaggagcttcagtccacttaggaaacttgaggtgagctgcagggagcctgtggagaaacgcttctcatttagtggggtgaggtgacacggggtggcggggacagtaagttaagtttgagaaggaagtatgtagaaagtgtatgtgaaatctgtagatttggggcctctactccattgtgaacttaaagaggcagggcgaaagcgagggtgagaattttactcaggacatgaagaaggaagtcctttgagaaaacctacccctcggatccagatgaaatgtcctcccagtagttttgggggttttgtgggtatgggttttctgtggttttcttttttaagcagttgcatattacatctcattcgatttagttatgggaatgtttaatgttctacatgaagccactttcacttgtaggaatccagacgctctgcagtgtcccatcgtcttatgcggatggcggggaaaggcctccattcgaacttttgtgcccaagaatgaacggcttcattatctcaggatgatggggctggaggtattgggagaaaagaagaaggaaggggttatcctcacaaatgagagtgcagccagcaccggacagccagacaatgacgtgactgagggacagagagcaggagagcccaacagcccagatgcagaagaggccaacagtccagacgtgacagcaggctgtgacccggcgggggtccatccaccccggtgagcaggcccaaggcagcgggggcccacacccctcacacgcaaaactggcttcttctggtcactggtgtctgaaaccaaatccagagcagcctgtggcctgtaaagcatatatttctaatgactgcagactggtgggatcataggagccttctgaatgaccaggactgctttctttggagctgatgaaaatgtactcttttagcgtgttagaaatcacttgttttattttgtttctttggccaagctgggtctagtgtttcttttgctgggaatagactttcaaaagttgtacttctatcaagaaacaaaactgcccttgcagaaatttcaggtcttt

SEQ ID NO: 114313 - DNA, 1094 bp, Homo sapiens
gactggctaacatgcagattttaatcacctgtgttagagcaaaataagagtcttgccagcagttctgacttttctgctagccagctggagtagattattggtcatattgctgcttttatatttcatcaacttccacttcagatcactccagtgacgttttcccctaagcataaaaatcatttctccaagctgttctaattttctttctgttgtcttcattcttgtttatttttttaaataacttgctgtttaatatttttggctcaatttgatcaaaagtacgtgaatcacttcttgcagttacgtttcttacttgcgtttaaaacttactcgtgtggttcctttgggatataaaacatgctctgtggagtctgtctcccactgccgtctccaggcaagaaccacaatttaaagtagagattcttgtaaaggataaaggacctgtttatactggttttcttttaatcctgcacttagatgattgcagtattgttttagacaatttttatgtatttcatgccattctgggagttggtgttatagtttatttaattttgaattttgaagaattaaccagcagttaatccccagcctccttgcttctcagagtggattgtcaggtgacatcccttgaagtccctgaatggcttttgcctgggtcctcttccagatcgtccctactgcgtcatttggacttggttcatgtatccagacggcctcttttcaccatctagatccttgaagccaagaatgtagattatttgttgttttctttcttcagaatacttaacacatcactaggtgcagaaatgtgctcagcgcatgcatccactacctggaaaacctggcaaatgtgtgtctgtttcttttccagcaaagggaagcatcgtgctgaagtatgaaccagattctgcgtaagtcagtacacgccctgcccttagacacacacgccttgtcattagctacagtgttctcgttggtgaggaaagtgacttgggaaggtgggaaccttcttcaggccttttgtgattgttcctcagaagtagccttgtgaaaacttcagaaccaaaatattcctgtaggtcatcatgaag

SEQ ID NO: 114314 - DNA, 1057 bp, Homo sapiens
ttacaggagatggtcctgtcttcatctctctgtgtttcatcttatttttttacttacaggttattaacacggggatcaaagtctggtgtagaaataacagcggtgaagagtttgactgtgctttccggctggcacaggaggtaattttggaagtggatttgaacagcagtagccacagatgactgaagcagtcgggagtagatgggcttgctggtcagccagatggtctgagtggctcagggcttggctggcacctaccagccacttgaccctcacaggttatagagctctcccagagtgctggtttcccctcctaggggggggtgggttccacacctgtccaaggggaggggccatagtgagggctcgaccaccatagccgctaagagcatagcccctgagagcaggctgttgtcgttcatgaatgacatcatggtatctgttctctcattctctttattcacacagggaatatatacattgtatccatttattaactcaagaattattactgtatcaatggaagatgttaagatactgttgacccaggaaaatcccttttttagaaaactcagcagtgagacctacagtcaagcaaaggacctgggtgagtagttggaaatgcatagagacataacttgtattccctttataaggccagcaaaaatgcaggtggtgtgcgttggggcatatttatcaatcatagttttcagtttatttatggctacatcaatttccagagggttctgtagatccctgattgacagttcagaatgctaagggtcaaaggcatcttggggttggtgtacttccccaggctctggtggtgccctgctgctgcccagcagcctgtggtgtgtctgtgtggcgtgcagggctggcctttgctcaccttgctgggccagagagtccggggagaggaggggtcagcctgtgagcagccctggcaagcctcccagccagagctcttgacccacttgcctgtcagcaggtcgggggtgggtggaagcaggtctctgtgcatgagcaaatttgtttttttctttttttgttttga

SEQ ID NO: 114315 - DNA, 1049 bp, Homo sapiens
cacagctactcaggctgaggcaggagaaccgcttcaacccgggaggcagaggttgcagtgagctgagactgcgccactgcactccagcttggaagacagagcaagactccatatcaaaaaaaaaaaaaaagtctcaaaagtagtgttatcaggtcattatcattggagtagcggctgagggagagaagctgcacttgttaatttaggtttctgatggagttgtgccccaaataaatgttacgtggaggtttcaggtggaagtggatgaagtttagaagctggagtccagagcagagcccagtgcccttgaaccacactgcagttttggggattgaattctggaggaggagaataagatgtttagaaacagtctaccagattttgaactcattgtggataaacaacaatgttgttatgtacaggaaattttatgctttggatccttcattcccaaggatgaatttgttaactcggactacagaagggaagaaaaggcagctctacatggtttctaaggagttgcggaatgtgctgctgaataacagtgagaagatgaaggtgccagccgcacagacgctgagtgctgtgtgatgcgggatgcgtgtggcttttcacagcggcttagatttcatttggagcagaccgtgacatctgccctccccacctgtagcgctggctgtgggtccctgagcctgccctttgatttcagagctgttgactgacacagggctgaatggttcctgccagagtcctgaatctggtggcctgtgtcttttctgtgccccattcccgcaggggggtgagccatggtgtagttctcacagctcgccctcctgggcagagaaggtactaaaggtgtagaggctgcgagtactgctgccccgacccttgggatttgtcctttgaggtacttcccttagaatttggccatttgggggcccttctttcatttgctttactgtcctccaaacgacgtaatcacaagttgtgagtatcagttcgttcttaaccggggtttctcggtgggtttctgcttctcctctcctttc

SEQ ID NO: 114316 - DNA, 1050 bp, Homo sapiens
atttatatacttgtctttttgcccctgccgggtattttagaaatcgtgcttggtgcactttgtgtccttcagtgtgccttacccagagcagatgcacgataagcatttttacacgagaacaagctggtggtgtaggcctctgctaaggaacaggctgtatatgctctttgtgggattaaggtagaatcagctttaactccaaagaaactgtccatgaattttgtttataatagcaagtagatttaaaatgacactttaaaaaaattctgttgtctttctctacatataatgctgtagaaaaatataactgatggattttgtgaacgtggtatttttaacttttcgtagcagcacaaagaatgctcctctttgtgtgtcaatgaaattgttctttatgacagcttcagggtaaatctgcagagaccagagaaagcacacagctgagccctgcagatctcacagaagggaaacccacagatccctctaagctggaaagtccgtcattcacaggaactggtgacacagaaatagctcatgcaactgaggatttagagaataatggcagtaagaaagatggcgtgtgtgggtaagaaaagtggttatgtcttgatctaatacgctggtgtcttcacagtccttttggattaaatgggatcccagagccacttcttggtcggtttgagggggcagtacatgtgtggtatcaggcacatgcagtgtgagggctggactctgtggaagccggaaggtttcaacatctgccgcaaaccgttccatgttgcacagaactgacagaaaggaagaatgtgcttttggtattgaaggttaccacacattacagattgatttgtctcatcctgattccctttttagtcctcctccatcaaagaaaatgaagttatttggatttaaagaagatccatttgtatttattcctgaagatgacccattatttccacctattgagtaaggattcagcctttttaattattcatttaaagaaatttactatagagtatcaaatgtacaactgatcacatgtaaccattg

SEQ ID NO: 114317 - DNA, 1134 bp, Homo sapiens
tcggcctcccaaagtgctgggattacaggcatgagccactgtgcccagccgtcatgaactttttaaagattacaaagtgggccaggtgcagtggcccaatcctgtaatccccagcactttgggaggccaaggctgatggatcacttgagctcaaaagtttgagaccagcctggacgacatggcaagaccccatctctacagaaaaaaaaaaagaaaaatacaaaaactggccaggcagtgtgttgcatgcctgtagtcccagctccttgggaggctgaggcaggaggatctcctgagcccaggaggcggaggctacagtgggttgagatcacaccactgcactccagcctaggcaacagatccagaccttgactcaaaaaaaaaaaaaaaatttaagtttacatattggccattctatgagtgagggtcgaagacatgatttttctcttgtatcatctttgcggtatttgtcttaatagtaaaagaatgcatttttgattagttcagaggtgtgaattatatatatatatttagccttaggatattaccccatcatcagaatactggagggttttttgtggcagtattggtgaaaaaatcttcaatgccgtggaataaacgtcagccaaaggtgagtttttctttttccaaaatgacataacatttgatcttgtacatttaagacaaaaactaaccggagtttagtagaagtacagaggaaagaggagcttcttgctgtgggcagcaggagagctgaccctgaatgagggggaatttcatttaaatatcaagttttccaaaaagcagaaatttctcataggtgataggtaagtggagaagtcagtgtttgggggaatgtattcctgccacactgtaaatccagttatttaataaaaattgaaaagacatgaaagattgctctgtggctctcaattggaagccccaggtttctgtgctctagttccttgtgagtggttcatttcaccaattacagatagcagagctctgctgaccccaagccagcccgggttcaccttggctgcaaggaatgatgacggccttgtccagacctggctagaaagatgcagcccggcctgtttgctatggatctaaactgcctgctggttcctttcc

SEQ ID NO: 114318 - DNA, 1015 bp, Homo sapiens
gcagaccttggctgagccttagagtgggtggttgctggtgattttgactggagggggtgtgcgttccccacctgaaagtgctcaacaactttactggagaaggggcaacatggggtagcattggcagcttccaacccaggtgctggggtgtggagataacacctgctgcctgccctgctcatctgtgaagcccctggacagtgtttgatggagaagcccgcatgtttgcctgcactgtcatttactgttagcttttaaaaggaagaggattcagaaatgatggcagaagtcagtacgatgcttgcttcaaaggtttcttactgccattcctccaccttggagattcttttcctttgtttttgtaattgtcccattttcatgttttctgggagatttgttgaattttcctctgctgagaggctgtcacatcagtatctgtgctagtagctggtctcactggtttcctgtaatggcctcaccttatagcttcttattgtgtcactggtatggacacttaaggccagtgtgttttcacagctcttatcgcattgtttttaaaactgggctgactgtgtcccgatgggcaattttaggaaacttcctgggaccacgaacttgaggtttaaaaattcccatagttcattttcagcattgctctgggatgtttgttagacatgcctgcgtgaagacctgcagcatcgccctggtgtgcattggaatggggagacggagcaggcgtcctgcagcccagccttctggttgtcttcttgcggagttagtctcgcgtctgtggcaggactcctcaatgccctgtcattggaacaactttattgagctgtcgtttacatattgttaatgtttgctcattttaagtgtacggttcagtgatttttagtaagtttactcagttggcagcgccttaccacagtccagctttaggccgttcccgtcaccctagcagacctttcctgcccaacagcacttgctccccattccagctgagccccatcggcca

SEQ ID NO: 114319 - DNA, 1281 bp, Homo sapiens
aacagcatagggggcttttcatatgtgtatggtacaatacacataacgtgaggtttaccatcttaatcatttttgagcctgcagttcagtcccgttaggtatattcccattgttaatcaccaccaccatccatctccagaaatcttcaccttgcaaaactgaaactctgaactcctttaaacagtagctcccatctctctcttccctgcccctcacaccaccgttctattttttgtctgtatgactttgactactctagacctcacagaagcggaatcatactgtatttgtcttttcgtgactggcttatttaacttactgcagcgtccttgaggctcacttgtgttgttgtctgtgtcaaaattgcattgcttattaaggctgaacactattctgttgtttatataaaccgcattttgtttacccatccatctgttgatggacatctgggtttcttccactttttggctgttgtgagccatgctgctgtgagcatggtatacaaatacctctccaagatcctggttacgattctttggatatacactcagaagttgaatggctggatcatatgatcatatagtaattctgtgtttaattttggggggaccccaccatgctttttttcacagtggctgcgtcattttgtatttctacccccagtgcacaagggttccaatttctctacacattcagggacacttattatctggggctctttgttgttagtagccatcctaatgggtgtgaggtcacctcatacagttttatactgaggaactgacagatagtacagaatattctgaaacagtagtgtatttctacagtgtattgatataaaatatttctccttttatgttttgccagaatgttaacttttcccatcatattttccttagagccaataatgagaaatttcaaacttagcatgtttcctgcacccacgtgtgtgaagtcagttggtgcatagtcagtgagagaggcctttcctgggcagtgcccacctgctgctgtccttccagtgaggctccccttggcggctggctggtctgggttgtgccctcagccctgcggttgttgatggccttcacggtcctttaagctggaatgtaatgttgtgtttattttcctgtgctcatgtagacctctgtaaagatgtcatttctgggtgatgttttcttgcatggtcataattgccatggtgttggtgatactttattccaaaaggtgtgtgagggggagtatggggcacataatagtttagttgtaatgaaattacac

SEQ ID NO: 114320 - DNA, 1281 bp, Homo sapiens
ttccattaacaaaaacatgaaaataacttccattaaataaaagtagaaagtcagaaatttaacggtgattgtaagaaaaatttagctattagtaagaaaaatttagctattatattagcttaattgaaattactatggaaaatttattagtcattattcatataattctgattaaaatgccattgttgattaactgagtttttcaatagtattttaggttctgaaaaacatgaaaataacttccattaaataaaagtagaaagtcagaaatgtttacctgtgattgtaggaaaaatttagctaatatattagcttaactgtggaaaatttcttattagtcattattcatgtaattctgattaaagtgtcattgttgattaactgagattttcaatagtattttaggttctgtgtcctaggtctgcaaattagtcttgctagtgttttttccaaatggaagcacattaatatctccttagtgaatggagtttactgttcaaatccattattttctgcttgaaaattgaagtataatttaaaactataatacattagaaaatccctaaaacaaaagctgaaagcagattgcagttggtgaaaatggagattgtttcctaactgatatttgtaacacttgttttgtaacttagcttgtatgtgacatatctgttaaagtgcagtcatccacctgtagggagctttgcactcataaatatcttttttccagtggagacggcactatgagaaaaaacattgatgtttggaaaaagtggaccaccttaaatagcttgcagctacatgggtaagtaaaacttcatcactgctaacactgtgtgacaagtagatcagcagagatttattgttatgcaagtgagcatccgatctttaattagagagctgtaagcatcagaggatggtcaatggccaccttcaactgttttatcagaagttatttgaaaacctttcaagagcaataactgcaaattgtatacatttcagataacacgtttattaaaaatgccttctataaaaatttcttgcaacacttcagatatgtatttttccatgaaatgaccgtttacctcttgatgtatgcattactaatcttttctctctgtttttgttcttttgtatcatcgttttgctaagagacattttgatctcttagaaatatttttcggttggctttttatgatggggaactattcattaaagaacaattggaaaattcttaaagagaaatctcataacacgatgatcacgtctgttaatgtttggtgt

SEQ ID NO: 114321 - DNA, 3089 bp, Homo sapiens
catcttgcctaccaccgtcagtagtactcaaacaaacacactcataccatgggggagctttattttagaattatgtgtgttttctataaaaacgaatggcatttcttttttttttttttgagatggagtctcactctgttgcccaggctggagtgcagtggcgtgatgttggctcactgcaagttccacctcctgggttcacgccattctcctgcctcagcctctcgagtagctgggactacaggtgcccgccaccatgcccgggtaattttttgtatttttagtagagacggggtttcaccatgttagccaggatggtctcgatctcctgacctcgtgatccgcccgccttggcctcccaaagtgctgggattacaggtgtgagccaccacgcccggctgcagatggtgtttctttatcaagcctacttacagaagatagatttcactgtttgaatttttagtaacaatttcccctttcccccacctttgttcattattattactattattattattattattacttactgccttacatgaagggtagtagtgtgtagttaaaagctaccatcagactccctgggttcaaatcctaatcggcaagttacttacagtgttagacatcccatgtgaaatgggacgaatcagtatgtagcttgcgaggtgctcaggaaatgttagctgttatagtgacaccacgcccctttctcttaagtggaaacaaatacccatcgtgatgttttagagtcagctttcatctcgtcctatctttgttcaggcaaacttctctagttctgttttaataggcatatttgttaggtctgttttttgaaatcctcttttttacattgtttaaagataatgccttggctaaaaagcctgcttcacttttccctgtttttagttgttttctccacattggcagtaaagagccttggcgtcccagtagcagcaggttctcctttttgtattgtggatgttttgcatttcatactgttgtgaagagtggctttgatcatacatgttgttggtatatttgcctttttgctgggggtgtgagaagaaccagagatgagcagaggtacacccagtagacttcccagcctgcagagcctcccgggaagagcttccgtgttcaggtgcttggggccccaccctaggagcctgactcacagtcagagcagggtcccggcttgtgttcaggattttgaaacatttgtaaggtgattttgttgtttctacacctttctcctcatcttttttttttgtagttaatcgttactaataacagaaaagacatttttggcatggtaattggcacaaagtgaataattgttgaatagatgacttttgaggctttcaaaattcgagtgtccataaaatccatccagagccacctggttcctttttttgaaccacttaacgtaattctggaaaaccttgactgtgggtcttaagtttggtggattgctgcttctcactggctgacctttggaggtcgcatatttcaggatgtgattccacttaggctccatttcacctgacactgcaattctgtgccttcagagggatttgttattgcgaatgatgtggacaacaagcgctgctacctgctcgtccatcaagccaagaggctgagcagcccctgcatcatggtggtcaaccatgatgcctccagcatacccaggctccagatagatgtggacggcaggaaagagatcctcttctatgatcgaattttatgtgatgtcccttgcaggtatttatcttattggccaaaaagcccaaatccactaaagaaatcaagtcaaatagagactaaaatgaagttgtgcatgaatatgacacaattgtacataagtcttggggtgcggagaaagatagcgtgagcctaaaccaaaagatggacacgtagatacgtcttaatgagaagcagcacagcagatgctggataaagaacagaaaggggtggttgcaatagcctgcagaaagataaagagaaaacaaaacaaaacagagaaaatacgtaagaggaaaatagaatcgtagactcttattgtggtgtgttttaggatgttattgcttggaacaatttgtgcaccccaactattttgtattagttcttccagtgagtacagtatataaaaaactttgtcataaaataatacgtaatcacattggattttatgttatttagttgaatgaaagaaatttcggagttcaagcccttaagaaattcattttgcttgtgtttttatacctttcttgagataatacatcaacattttagatatttagagtttagatataaaataatactcatggtataactgagtaacaagtttttttaaaaggaaagaaacaaaactaaagacatcatctgttccgttcccataggaggtgcacggatgatgatcccaggtgataatgacttctgaatgacataagtttgtcaagaccagaattcaaaagctgccacaaaacttgttagcacagaatgcaagctttagatacgataccacattatggaagaatgccattttgtttcagtaagtggcagagttactgctcatggcaaaactcagtatgaaacttgcagctggtggctctgaatatagctgagtgttaaaataatctggaaaaagccctctttaaagtaaaatttaaaatacatcatgaactaaagtttttttttcctctaggttgcaatttttcagtattccttggggtctcatgttttcctacccctgttttttgatcagaaagataactcgttccttgtatcatattctgagatctgagaacgcagtgaccttatgagcaagaggttgcaagctggggaaatttctgaaattgtggtgggatttctaccatgcaaacaactagtgtacagccaggaatgccattgcaaagtggggattacatctcatgggataattccatcctgcagacctagtccctcgtgtacacgcggctagaccatcaaggaaaatcagcatttacagagaaagccaacaaaaacaggcgttaccttctgggaaaacagggcagataaaattagacacagaaagtaacaaatccagtctt

SEQ ID NO: 114322 - DNA, 1520 bp, Homo sapiens
ggtgcggccccgggggcggggcgagcacttgcgcggggagggacctgcaagcgccccacccacgccggggccgcagtaaccccgcgccgctctgcgcacgcgcggcttcaggctgtccgcggagctccttgagcccgcgtgggaaacctgggcgcttcgcgcggagacgcctttgtggctgcttcctggagcatttttttccccttagagctgttcgctgttttccctgtcacgccgcttttctgaaagacgggttgtgcgctttgggcttattcctggacggtccccaaaggtccccgaaaggaccaggcccggacacgtggggccttggtttccggccggaagtcccgggaggtgtagggctagagttctggccgtggcgggccggtttctgcgtgctgcgtgcgcggccgcgtgggctatggggcggcggtcgcggggtcggcggctccagcaacagcagcggccggaggacgcggaggatggcgccgagggtggtggaaagcgcggcgaggcggtaggagccgggacccggcgggcgggccaggggctcctcctgggcttcccggaccccgaggcctgcgaggcggcggcgagggggcggctccttgggcctcggggtagacgtctctttccttcctcagggctgggaaggaggctaccccgagatcgtcaaggagaacaagctgttcgagcactactaccaggagctcaagatcgtgcccgagggcgagtggggccagttcatggacgctctcagggagccgctcccggccactttaagaattactggttacaaaaggtagggaggcagtgcctgattttttgggagttggggccaggatgctggaggttaaaggcgacggtgttttcttcgacaagtgttacagtgccagagaaccgtggcgtttcagcggtttggattcaggaagcattgaggtggggagcacagggtccaatgaaatggtcacggaggtattgcaggcgcaaggttagaagacgaaatgaaaatgagatctgaggaagattcggctcctggggaatcttccaggagggaagctgagggtcttaccttttggaacgtaagagaatttatagagaatgcataaaaccccttggttctcccctcctccgcgccccccctccatctttgtagttacatctttctaaatgagtcgcaagtaaaacttaacggtaggatatgcttaggagagaaggaatgcagtgttgctcttagggctcaaacagtgtggattgcttaaattttgaaggcatacagtgtaaaagtagtgactaaagaatgtttactctccatgcaaaagttggttttagttttaaaacacttgcagtcttaaatttaagaagatacaatgtattaacttagttttttagatcagtttgaaacttccttatttttcaatagccacgcaaaagagattctccattgcttaaagaacaaatattttaaggaattggaggacctggaggtggacggtcagaaagttgaagttccacagcca

SEQ ID NO: 114323 - DNA, 1881 bp, Homo sapiens
cagcacctacggcctcaactacctgctgtccggcagccgcgcggccgctctcagcggagggggcggccccggggcccaggcgccgcggcccggcaccccgtggaagagccgcgcgtacagcccgggcatccaggggtgagtgcgcggggaggccgcgggggcgggggcggggcccatggtcctggccggcgcccgcggtgcagacacccgtcccaggcgcccgggcttttggaggatggatgttgaaggctaaggccaaggcccgactctgcactgaaagttttttttttaaacatcagactcatttatcgtggagtgacttgcccagatcctacaagtaacagtccaagaaaaggggctgctgggtaggacctgcaggtatttgtcttttttactcttgagattggaacgggaaatcgactctctacccctccaccccgcctccgggcaagtgaggaaccccttgtcaaagtggggcgtagataagtgtggagtttcacgtaagttaagttgcagaataatttagcattgccaggaactcgaatcacgtcgaaggtaaatattaacctttttaatttcattttttaaaaaaatttaactgtcaacttagaggtgattcattttttggggggtgttgtgtcctttaattttgtgctgcaattaccataagcatcgcctatggtttataaacattggcttaattcaaagaaaaaaccagatttgtcatatatgtctattctttggaaggtgccatttttattttaaatatttctacatccgcctagagggaattagaggctctacttaaatttagtgcacttacagacggcaaggaatgaaacgaaaggtggtgtgtgtttcggggttggaattgtcccaggtgaggctgttcaggtgtgatgctgttgacgcagcccctttgccattttgggcttttctgagcgtctggaagcaatttatgtgtaggttgtatgtcagtattttaagacttaaatgataatttttccttgcacaatttttccccccaatttaaaaaacaattaaggatttgctggggtatgagggttgttgcatgcagtagagtcctacaaataaccacaattgctaggtgttgggagttcttatagtaaacttttgcttgtaactctttttctcatttgaagtatgttgggaaacacgagttgatacttctttaaagcgtgtgatacactgtaatagctgcatgttctgtaacttatttcacctggcttgggctacaagcgataccttctaaatttcccgaagtgtaaacatgcagtgcagacgccggcaggagcgcagactcctcttctctccctccagttcttacctgtagaactttctgagagcaggtggttgggagcagtttcttcttgatgaatagcaatatatacctaagggctcgcttggggaggacctttaggtttccagcctgttatgtaactggaatggactccgtttctcttagcactagaaaaaacaggaagacacgtggtctctgccagtcttgggttgtacctctgctcttagaaagtggtagcgcatcaggtcccatgcacctcacttgggctccccgagctgtttcctccaggtaactctagtcaggctcagtaggtggtgttgcttttgttagtgaatgagcccactaggatcaggtgctgtgctaggatctggggatctggggcagggacggcatgggagacacagtctcatgatcttgacccaccctgaaacctgcctgcaagtgccccctgcctagagcacaagagtaccctgctcagttgtgcaggtcccctctcacgctcttcgtcacccacgtccagtctctcatcacatgctgttcgtttggcccttttaatctct

SEQ ID NO: 114324 - DNA, 1062 bp, Homo sapiens
cagggggtgggccacatctgggcccgggcggggtggatctctgcagaagtttatccatctcttggctgacagggtgggcgagatgggagcagctctgagggtccctgttggcagagaatgtctttgattatcaacaacatgcctttttgttgtgggcttgtgatccttttctttcctaaatcagctgccgtgcataaccagttaggctctcctgtggcttcagattggagttagtttcccaagtgctaggatgtgggtgttaggtgatttctgtctttccgtttgaaagagatttcagatcattgtaacatttctggaatcctgtcgatctgaaggaatggctaggatgtagtagtttaagggaaatgaaaagtcgaatgtattttgatgtttctgcatcagacctgctcggtggagtccatttctcagcttcgggagccacgtgcttggctcttgagagcctagctccatcagcccatgtcacacactcacaggtctggctttagctggtttcgccatggtttctaacttgagcctcagtttccccccctgtgaagcagagcctgtggcacccacctcagagagtacatgaaagacttggaagcactctgtgagttgtcatgcgagagattaaaaaggccaccgctgcccttttctcctctctttaaggaaattgaaaccaaaaattaagtccttcttgccagctggacaggaaaagcctttttcttggtttttgaaaatacaacttccactttcagaccaaagtgaaaactgctaaagactgaatattctgagtcttgggagtggggggctagaggggtgttgtgaattgaaagatacctttctatttttaaaacattttaacaatgccttaatgatgaataatgtctgttctagttttgcatttgttagtttttttttttttttttttttaactgttctgaaggtacatcagcactgttctacagctttaaataagaatctcatctccccagaggcaagggtactcttgatgtatttgctcagggctgtatgtgctgctccgtgtaactcatttaaagt

SEQ ID NO: 114325 - DNA, 1946 bp, Homo sapiens
ctctcaacagtcttcctggtcacgagcaccattgtggctcgtgtgtggggctcttttggcttagctctctgcacgagtttgctcctttagttcccagagctgacccttgaaatgagtgatattactcctgttttgtagacagaaaactgaagccttgacagtctgacgtgacctggcaagaggtgctgcagttggaaatgtgaattcacggctgacatctgggcactttactcctaacagtgttcagtgaacaagacgtcgctaacatgcgggggatggaacctagcaactcattctacaaacatggttcaaatatgttggtgcagggccttttgctttgttttcctaaagagattagattcagatgtggtggggtgctttgacagccaccgcaggacaaagttgatagctgtggggttgcggagtgttgaggatttcatagggaagccagtcctgcgcagtagtacgctcaggttcgtgctttcttgaggtgttccagaactggcctggagggaggctgcagtgtggaagcgggatttctgtcacctggagtattcttagaagttgcattctatgaagagtggagcatctgatgagctgtttactcgctgtttcatctgacggcagttgaaagacaaggcaggactggcagcgcagctgcctcagtcagcactgctgcactgggggcttgacctgcagtctcgcaatcctggactataactcattttgaagagagaaaaattaagcattaagtgattcaagcgtcttgcccaaggcgctactagaaaataaaggcactggtgcccagatgcaggtctgcatggtatgcaagcctgggcttcttcccacctcccccacagagagggcactggtatgttggagtgaagagccacgcaagacctctgtgaatgggcagagatgggccagtgacgcaacacagtaaagtgtattttggttataggcatcgtctctaaacttatgtaaaacattattaaaaaatggaaggacaacgatgaaatgatggccaaaaatatagaaaaggataccttgcatgtcctgtgaaatgcaaaggaattctaaagtgtcattatgagttacctcatggaagaaagcaaaaggtgaatctatctagagtttgtggttctgactcacaagagactgatgttcatgctgaaggacgagtgtgacaggtggaaggatagagcaccgagaccacactctaaagggtaggaatctatgggaactattcagggagatgaaagcatggaatgaactgaagcttgcagactcgttgagtaaaaagcgcgttttaggattggttttagaataaaataacaaggcctgtggttggggaagatgacttgctgttcacagagcctcccttaataggtggggacctcagcttttcctctgctgccatcaggtgagtggtgtacagtcctagccacagtagtaatcaccactggcctgactgagccctcaccctttatacagtgtctcctgccaccctcctgggagaggctgttctcggcacagctggcctggggtcacacagctggtaggtgtaaagcaggcattggagtccaggtagtctcactccgtagcctgtctctttagccactggaaatgtagagcaaagcgagaattgtccaaagagataagctaataaagaggaaaacaggctgggtgcaatggctcacgcctgtaatcccagcactttgggaggccaaggagggcggatcacaagttcaggagatcgagaccatcctggctaacacagtaaaaccccatctctactaaaaatacaaaaaattatccgggcgtgatggcacgcacctgtagtcccagctacttgggaggctgaggcaggagaatctcttgaatccaggaggcggaggttgcagtgagccgagatcacactactgcactccagcctgcgtgacaga

SEQ ID NO: 114326 - DNA, 1053 bp, Homo sapiens
tgtctgtgacttgtgccgtgccaccttgacctggcatccactgtcctctaccgcgtttgcagataggagccactgttggtgcctttttgtcgtgtgtgttgaatggtcagggtcccaaatagctgattgggagcactctccttgaatctgccatgtgcctgggtctcaggtgactgggcccctccttgcttcagaacccacgtgcgttgcctgtcctctctggcttggagggttgtgtggaatcagaggtgagacccagtccccagggatgggcagttgcctttgattgcccagctgtcctcagcgccctccctcctgcgcccaactgctgtctcagttgcttgcttgaggatccggatatagactgaggtcggccttagcgtggcggggggttttctcttgagtcttggatactttgttaccggtcccatcttcctgtgggtgggagtgtctgtcttgcttggcccagcctcccagagaccttagctctcttagtacatgggctctgcctaccttgatccccagctcaccaccctagtgcagttgcttcttcgctcttgttccactccttgtcgccatccaccctgtgctttctcgatgtgtccttactcggtgtttctgtggagcagggcatcctgggcttcctttctgatccctggctcctgtgatcttccgtgctgggctccctcttcccttcccttttccactgtgttgccctcacacagctggcatgccatggatgtcgctcacccaagcccttcctaatgttgctcaccaaaacccctcccaccttgcccctgggaccttctccccttccaggctgcatgcaggccgagggcctggcgtctcagcaggaggcagtggggcctttgctggcacctgggctctgcatcctgaccttctgagggcttggtcctttaggtccatcttgaatctcctccaggcttcggactctctgctctgtagctggcccatggagacgggtacactcaggcctggtcttagactccgctgcttgggctgtgctggtgcctttggtgccctcttagtcca

SEQ ID NO: 114327 - DNA, 1086 bp, Homo sapiens
tggttcccagcctcagaagtgtgcctaactgtgccacattcattggaaagctgctttcacacttcctggatggaattctctcattttttcaatataaagtcactgagatgatttttttggagaagtctttaaaggccagttatacatttattgatacttggtattgacaaagttcagttgtttagtgttgctaagtcatactgtgtaagtttgttgagcacagagttttcattttatactttcagaggagaaatgaaactgaatttcgtggccagaaatatgtttgagcgtcatcctgatgtaagaacagaacagaaaatgtggtgacatttcattgtaactctagtatgttttcttttttgtccattagactacatgaggaaataattgacttttataacttcatgtccccttgtcctgaagaagcagctatgagaagagaggtggtgaaacggatcgaaactgtggtgaaagacctttggccgacggctgatgtgagtatgttctttggagttctgtgtcgcacgtcacgtgcgagtaaatttaaataccctgtgatgatgatgtgtcggctagatccacacagaccttttctcgttggcccgaggcagcagttctccaagtgtgctttgagaaggcctccgttgcctggaatgcatggcccccggcgcacctgcacctgctgtcttagacacctgcggtggccgcacatcttcgtgatgctggcgcgcactcaagtgcgaagaccatcggctgagggatttgttgggttttttttttttttttttggaagggggagaatggtgtgattgtttctcttaagttcaccttaaaatttagaaatttcaccctgtcacccacccctgcttccccaccaccacacatagtagcatataatgtgctcatttttgtaaaacttggaagtgttccctcatcacacaccactcttgcagtgaaggaacaagtgttttttgacatgtggagtggggccttctggaatgcttggtgcaggtggcgtgaagcctgcccctggccggctctattcagcagccttccctactgctgactgggctcagtggaccagca

SEQ ID NO: 114328 - DNA, 1038 bp, Homo sapiens
ctctgaagtatgtaatatagaaaaaccatggatgccataatccccttttatttggacatgtatttctccactttttccctatatggatattaatgtttattattgttatcttgttgaacacatcccacaacgcaaacacgtttgtcacttggcttttgacttaacgcttacccttgaccctttcctatgtgtgtaggttgtgttttgtcgtgaggattgccgcattgaagagtctaaggctgggctagaggtttcccggttttattcccattggcgtattcaggggtatttatgtcctcattcctttggtgacagtcttttaaaatctttgccaatctgataaaaccatgtgttaacgcttttaaatttatatttctttaatgattagtggggttaaacacattgctatttatgaattccacaaattttgattgagcgtctgttaggtgagataccattcttactgttggtgataaaatcgttggcggacgggtgacagaacaggtggtggagagcccagctccaggcgcgtgtccctgggccttctcctctgtgtggctctgtgtgctgtccgcccggttgctggctgccctcctctgctgtgtgcaaggcctgtgtgtgtcggggaagcctttcttgtcacacatgtcatactttttccaatttgttttttgcatttgtatttttttattcagctcctatacatttaaaaaaacacctcagatttaatggttgtttttgttttatggcttctgggatgtgagctttatttatttcctaaagatcgtctcaaggaaaacacattggctgatgtgttttgttgttgtttatagatggcatgatttgtgcaggctcttgagtggttttcttggtagcacggtatggcagtgtatcatccatttttgtccgttggatgagtcacattggagacattggcattgtcttcaagtgtctgctgaaatgtactcaaaaaacaaagacccacataatcgttgagttataatataaatctagaaaagataaaactccagtacttag

SEQ ID NO: 114329 - DNA, 1117 bp, Homo sapiens
agcaggtcttcgattatgcctacatagtgctcagccatgctgtgtcaccgctggccaggtcctatccaaacagagacgccgaaaggtaatgggttgtgtgtctgcgtctgggctcagcgtgcctgtgggatggtacttatccctttcctgtgtcatttacctccatgaaatttatgaagggatgttctgccgtatttcagtagaatctagatatgttggtgaaggaaggccttctaggaatatgggatggctgtgtgggattcatccatggttgagagttgaaaatttctttcttggagatttgacattttcttcagggtcttttgttttggggaggtgatttctggcttttaaaattcagtccctaccatcttctcttatgtacactcgtcccttgttctacattttggggcatttttacagtcccaaaatgtagtcagaagtatttacttctcacccagatcattctgtggtagtggaaagggtggtatttgaaggggtgggagatgagataggaatgggaaggaagagtaacgtggtcgtcaagagtggaattcgaaacagtttgatagatctgttctgtggtggatgatggaataaacaggtttcgaggcctggctcagcagccgctgcaggtgctggtggtgctggagctctgtgtgttcctgagccgctgtctgctcggtgttttcaggcggagctctgggccccatgtagggcactcgtctcggtaccgtctccattctcgtccgtgcagtgggaagtgaaatgtcagcactgtatgatcatcgtgggtgggaaggccccgctcccctacttggagctgcatttcacagtggtcttctgtaggtagatgtactgcgatcccagggtatgcttgagctgaatcattaaaagtcagagatatttgtcaacgtattttagctcctttcctactgtccttcacctagcgagatgatctgttaggggtataaggtagctgttcgagaggggttctcagctccctgacacctgttgtactctgttgatctccaacaatgtccctttgcagtactttaggaagaatcatcaaagtaactcaggaggtgattgactaccggaggtggatcaaagagaa

SEQ ID NO: 114330 - DNA, 1015 bp, Homo sapiens
taggaaatcctctcttttttgtggtgttgaggtcccccatgtatagtttcagcagcgaggacactgtggttcttgagtgctgccgtggcttttcacgggggccaggttgactgccttcctgcaagtttcctcactgccccagcatgagactgctgtcgagggtcatcttgagagagcgactcagtcacgacccacttagctgggcgccaagccgtgccagacacttgtccctacttcctctcagaatctcaatgaaagttttaatgtgaacttattagacttttttcatgtttgaaattaggcataatttctaaggctttttctgttggaatatactgtttttaaaatttagataaaattagaaatctaaaggataattttataaatactaaattttgtatctacttgcgattatacatcacttgaatatgtgtgggtataaaacccaacatgttaattgacttaaaaccattttctgaaatgtggggtataatttgagcataaagctatgtaggtacatgcaaaagtgttttgactcatttcttggagttttgcactctgctctggggaagacattctcacaggatccaccgtgattctggcggagcttctgggatgctggctctgtaatgacccacagagctgatgagcagagccatggcccagccggacaccgtaacgtgtctaattgcagcataagtgtaaaattcaggggcaattatttacactcttaaaatgaattataccacagataaacttggtcgcctttttatggtcatcacagtggccctgacgtcctggccatgtgtcacaaaggtgtttgttttaaccacccacaagccttggggcccttgagagcccagtgcggctgctgagctacagagccacactctgcggctgcttgtgtggttcgagtgtgaagtccagggacgctgagggtttataggtttttatctaagaagactcttggccacagtcaatctccagaggttgttggggtaaatgcacgggatgc

SEQ ID NO: 114331 - DNA, 1029 bp, Homo sapiens
agtaacgggtgatgctgacatagaagcagcctgggacctggacagcaggcaaggaaggaactgccagccgtcccacggcctctcaggccaccagttgggccagccttgggctgtgacccctgagttcagcgtgtgagtagggggttcaccacgggggtgacggttgttcttctgatgactctaatgtcttgatcgtttgatcttcaatgagtttcaaactttatgacttggattactgggcatactttatatgccagttgctgttttagaatacgaagtatttccaattcaaagcacaatattgttaggtaatagtaaaacagactgctctatggagcccacatgcaactgtgccatttatcagctgccctttggtggtgctgagcttagaagccggatggttttcctctgattgctttggtacccatggccgtctctcattttgttcctagaccaggtttactatacctccaccgaccctaggggttgctcctgttccttgcagacaagctggtgtagaaggaactgcgtctttgaaagccgtccaccacatgtcttccccggccattccctcagcgtcccccaacccgctctcgagccctcatctgtatcataaggtatagctctgtcctggtgcattcacctacctgttcaagctgccatgtgagaggcggtgctaaatgttttctcctccagagagaattccagagagatcatttgaaaacggaatttgctttgttgtcattcagcctgtttgcttgtctttccaaacaaaacttaaaaaagttaaattattttaagatgtaatatatagtttaattggttgccacaaacatctcttaattcctctgttgaactgattagcataaaactgaagtttgaaataaggctcaaaatgaagacttttcccatttacataattcatttatatgctaaataccttggttttcaagaagcaaatgataaaaccaagagcagatcttgccatgatgtcccgtgtatgctgctgtcattcccacgttgcctgat

SEQ ID NO: 114332 - DNA, 1253 bp, Homo sapiens
gtgtgcggccccctgtgggcaacaggggacaccaccagtataaccgcaccggctggaggaggaaaaaacacacacacacacgggacagtctgcccgtgagcctcagcagataatggctcctggctgcgtcagcctcccccacccctctgcagactgccccgcggcctcggccaccggcaggggaaccgagaccagcaccccgcacgtcagccgggctcgcggcacgcccgccgctgatcactctgcatgtttcttcgtgtggtggtcgcgtccatcttcaagaacagctcgttgtgctcatctgtgaagccttattaaacgtggacgttgttttctgccttcccaggattcttccttcagtgctgaggcaggtcgggctcaggaactgcagggacgtgaacatgcgcttgcggtttgaggtagccgtgtctgttccttcgcggtttgctattttcatttcctgttcgtcaaagcagcagaggagatcaaaccccgttcgtgtgtctttcctccacggataagcttgggaggtcattgttttactgccctcacattttgtttgaaatttcagaactgtttttctatgtaaatattgaaaacttatgatttgtgcaataactcagatattttttatttaatttcctattttcacataagttatatttaagggaggagggaattttttttaaacaagcttaggtcctttcccgagctgcattttctaagttgggtcatcgtgtcggctggttgtctgacgagcatcgttacaaacaccatgatgaggggtttggggttttattttgatgtcttttcttttggtcggaagtgagtgaaggagccaggtcgccctgaaggttttccaaagggcttggctccagagccacctggcagactgcccgtggccctgctgtcgggccccaggccgttgtcctgctctgaccacagagttttaatgttttggttttcacttcttttaaactggacaacaaatccagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagc

SEQ ID NO: 114333 - DNA, 1027 bp, Homo sapiens
tccatcctgcctaaccctgagtttttggagcaccacagttgtcctgggagttggttgcatcttgtaggccatctgacttcctgtttttaaaacgggggtctggtcttgctaaacactacaggtaggttggtctttgaagtccactagtggagaatgtcaagacaagatacttattaccatgacatctgatgcatgtgcagcagtggggagttctagattgatctctgaatgtgatcgacgcccagcaaggacaagctttaaaatgtctgcggtctgcccttttgaagcaggactggctcactctgtcattgggagctgtcagctgcgactgcaggttctctaggaggcattccagaatagagtagcacactgtgtctgcagttctcgatgaccgaaagttatcaaaaatatttaaaatatttaaattgtgaacctattgataaagaatatttataaaaactgatctgtaggcctgtactaatctctacgcattagcaatattgactgtaaacccacattaaggaaaccactacgggtctggcagtgcgtgtcccgtggggtgtgcattttaaaactcgattcatagacacaggtaccatgttccatttccgtcatggtgaagcaaatgaattggcctggctaccactgtggtcgcgtgctacaggtttgacaaaaagatatcatgtttcgatttttttgtgtgtggacaacaatatggaagctaaaattgacatatttttatgtaaagtttttctattctttgatttttaataaactttggaaaccagttttgtgtttgtgtccaagtgtatgctttcaagggcaagagtggcttctacattttccgtattgaatttctaaattagggcagtgctttagccatttattctaaataagattcaagagaaggcagatgattccagtcctataaagcaagttgcagcagggagattatgttgtcactggtccattgaagtaggaggaggtaaaaatacaaaaattagccgggtgtggtggctcacaccta

SEQ ID NO: 114334 - DNA, 1201 bp, Homo sapiens
atgttttttttaaaagagacccccattaaaagagccaggctaaatcaagagacagaaaatattgaatttttaaatgaaaatagaaaagctatttaatatccttaattctagcctagtttctcatatgccctcactatgtgctttagagtattgtctgcatattctggaactgtcaattttaaaggaatacatagatgaagtggtgcattcatttatattctacttgcagaattgtcaaccttgagttggaaggtaaactagaaatagaggagctcttctctagttcaccatctagtacctgctgtcagtcacatagcaggtgccagaaaagacagcacctgagaggaaatctctaagcttgcatacttctgtttagcaccttaagtgtgcaccagagacagctcaggccattcctaaaggccctggtgtttttctttagataacttttgaagatttgctcttatccagtcttcagtttacatgcatttctgtgtttttagataaaatacctttgtgtaaaatattgtttgaggcctaatcagaactaagtctagagaattgaaaccatctctgggggaaattaactgatgtgaacgggaattgaacctgtcatcgtcgccgtatcactgctctactcttaacatctagtgatttaaataaagcaagaaaaatatttaattacatcagatatatgcatttaccctggtggcagtaattactttttgtgaatggacacagctgtgaacctaggggcatttacttcactgtatttagtcttttaacccacatggtgtctggaagatttaaaataaccggaaagattttcttgactgactgactaaatgaatataaaatattggttgataaaagtgacagtggtgtggtatttctgtaactttgtacatttactttatcaatatcgcagactcagggcttatttattaatatctccttctggggttctgtgggcagttataacctactgcttccaggtgagcagggttgtctttgtgggttctctctctgaactgttgggtacactctaggcctagttgaccgataacaaaagggttaacaaggatctgggttctgctaaaacaaacatgtaaactaatgtggccattaactagcatatgcaattgaagcagcatatgaggaaatgttattccatataaaaatagtgtcaccttttacattaatt

SEQ ID NO: 114335 - DNA, 1053 bp, Homo sapiens
aacaacacccaaaagaacagaataacatgaagtccatttcccattttctcagaaacaatttcacagtaattccaagagctgggaaaggtggaacatgcgaacagatttgaaatgggaggtttgtaggtaaacatcacagtaatgaagaaaggagctttcagtacccttggccactgttggaaatataacctaaaaataccactggtttgaggttccagaaaaacactttattgaattctttttatgcatggtgtatataaattagaatgttacaaatttggtggttgtattgctgcagtgtaattgttgaatgtaacactatgtaaaataaggatactggcctgatatgaagaaagaggttgcccgcaaactatagtcaatatcaccctgccttctaagccaccaaaggaaggaagagtgcattttgtttcgcacagatccatgttaagaagtttttgtttcattttatttctttgaacattggcaatccacttatagcacgtagaacttatctgttaatcaaaatattcacttaagataaatccatattctccttccctgctgcataagagagttcattgttctcgggaaattcattttaccagcatttgccttgaagtagaaggcattctcaggccatgatgtatcacctaattaaggaaatttaattaataactgaaaattatggatggtattccttaacacattttcaacctgaagtgtaatcactaatatattttgtaacttttgttttgaaacaataacagacttaccaataagttgcaaatagagtacagagaattattttttttgctaagccatttagaggtaagttgccaatctgatgccccaccaccccaaaagctttagtgtgtattactacagtaccattctcctacattaactacaagacacctgcaaacactgggaagtccacattgctctatgactgctatctgatgcccggaccctgttcaagttcctccagctttccctacaatgtctttcatcacaaaaggacctagctcagaagcatggcatgacacatggcaa

SEQ ID NO: 114336 - DNA, 1034 bp, Homo sapiens
tcagcatttgaaggatgtgtgggtgctcactgcctggaatgtgatagtgaggattgggggagcccacccagtgcagtgacatcttggcagggatgaatgactgatgtcatttattataaacttgaacctgaggtcactcaggcagtgtacccaaaattttcatctctgttatgcctttgtgatacaaaatcatatgaaagagtgaataagattggatgactgcttgaaagttatatgaaactgtgtaattcagcttgcagaaattaagttccctgcttcatgtttatacctcacgtgattactcatttcaagcatactgtctctttccgagagtaatgatgaaaacattgaagaaaccatcgatccaattacccatactgatcccagaagtataaagaaaatgttaatattcttgtatgtcttcttttcatatttggtatagcttgatataaagtaggaagtctgtatgattttactgtgctctcagaatagggatttttgttttgttttaatgcaagctgggtttggaaggagatttgaaacttgtgtttggctggtatatgatgtagacaggcactagagaatctgatatttgttgatattcaaattctaagtcctgtatgcgtgttgttttgttgcattgttgtctgtttgtctgtctgttttttaatagaccaggcatttggaaagacctgaagaccatgggctctgtgtctctctctatattcttcatcacactgcttgttctgggtagacaggtaagaagtctgtttatatatatgtatgtataccttctctaaagtgctgtattaatagtgctttgctgtgcattgtagttaatcttcttggaaacaaacgtctaagaattagaatcatcttatcactgaagataaaactagttagtacagggtgtggatgcttcgatatagacaaaaggaaaaatatctttcgtattttccacaaaaggcaaatgttatgaatggccaaaattttaatcagttaatttcctgttaaatctcaaaacaaattttgta

SEQ ID NO: 114337 - DNA, 1064 bp, Homo sapiens
cgtaaaggacagcagttcataggcttcagatggtcacttctcttctctttacgaagggaactgcagtttaccagaggggaaggacagttcggaagccttccgtgctcgcagaccaggtgtctgggtgtggcatgctttctttacttaccatggaggcactgcaagttggaatgatggaagttatgagttgcacagatgtctaatgtcttaactcaagggttttcttcacagtctggattgaaggatctctgccacctatcataaggggaaagagaaagcatgcatggttcttgtcataccccagataacttcagaacccattctgtggtttagcgttattgagctttcttaatttaaggctgacttgattgatcataaagccaattgaattaaaattctcaccattgtttggttgtggtcattactttgcagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggtacaggaaaatgttgtgtttttcacattacaagactcgttgaggctaataagcagcggtatctttttctcaagaaggtgaaaaaaatagatatgattctggaaattaaaatactacatttcagaataccatgttgggaaattccttgtaatattttataaacattaatattaataagatcaaattcatgattcatttgaaaataatattggcacatagtaatagccaaatcccaaataaactttggcaactaaaatatataataaatattttggattatttaaaaaattaagtatttttctccttttttatttttcaggatagcactgtgtattgatggtccaaaaaggttttgctccaatagcaaacacttactggggaaagaagctattaaacaaagacacctacagttactcggttatcaagttgttcaggtacggt

SEQ ID NO: 114338 - DNA, 1092 bp, Homo sapiens
acaattctcagttctaaaaatgtttcttgaactgttagcattattatgtttcttctcactctctcctcactcctttttaccttccttctttacttttctttctgtttatggtaaccagtgactactgtaaaaacacatataaaagacattttgaactattagacttgcactgtaagaagagaagtttgcattatcattttgagagagatgcctgtcccaattcctggaaaagtatcatgcctataaagtaatgttatatcaaacttttctacctaggtaaccttcaatttattctctgttgttatatcttatttttctttctcacatttgcacttatgattttttagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaataggtaagtagtataaggagttttgttgttttaaacctaagcatcctgttcgattttggagatatatgggacttagaagcaatagaagttctctggaaatgcaaaatggaatggtcccttccctgaaggcaagttggggttagcagcagagccgttgagtcaagactgtctgggtttaagtctcaaatattagccacgtagtagcagaatatcctgggcagaatatttaacctttttctgcttgcttcttcctctgtaaaatgatagtaatattgacctcaaagacttacttaaggtctaaataaaatagtacctggaacgtaggaaatgctcactaattgttagctactactataacctaggcttgtactgtccaaatatagtagccactagaccatgtggctatttaaatttaaattattaaaagtttaagaaaattcaattcctcagtcacattgtaagtgctcagtagccacatgtggctcatggctgccaaattggacagcaccattataaagatttccacatcacagaaatttctcctggacagcactgacaagagactccaagtcc

SEQ ID NO: 114339 - DNA, 1058 bp, Homo sapiens
cttatgaaaagacgtttccacccagttagctgctgttcctccttggcagctcatcacagtgcctaggtgcctcatcttggctcttagcagtgctgatttgccttgcagatttgagctcatgttaatgtttggcccatgactcagtggcaaagagttgactatatcctatttcctctgatttttctaaaaatgaaagactgggactagatggaaacctgggatgggtactgtctgtgcctgtccctgcctttcgtacacaacatgaagagaaagacgtgttaatcccccccaacctcttgatgagcatcaacaaaacagacgcatggtttccttgaatgacatcctgcattaggcaaattgattaagctgagagcgcctagtcactggactggtcgtctcaaaaaaactggcaaggaagaagattgaaatacaagacaggaaactaagctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctcttgagtagcattttaattaaggatgcacctcagatgcagccatgaaacattttcagaatagcagtggctgggcctcatcctaaacctactgaaacagtccttgaagaagcaacccctcatgccattcctccatttagaaaagcagaacaaaacaaaacactcccaatgattt

SEQ ID NO: 114340 - DNA, 1068 bp, Homo sapiens
aaaggctcctcagggcagctctaatgtgtaaccacattttgagtagtgtaccacatgagcacctcccgagcacagtgaaatgacaacctgagtcataatgacacacgggcctgaaatctgcctcctcttggtattcatttcgctttaggaattagaatttaattgatcctcctttgagctgtgattaaaagtggtgttatttccacagccctgccacagtcttatccactgactctacttaaacttctctgttcagggaatggctgttgttatgataatttgttagtagtaggtggactgccacatttaaaaaatctatttatgatgaattcaactttcccaaaggagggttgctttttttttctcctgttgtcagcctccctgggaattttactaaaataaaaaaataaataaaggctttaactatttatttagtccaaggacttggcattaatccatagtgatttcttggtgatattttaatctgtaggaaacagatcagtagatcagtaaattggctaggcaaaaaaaaaaaaaaaaaaaggtgcatttgatggatggaatgagcatttgcagcattatggtagccttggattttggttaagttctgttagcattagtatgcctatttaaaattatatcttcttaaaataaagtttaccaattctggaatattaggaggaattctattcctgtcatcctattactagaatatcttcctatccctcttcatttcttctacctttatacatactcatgttttcagctacggtgctaatgaacacataatatatcctgcttgttaaaacttaatcatgaagtattttttgtattccgaatggtcttcatagtgtttctaacaagtgcatactttgccaaatggacagactgtcattatcctgttctgtgttcagatggagaacttaggcatttgttttgtttttcgtttgtttttactgtccagtttagaacttgtggttgagccgtggattgctggactctggccagccctcagaaagcattttaggtcaagcagaggacaagaggagataagtggcgcactcccgg

SEQ ID NO: 114341 - DNA, 1042 bp, Homo sapiens
taactatcatctatgaatctttttatgttgtatttgcatttaaatttttgttttctattgaaatgagggcttaaatagggctttttcttagtctaaatagggctttttctttgtcttacttttactagttattaactacgtagcacattccacagtgatggaggtgactgcagttgaccttgtgttacccagctacacattgctgctccttctttaattggtgacagaaagctaatgagagcgtaggattccccccaaccaccacttgccacttcctacagttgttaagatctactttgtgtaatactacataactatttattgctgtaacagaaagcttcaggaaaaatggaagggttttggtaggtaataatcaattattatgtgaacttggaggtagaataatccactagatgtcagtattgtaccaggaactgtttttttaaaactacttgtaactgatttcttctaaccagctcccggaagtggccattaatggatacaatttttcaaatgtgccttgccacacttgtattgtcagtgagcataaagagtgttgtaattaggccgccatctccccagtgtggttttcgtgtcgttttattaatgtgtttattgcatttctagtcttgggtgagtaaagtactttagagagaggctcagctctctaaataaatatatgtatatttatatatatatagatttatatatatatatattccatcttcctttcctggtaatcagctcgagatgtaatttgagtatttagaattaatttactgtaatgaaagcttaccgattaagtcacaattttggttcagctctacccttttaaaatttgtgtaaagtgtgtgtgtatgtctgtatatgtgtatatatatgtgtgtgtatatatgtgtgtgtatgtatatatttgtgtgtgtgtgtgtgcatatatatatatatatatatatatatatatatatatatgggttttttcaaaaatagtatgctcattggaaaaattctggatacagaaataacccaggaaaccaaagtattt

SEQ ID NO: 114342 - DNA, 1039 bp, Homo sapiens
tgcactccagcctgggcgacagtgataccctgtctcaaaaaaataaaaaaaaagaatatttgatgagcactggcttataggattctccctgtggccttcattccattgcacagcctctaccgttttcccgtctggctctctgttttgcctttcagtaataatacaagaaggtgcaccattcttttggttgaaaggggaattaagaatgaactcaagttctttcgcattatttaccgtgtaatgtgaaaagaaatctacttttgtagggatgtcttttaaagatgtttttactttgaatttttagttttctcctttctgggtgtatacttcagtcactttcaagttttatgatcttaccagtagataatgtatggatatttgttagaatttatccccatttcttcacatctttataataaatattgagtgaatgaatcctttacatgaagatccttagggcatattagattttataaatatcatctagtcctagtgcaagcaaataaaattggaaactttcttgaataacaaaatgtagggtgtgagagtgtgaaggttgggggcagtttttaattacgtaataatggctttcctctgtgaggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactgtcataagaaaatttatgctgttcttgaattttaa

SEQ ID NO: 114343 - DNA, 1054 bp, Homo sapiens
tagaagcacttcaaaaggacctggcacatagtaagtcctcaataaaggtgtctgttactaactgtatgtgtataaagacctagaagtgtgcgagagatctggttcccttcaggagcacgagtctactgtgtgctttgagagtggagggcagggaatgaggggtgagccagcaggtgggtcggagccaggcaggacctcagatgcttctctgacacctaggaaatccttggcctactgtcgggacctggagcctgtggaggattgggagctgtagaaccgtgtggtcagctctgtctcctagaacagtcactgtaggcaaaggcctggcctgggcatgagtgaggctgggagatctgtgtgagatgttctgagaagacggagggaagaactatggtggtacagtcaaaaggaattagacttgtgaattaaggaggatttactaaaaatgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctcttctgagctaaggcagccttcagtccctatcagcgcctcctttacttcccagagaacttcacagagactctgtccttccatgcaaaggcttcctgaaatagggagactgactgagtagctcattcttgtgacttacagtgccaacatttaaaaaagtatgaaaatgatttatttttat

SEQ ID NO: 114344 - DNA, 1048 bp, Homo sapiens
cacatttcatgattttcttcatgtaagagcaggacacagtccctgctgctctcttcactgggaagggctgcaaagctggagatgtggtcacagcacagttggcgtgctcaacagaggcccctactctcttctacaagccattacacacaacacgaagtacaattaacctaaaattagcccctcgtgtatgtgggctttgaggattggtagaattactgatatattgagtgaattattctaagagactttatagcttcacagagggggaattaaaacacatgtcgttatgtagggaaacatggagagttcagacaaacatggcaacacttcttattacattttgtctcaataaaaaatgattttcatggcctcagatagcatcttatataagaagtggaagggcgttacagggctgattcaaaataagacttcatgtttttatgttgttttatttatttccttatatgataggaatgagaaaggactgaatcatattttgagagaattgttatggaatttggtaataaaggggatttttgtcactgaattgctcaaagctgttttgagattatttttgctatagtattattaaagccacctgtgatccagctaaaaacaaagacctgtgaagctccacttggcttcaggtcgtggtacttcctggaaggcagtcaccatcctggacaactgctttggtctggggtgctatagtgatatagataagtgattgactgaacttgccacagaatgtaaaaacaagatgatttcaagaaattgtcaccaatgcccacattttcttcaccacattagcgatagcagcataatatttttactctatcagctttaaaaatcaaccaatgtgtagcaactactccacctgttggtattggagattataatgccagaatatcaatcttgatacacagcccgtaatgtcatcaatttattttctaatcttcagcagtactgacatttgaataatttcagataaatccagagtaaaatttcctagcttctctcctaagctgaccctctggaatcccaccaa

SEQ ID NO: 114345 - DNA, 1050 bp, Homo sapiens
ggagttccaggcttaaagtatcagtgccagtcctggagtgctactggcagttgcaaatggaaacaaagatccttaatggaaaaggaatacctccaattagacctaacaattcagacatctaccacaagacgtttctaaactttcacaaaggcagcaaaatccctggatatcagactgagtagaataagaaattagaatttaatttctttagactgttaacttgaaggagcaaggcacatgaatcttaacttaaataaattaactttcaaggtgatttaatctttgaactttaacgtctttgtaaaattttaagaatgggaggggtttaagatttaaatttgaagtcagaattttatcattgaaatgtttttatatattttattgttgagtttcttaatgttgtaattggaactctttacagaatcactggtggactattttgacaatatggtatttggaatgggaagtagaataatatttttttttaactttggatcagtataagtccgaagttattttaattattgtatttttcagacccatttcaggagcttgtgtgggacaaatccatgctgcccactactgtttccagggaaaacctaagtgaaatattccaggaaacagggtagtcaccaggggattgaggttaggaagttgagagtaggattgtcatgatggactgttcttcccttcacagcaggtagaggcccacatcccaggtcaccacaagcttttactttaaccccagtgagttgagagaatgggaggctggagaacattggtgggggtaggtaatatactgaaagggagagtgaatatttattatcctgccttggtgtttcctttcatgtgaagatggctctttggagctatcctatggtgtctctcctcccgctcatacattcctctgtatgggaaagtaggagaaactattctgatatgtaagactgatctctcaggatctgctgtctgcagggaccacttgctgtcctccactgcccccgctccacctcctttccaccgtggggatgcctaagctccagccatggc

SEQ ID NO: 114346 - DNA, 1049 bp, Homo sapiens
atccaatcacctcccatcgggccctaccttcaacactggggattgcaactgaacatgagatttgggtggggacacagatcaaaatcatatcagacgtttccctgattactaattttaatctattttcttaagttttgttacataatgagcaagggacttattcaccaaatcactttgtaagccatttgagcccaacagcagtggagggaagaggtgtcatagagttacattgggagaagttgaaatgattgaattacataattacaatatttgcagtgatgacatttgacttttttgatttggaagtaatttttttgcttcagttttgcatctttttttaaaatattgtctaggggattacatttgttatttgggttgttcctcttggttagaaactctcaccttctgggtaggtgttgtattgaaggactatgtgtcctgctgtatctcttgtggcttattaaatccaggtgctattaagcatagttattgaatttcttaattttcctgcccctctgctgaagtgctcctgtagtttaccatgcttacacagtcaggttaatgaggtacttgccctttgagatagctgttatcacaaggagcaattatctcactgtggtagggtttaatctcccaggtcatctttcacaccgaggtaggaaaggcaatgttgctactgaagagctccttaagggggcctctctagattccagtagaaaattaaagcattgtgtgaggcttttagtgaacgtacttcctgtgttacctcaaacctgatccgtcaccatctattctgagtaagtatcccaagactctccttagatgtttgcaaggaggctctggagtcagggcaggccatgaacctgcaacttgagcaactgcacagggccccatggcagaaggactccaggcttcatttaatgctctgctgtttttatgctgagtcttaacaatttttaaagaagggattctgcattttcattttccactagggcctacaaattctctggttggttctgtctagttgaggcctgggtaaccttctaaag

SEQ ID NO: 114347 - DNA, 1085 bp, Homo sapiens
gtgatttcatatattggaactgaccttgggcattgaatctgaggtggattctcagttggcaaagccacccttacatgattctttgctttccatttcatcttacccttcatcattacagccctagcagctgttcaccttttactcctacatgaaacaggatctaataaccctttaggggtttcatcagacccaggcaaaattaccttccacccctaccacacaatcaaagatattttaggtttaatttttctcctcctccttcgaataactctagtactattttcgcctgacctcctgggtgacccagataactacgctttagccaaccccctcagtacccaaccccacattaaaccagagtggtactttttgtttgcacaggcaatcttaccatccatccctcacaaactaggaggcatactggcccttgtattctccattctcattctaacagttattcccatgcttcacacgtctaaacaacaaagcataatattccgactgttgagtaaatggctattctgaatcttagtggccaacctatttacactcacatgaattggagggcagccagtcaaacacccttttattgtcgtcggacagatggcatctattatgtacttctctaccattctcacccctatactactcaccggcctaattgaaaataagctacttaaatgaaggtgcccttgtagtataatttaatactctggtcttataaaccagaagtggagactcccctccccaggaaatctcagggaaaatgcgtcccgcttcactgtcaacactcaaagctgaaattctaattaagctattcactgaattctttcttgcacatactttgactaccacgtcactactaatcaattagcactattacattagtgcttgtatgtacttcctgcattactgctagtccccataaataatatatagtactataattgcttgattgtacatagtacattcatacataacaatacattataaatctagctcacatacatataagcacgtattaggaatttcttaatcaactgtcataaatctagtattaccgactgtacacctaaatataatcc

SEQ ID NO: 114348 - DNA, 1019 bp, Homo sapiens
cctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttgaaacaaagcacagtatgaatctttaacccaagcacttagtttcaccactgagattctacatcatctgcaagaaaatgcacaaacttttggtccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataaga

SEQ ID NO: 114349 - DNA, 1044 bp, Homo sapiens
ccatagaaagaatgaagtttgcagtgtgggaaacctaagaattattggtggtatcctataaatctgtttatgaagatgtaggattttactaatttataggtaatgctgcatttgttaagacctaaagaccagcacttttcaaacagaggcccataaactgcacatgatttttgtttgtttgtttttttgagatggagtctcactctgctgcccaggctggagtgcagtggcacaatgtcggctcactgcaacctccgcctcccagattcaagcaattctcatgcctcagcctcccgagtagctgggactacaggcacctgccaccatgccccgctaatttttgtatttttagtagagacagggtttcaccatgttggccaggctggtctcgaactcctgacctcaggtgatccgcccaccttggcttcccaaagtgctgggattacagatgtgagccaccacgcatggccgagctgcatgtgttttgagcccatttcagcaaggaactccaggattcttatctggccaggctggctcggagtgagggagggaagggcagtggcatatgacattctcaatccagaggtgagagcatccccacactagaggcacagagggtccaagacaagggtttatggctttcctgtcatgtggttttcattccaagtgaaagagatcacacacgcgttgtgcctggcttttcacatgactgggtttatggcattcattggggctttttcatttaagaggcagcattcaaaagatgccataataaaagatgctataaacacaagaaaatgaagtcatctatctttctagtatttgttgatgtagagatcatgcaggccgggaggaatgcctagagagtattaaatcaaagaaacagcgatgatcgccttacatattttctgttaaaagcctatgatgtcacaaaaatcctgagtgttatccgctgtaaaaaaaataaaaaataaatgcattgtgagtaaagaaagctagttagagtatttaaaacagtacaaaataaagattgtattaggttcc

SEQ ID NO: 114350 - DNA, 1025 bp, Homo sapiens
tttcctgattattatagcagtttatgaaaaagaaagaattgattatttcaagttcaagtatgcatcggttagaaaagactcaagaatctctgcttctgccaacactttaaagctgaaatttcatgaaaggattttcccagcttcacttgtgaaatttctacatccttgtcttagactaagtcaccaagcctttatttgaatctcaataaagaggcagtgaaggacccttgccaagagctattagttctctccatgaatccctactcgtaaattgctcaatgtcaaaagcttgggaaacccagagccttggattagttcggggagctgattgacagacacagagggaggacctggatcttgtgctgtcacttaactctgtgaacttgagatgcattcactgccctctgggcttctgtcttgctctgcaaagtgcagggccagaccctgaaattgatgattctgtgaccctggcattccttctctggaccctggggcacatgtgtccagctgattgagggaccacttctagcaaatgtccctccctggtggctcatagctccagtgagctcagaatgagacacttaaaacacagatgtttactccccacttccaagtaggctaaacccacaggagcatctggggtcctctggtccttggtgctgctctccaggtctgcatgtcagccctgcatgcctgtggcttcacagagcgggtggaaggagcagggtggtgggtcagaggggctctgcctctgagtcactgtgagatttgacctgctgttctacttctccacatggttgttttcaaatgaaatatgaagcatgaacacttgaatgacagagctgtttagaggattacatatagtacctaatatttctatatatcctagcccagtgccaagtctaacatagacatttataaaatagaaatgattgtcactgtcatatgtgtgtttccttttaaccctattttgacaatagtaactgtaacaattgttgttggatgaagacttgcaaatcccaact

SEQ ID NO: 114351 - DNA, 1021 bp, Homo sapiens
aaaaaaaaaaaaattgaagagaaataatatgactcatgataaggataaaggaggctttggatatttggctgacatttggaaaaatatgtagaagtatagaagtatattcaaacactgaaaaatagaactaatatttgtaaaattgtataatcaattctttttgaataacgagtggtcttttaaattgtttggcattcttctgagagcctacaaataaatttaaaagtagaatagcttaagcagtatataacttgggccttcatgctaatcccatgctctaacttttctttaacttatcctaatataactatgggcttatttgattcaagaatgagaaaggaattccaagtaaagctatgctgactttgtatctgtaatctgctttatctttcaatgtttatgttcacaagataaatgccctacctagatattttctgtatactcttatttttgggtgtctgtttgaagggttttgtttgtttttcctttaattggctgcacaggaagatccatcctgcattgtgagtttagcattttcttcattgtctgccatgcatcccattgtctgtgcacacacagcatggccagcaccacatctgccttctgtatggtgcaactgctcaaaatacaaaaagctcctccacgcagagcatgcccatgtgttcaacatctggtgcagggatggagatggaaacgtcagtggtttcaagtggcactaattagtttccttgtcattttggtttcctcattacagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggtgagtagccttcttctcacacccagcccacaatccagaaccaggaatacagactcaatacacacaaaattctctgcacacactagatgttctgcaaacaataaatgttctgcacacac

SEQ ID NO: 114352 - DNA, 1027 bp, Homo sapiens
aggcaaaccagggaaattcatctcatttgattttaaaactgatatagaagcgggagggataaagagagattgattaatgggtacagatacagacatagatagaagtgagacctggtgttcaatagatcagtatggcaactgtagttaacattaattgattgaatatttgaaaaaaatctagaataattcagatatttctagaataaagaaaacataatattttaggtgatggatttctcaattactgtgatttgattatatgaatgtatctaattatcacatctaccttgaaaatatatatatctaatatgtttcaattaaaacaattaaaaaggtaaatctaaaaaagaatctgatattgagcacacatgctagagtcctttcagtctgggtgcacttgctataccatatccaggagttaaacgagttatcaactgatagagcatgggtaagacattcataactaatgaatgtgaagctagagtccttcctaccttacttgcagaatcagtttgatatccttccaggcttgggaatccaggtttggtggtaggtgtattttcttttactttgattttacatgaacacatgcaaatgggaggaaaccagccaatggctgtttgaaaagtcagtttattttatttgtccatattgtctacagatccatgtgagctagacttctcttgctggtgtagttcatctgcgtcttgcctctttggtggcatttcccactgctgccactatgctgagtcagcagtcttccccagatacattctgggtccattttcatgctactgccctgtatctctcctggtgtccatccacccagggccaggcatgttatctgaatcatgactgtgctaatattttgtaagttggtttttgaagattttctcagagccagagtcaagtggaaatggtagaatatttatgactggagttctgttagtgacggagtctcatatgctattgagttctctacaaagacaaaattaaggtcatgctgagcaatcaggtattctgggag

SEQ ID NO: 114353 - DNA, 1051 bp, Homo sapiens
caagatatgagttcaaatctaacatgaaaaggatgctaaggataggggctgcagggaggatggagaagcagacatgtttgcatacttcaatgatggattgtggcttacttgatttccaagttactttccagctagggtggccacagccagctgtgggtgtccaggctgccggctctggtaacctggcccgtcttccctttcagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacaggtaggagctctggccccctctgaggggttttctaccatcttctgattttgtgttttagatttagattctaaacattcaatttcaatttcaagctttacgcctgatgtctctttttgcaaccagcaaaacccgcgatgctcacttatcttcctcagcctctgtccctctttttggaaatctcaatctattttcactatattggtcataactttaattggaaagacaatggcttgtttctttgctattattcctcaactattcataaaataagtcttttcttggcaagaccatttgaatttggataatttaagacaaaggtatgctttgttggaagatgttgttgggtgaaatattatcttgggattgtcatggttatttctcatttgttcaaaaacagtgccttcagcaaaatatttgcgtggatggtggtacatggcagtgttcaaagaatatgttttggggcataaataatggaacatttacagcaaatgtaggcagtgatactttcaaattacaaatgacaattaggtctcttcagtttccaaagcaactagagtgtagaaagcatgttccatctcagttcattacacagacggctctgggtgtgtgaggccagctgtagggacctggctgagctctgtgg

SEQ ID NO: 114354 - DNA, 1024 bp, Homo sapiens
tggtcttatttcaaagacagggagacaagatttggagatcacccattgctgtatgtgacctgagcttttgttccctgtttcattttcatgtctctctttttcctttaattaaatgattaattaaaatgtaatgtgttttcaattcacttataccactattggcagagggactaccctgtgataagtcatggagaataactgtatggactgcaattgggatcttacaaagaaaggaaccaattgctcattatttcttttctctatgttagtttacagctaatgtggccaccaacagtattactattttttatttaattatgtattcacttttgcaaaaagtacctacccaatatcccctccacctctagcctaaacattattactaatttggtttaacagtttctctagttcaagtactggacatagggctaaattagacatatggcagatcaataattgatgtaaataagcctccattttggaggaggagaaagaaaagtaaaagagaaattagatgatcaaataacacaagtgcaacaggcatgaaaggaaaattacacaaacacaaactgtgacaaaatatgcagaatttaataacatgtattagatttattcctactgttaaaaagcagcaattactgattgtccatacagtgagtataaaagctggaatgttgaccattccatgttcaaaagttcaagtttgtgtcccttggtgataacttcctcttggaaattaaaacaaagggaagtttatttttcatatggccctgggtgaggagatggcttcttaaacccttaagaagtaaaagacactcaaggaagacattttctcagaaggaggcagttacctggatggctttgagtatttcatttcaagtattcaagaaattagaaattataaaccgtgttgacaaaaagatatcagatgccacctccttgcactacattcttccaggagagagagagagagagacctgagagctctctagcagctcacgttccagttgacaagataagattt

SEQ ID NO: 114355 - DNA, 1049 bp, Homo sapiens
tgcctcttagatacaatcacatgtgtttttagaagagagatgcagaagaagattacacacacacagaggagcaagccatgtgaagatggatttgagagagatttgaagagatgggctttgaaaattagagtgatgcaactacagctaaggaaagctggcagccactcagagctgcaaggggcgatggattctcccctaggccctcctaggggagcatagctctgctaccaccttgagtttggcccattgatactgatttctgacttctctccagaactgtgagagaataaagtcatattgatttaagccaccaaattgctggccatttgttacagcagccacaggaagctaatatgcatggctcctctttctcatatattgcaggtgggcaggtctcccaggaagcccaacaagagaataatatcctctgggtcctgagtgctgtaaatgacccaagtgcccttaatcagtggcctttaatgacattgcactgtgcctgagagctgcaagaccaatttcttctttgcaatcatgagctcaaagagtgacgtcaagtgcaggctacttgcagccatcttgtcaccatatggagtctttccaagaagaaggcccaacagaggccattgtaactaggagtaagaaccatggaattcttacagcatactttgactccctgagtttatgcttgaatctgtgcttttgtttttggcgtaacctagttggcattgagtttttatcacttgccagagagcctgaagggcttgcgtaatacgattttactcctgtctgctgctcacattaaaacttctcgaaacagatttcaatgacgttgcacattttgagacacctgatgcttatgaattcgctgcctaaaatttatcaactctgagataagaggctgtctttagaaagttgtctgtgatacaaataccaagtgtgactttcttctgtttaaaatactaaacattacctttggtgaaggaagtcatttagctcatgtaactcatgagaaacacttagcttgttaatatagttgtcaaagtttttct

SEQ ID NO: 114356 - DNA, 1443 bp, Homo sapiens
atttgtttcttttacctcatgtcataataacagattcaaatcttcagtataagttttcttcttgccttaatcatggagattattttataagaacaaagctttttgaaaaatataaaaatggagctggcctcagactaattcacagcatttgcccatctgggatcctaccgcagatggctggaggtagatgctcactgaacagagttcaaaaaacacaaaggggctggagctcatttaacctcactgtcttactaaaattcttttgggaaatagctccaaatccatttttatattgttttgtttctaacggaaataaattcactgcttgtttctcactcacaaatgctgggataagcagaaaaaatgaaatctgtgttccaatttgccacctgcctctctatggtttctaaattgaaaacttaaatctctctgactacatgatcaatatcggtagagaattctctccaaagttaaagtggatattaacttctttcttctttttattttattttattttattatcattatactttaagttttagggtacatgggcacaatgtgcaggtttgttacatatgtatacatgtgccttgttggtgtgctgtacccattaactcatcatttagctttaggtatatctcctaatgttatccctcccccctcccccgaccccacaacagtccccggagtgtgatgttccccttcctgtgtccatgtgttctccttgttcaattcccacctatgagtgagaacatgtggtgtttgtttttttgtccttgcgatagtttactgggaatgatgatttccaatttcatccatgtccctacaaaggacataaactcatcatttttatggctgcatagtattccatggtgtatatgtgccacattattaacttctttcctgtatatctgggttggggggattgagtttcaacgtgagtcaatttttagactagaagttctcaacttccgacaatttcaccttctgggaatatttggcaatatctggggacattattagttgtcacaactggtgggggaagctttgactggcatctagcgtgtagagaccaggggtggtaccaaaccttctacaatgcacagagcaggacccccccgttgagcgaaatttacctgactctgaatgctaacagtgccaacgttgagaaaccctatgttccttgattgttgcctcagtttccacatgttttaaagaagccattttctaatctgtgatattaagattacttgattgaacatataagatctttgatgtgcttagggaatttttcggtttagatttctatgtatatatgttgaatatatatgtctccacatatgaagaaatctaaacactaaagattcatatgtgtgttcatgtatatatatattatatatgcaatatatatattgtgtgtatatatatacacatatacatatg

SEQ ID NO: 114357 - DNA, 1020 bp, Homo sapiens
gcaataattagactgacgaaaatggtttattgagttttgaaaattattaataactttcatgttacttttgcgttctagggccactaattaaataatttataagattgaatatttatattttatcttcaggtaaaatttcaattgttttttggttgatttatctcaatagggagatagtttttattattttaagtctttgagtggattgcttgtaagtaaagttgtgcaatttgattgagttaaaactgggaataaggatttgtaaagttactgttagaattctgatttaaaatagtgtttccatttggcctcaaatggtacgttattgtattttatctatctttaagtatattataatctttctaagcattaaatgggcaattcatctgtttgtcatactgaaggtagataaaaatccttattttatgtacagaggaagagttggagattaaatgtggggtgagtaaagttttaattaggcagtatctttcttggattatgtcctcctttcttctctttatatcagcacaaggtaagccaccttggttacatttgggagacaaagcttatgccatctccagtggatagcagtggtgatgtctctctgttaccaacaaaacaacagaaaaagactgcatgaaggtttccaaatcttatttactttggtttttaatttaatcaacactttaaatttgtattttcttgaatcttttttattattgactaaagagaggctgggaggtaatctctagctttattctttaatttctcttttgctctcccaattccttcatatgactcaggggcaagtctaatcacacatgttccatgagtgagaaagtgttcttattcatgattaagagcctgccagactcatgctgtcatccacagtgatgttgtgtgctaaagcaccaaaatgaatggattcctctaatccccagtgtaaaaagtcggggtaacactatttgacccatcctaccttgaaaatatgtctgggtgtgccttagagaggctgcaaac

SEQ ID NO: 114358 - DNA, 1048 bp, Homo sapiens
ctaagattactcctgcctgcagaatcaggcagggccctattgatttccattcccaggtcccagcgatctttatctttaactccttaatgttcctgtagagtgtcctcctacttatgggtttattgattggcctgagaattgttctgaaacttaagcaagagctgcatggactcgtgatagaggatttgcaacatttagctccagtggcttgggaagggcatggagggaattgagatgactgctccagcttgggccatcaccgggactgggctagggggttgcacttggttttctgctgcttccctaaggaacttgggttttaacagctgcctttatccccatatgtagtcttagatgattgaaaaaacagtgactgaaagtgaccaattaggattttaaacttgggttttattcccatatcacagtatgaatgattatttttcatggatcctatattttcctttcaaaacatatcattatattacattatatttatgtgtgtgttgcatgcattgctttgttaaattttgacaggaagaatatctgacatgttttgtaactctgagttggctctttctcgtattcactcactgtgcccccagcccctctcctagtctaagaagctctttctgcccttctctaatgtggccatgtgcatattacatgttgtcatcataactgcccttcttgcctgttttctggcctcctgtcactcttcccttgaccccgtgctgtcttgtgggccactggcattgctcagcctgccacctgctcctcctgcggctggagaaggcgtaacacggacagtgtcaaggtacaacaaactgtaacctctcagaaaatgaaggcatgctggatgagtgaaggagatgtttctgtgctaggctccatgtgtgtccacaggtccatgtgtgtgacatggctccgtgcatgtgtgtctcatggctctatgcatatccatgtctccctctatgtgccatctaagtgcctcccatggctgcacgtgtgtgacatggctccatgcatgtgtgtctcatggctccatgca

SEQ ID NO: 114359 - DNA, 1084 bp, Homo sapiens
gtatttgtagggtttccacatatagacctgtgtttgcgcaaggggttaggacaggtgaccaagggaaatccggccaatcccaactattaatctgcattccttaggagtgagtgtgacgacagtacagcttaagcttgagcatttctcgtttaaaacaaatgggctatgtcatgcaattattgggagaatgagaggtctgtattgagatacacgcactcacgcatgcattcatacacacacacgacctgggatatgactagaaaaatatgctgctctaagccctccaagctctcctctatctccacaaagtgtaaccttaaagttagtgaggaagttttaccagaagaccacccaccagaaaacgaactcacagtcatctgattcttctcttttgtgtgttttaggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaaggtaaggaaccagcacgcactgattgcaaagccgtcatctaaatgcacattctgtgtttagtgatagaagataatagagcatcacgaatgctgtataatccagtggctcttgtttcagacacagtttaaaataaaggtaaaactacaaaagcctctatcattagaatttcatatccagaaactgattaccacctcaagagggatctaagacagggattaccaaggtaaaaaaatctcattatttctggtcacctttatttaacaggtactgtgggcctcctaagtgtttgaaccaaaggataaaaatgtgaccataaaaataacaacaaaaccaaggaaagcctaaaattcttcactatggcatttccctgcaaagccttagtcttgccacaaacctagccctttgtttctatctagcattgcatggcagcagaattgatttaatgtcccaagtatctctatggattggtaggattaaat

SEQ ID NO: 114360 - DNA, 1054 bp, Homo sapiens
tagttggacttctgacctagtgtctcagtgtcttaaagaatgtgttctaagctacaggatgtagcaactgccaggcttttaggtcctgggcttggaaactagcacaacatgacttctgttgtattaaaatgagcagagcgagcagagcagtcactgagccaacccagattccaggtggagaacatagatccagctctcaatgggaggaatgcccgaatctgtggccatctctaatttgccgtagtttccattacccacagttattgtgtactatgtttgccttttgattcacattgaaaccctcaaagtcactgcttcatttatttctcttcttaacaattgtaatggcttcaaactgacttctccatttctatgttctcatctgcctagtttcctaggtacactattgtgataatggtcttattaatattaataagatcttctaacattaatgtactatggtagcttgttgcctgaaaataaagacctcacaccttagtgtagtttgccttccatatcttaacctactctgtaagctcttcccaatacttccctttaaacttcctagatcgagtacagcacaccattcctaaaacatgttgcgtacctcttcctcttgcccctccaatgtgccttttcatcctcctccctggggacggaacgtccttccagaaacctccatctgttgaaatcctctttatcctccagcattacactcagatttgagcccctgcatggacccgtcatagatccttctctgtagcagtcgtattctcccttgactcccacagcactcctgttctttttgaggtttgctaacagcttggattatagttatttttacaggcctgtattactttaatgcttgttaatcatttaaattgttcataatctttaaagtttccaagcatagtacttttatttcacccagtaggtgctcgatatagattttatttgattcacacttgatctctagccagatattttgcaggcagattatctacaattttaaaaggttatcctgcatcactaaatacagaatttagcaaatcgt

SEQ ID NO: 114361 - DNA, 1459 bp, Homo sapiens
aagccattttattcagaatattgttgattcttcccatagtctttgtattaaatcatcataaatatcaagaaaatcagtgtaagaaattctagcctcacacagggaccattatattagtatctagatttttttcataaaggcagggatggttaattcttccactaggatattaacttagcttgatatttaattaacagtttaacttctgaagatattgatgaaagattctcatacagtcaacgccagattagaagaggtgtgttggcaagctccaggaaggcagggaaagcctcaggagggagcaagtgtgcttggaattgtagcataaacatattcctctcctaaaacacatataatgtggaccgcagccaggcacagaccacaacctgaaactctgcatgtggggttgccagaattagcaaatttttcagtataagtataccctatatactgcatgtgatatagttatattaagatgttattcataatttatcttaaatgcaaattgaactgggtgtcctgtattttatccagtgccctatcctcagcaaacctcagtgtgggccattgtgtgacatcagcatggatcagctcagtgggttccctgaggatggagtgggatgatgtctggatcagttaggagaaaatgagtgtcttgctggtactacaagacgcactttcattacaaatgcacatgtcaaaagctaacatgatgaaaaccgttggaaggtttgctgttttgccagatatttcttaacatgtgtcttatgagcagaagctctcttgtcatttggaaagaatatcacttcagaggccccatggggatgacatccgccccaccatcaggatcaatatgtagtgaatttatgaaggagcaagttcaagccatgcgctgcatttaataatgcattataataacataaaatgagctgaggattaatcaaaactttataaactggtgctaaattgacttagtaatttacatctggctctgtgtggttggcccattgacaataacttatctccaaaaagttgcatagccatttcttcttaattgcatatgttgcgctgtagggtgatatagaagatattaaaatatgagtaacagatggatactggctaatggagcttcagatctcatatattttcttattgttttctatttatttatgaacctattgctgtaaaataaaaccttttttttttcagggcagaaccagcttcagacttttttccccaagccttcttatttcggtttcttcttgctatattactctatgatggaagcacttctgtgctctgtgctccatgtgatgtttggtttttgttattagtggatgaaagttaatgatacacaaccagactgggacactttgaaggtaacagcaatatctgtgtatagatggggttgtggttttgttatttatctgctattgctgtagtatcctttgtcttgagc

SEQ ID NO: 114362 - DNA, 1025 bp, Homo sapiens
acatttattgacttaaatgatgccaaatctttgggttttaaataaatctatgacttaaaattaatttttgtttcatcctaagaagttgttttataatattcccagtgtggcgggcaatgaactcctctatccttaaagagagatggcattgtaagagcagtgctgttatgcagatcttcatccatgagaaggtgtccaacatttgaagtgtttatttttaaaattttaaatgcaactttaggatgctacataaaatacacagagatgattccatgtgaagttgaaaccattcaaggttggctccagcgtgtggatgaatctgctcagtagcacatggtaatggagtgaacatggatgttgtgagcccaggctcttgtgtttggctctgaaattaactcactgggagcttttcatggaaatagatagtctctaggacaccacctcctagatacagacaggctttccccagcaacctgctatgagcatccaagatgttacctgtgcctggagccctcggggctcttttagcttcctcttccctgctgaacctcacagttctgccttaggtcatggtctgtgttcctaaggaagaaagtcagacaagtctcttcctcctggggggtgaagaagtgcccctcttatgcgtacctagtcctgcaaatggatgagtggtttcacaatgtattttgaattcattcattctgtctctctctctctctctcttttatgctattttcaatactggagaagccagaggctctgtttcctttcactgacagctttatcccagttattcatgtattccctgtgctatcattatttggacacagtgcaaaatgatcaagaaaatgccttcactgaaataaaacttgtagctctggttgagtccaggtttaatgtgctaccatccctttgggaaaatatccaggaaatcaaagaatggaacaaaatctgttgacccctgacacttttcttcttgtctttgctttcctttccttcttccttctccgtcactctgtccttcc

SEQ ID NO: 114363 - DNA, 1050 bp, Homo sapiens
ggttccaggatgctttgatgaagcaacgtcttaggaaatggctctctccttgtaaatggtcaacccctttctccacacaaactgtcgtgtctcttcacactggttccctggggtgggatgacaaaggattctcttgttcatactaaagtgaagacagttttctacattttaaaattttgtccagtgggcgttataaccttcacagctgactatacgggtagttcactgtgagagagtgtagaaatggtaaataagagaaatctctttttctagagattctaagtgctgcttccaacggtgctatgaaatccttgccatgtgtacgttccctgttctccatgtgatgggcaaaactcctgctcttcatggacagcaggtgtgtgtgtggtgtgtgtgtatacgtgtgtatttatgtgttgcgtggtgtttgcgtatctgtgtctgtgtgtggtgtatacgtgtgcagaggtatgtatgtcatgtgagtgtgtctgtgtatgtgtgtgtgcatgtctgcacacctctgtaaaggcagggttcacattggactcagcagtgccttgcacagtgctttatataccgtaggtgttcagtaaatttgttcagttaaattgaattaagcacatggtacctgggctatgtttcgttcaataaaaagagattgtttttgcactgatttcacaaatgtcgtaactatattcagatatgagaaaatgatttaataagagaaaagtgtccctgtcccactttcatttatgaggtgctacgtgggtggcagttgatggagaagtgagatgtcctatgggtctccaccttgactagggaacacagtttggttcttagcatactattttttgggaaggttaacaaattaaaatcccatgattaagtgaatttcagattttacactgacattaagctgttttcttcttcatctttttcttatcagttgctcttaaggagctggatctgacatgtagcagcaccttcctgacagctgctattcccggggactatcaggttagctgcattaccctttggactggccgg

SEQ ID NO: 114364 - DNA, 1081 bp, Homo sapiens
ggattacaggtgtgagccaccgttcccctcctacttctcctcttatttgcaattacgccctttgtctctgcctcattttctctgtctcgtacgtgcaggctgactgcttccaaggtatgagattatttattacattagcccgatcttgcctttctacatggaagttgtcaacatcctttcttgagtcatgtgtgggtgtcaccatggtgtcaggctgtggaggtaacagaggagggaagaagaaagggctgctaagttcaatccatgcaggcgaaggctatgcgacggggaggctgtctgagaccctgttttggaacccaggacggtcttggacctcagaaatcaggtggagcctctcagtggcaccctggacccctaaagagagggagggaggatcctgaggacaggtgtgacaggcagcctgaactgagcaggtgctgtcctctctgcccctcctccctgtaaggtgtctaggtcacctccttggagtcagaccaggcatgatttgtggggtgaagggaggctcagaacacggctgcagggagcgcgtgctttattaggaaagctctctctgaggacttgaggcactgctgacaggaaaggaggttttccttgtagtgtgtggccctggaagaaagagctgggaccaatagggaaaaacataatcattcagagtttcaaataaatggaatggccagctgtgagggctccagcagatttcataaaccgctcagcaggaatagaccgagcggtgttaaatcctgactcattcacctgtacagttgtttcacatccaccttttttgtttgttgcagtttttattctggaatcattatttctagatagagagcatttgcatctttttttaacaagataaacttttaaagacatttcattttatttttattatttttatttttttaagacagtatctcactctgttgcccaggctggaatgcagtggcgtgatctccgctcactgcggcctccacctcctgggttcaagtgattctcctacctcagcctcccgagcagctggggttgcaggcgtgcgccaccacgcccggctaattttttaaat

SEQ ID NO: 114365 - DNA, 1103 bp, Homo sapiens
atcctgtggtggaatatttccaatgatccaaaattagtgatggtatcttggacaccacagtatcatgggctcagacgaattggcgtgttcaacatctttcaattgtcaacctaaatctaacactaggattgatggctttggtcaaaggatgcttcattctttggagaaaacaaaagaataacctctatttgtaagcatgggggttggaggctttggaattaggtgcttgacaaagtgaacactgcatgaaattgggagcagttgcaggctattagaagatgacagtcttttggtggtaaggaccattaatacctaccaaggacatgtttattgtattggcagggagcataaaggagaacagctgagatttttcccctcactcttctctttggtttacatgaaaaaagtgtcaaaggagaagcctggtggagaaagggcttggctatcatggcaacctttatctgtggaaaataaaaggaagatacagttgccctctgtgaaaagatctgtgataacactcgtccccaatcatcggagagacaaatgaccatttctctttgaaagaattatatttacatttccccatgtctagagaaatgccttcttattaaatacacatgcaggtcgggcacagtggctcatgcctgtaatcccagcactttgggaggccgaggtgggtggaccacctgaggtcaggagttcgagaccaggctggccaacatggcaaaaccccgtctctactaaaaatacaaaaaaaaaaaaaaaaaaagaaaaaaattaactgggcatggtggcaggcacctgtaatcccagctacttgggaggctgaggcaggagaaatgcttgaacccaggaagcggaggttgcagtgagccgagatcacaccattgtactccagcctgggcgatagagcgagactctgtctcaaaaaaaaaaaaaagttcattgattactgtttttccccaaggttttttgttcacctgtaaagtaatatgtagttgataagaggatgggggggatatttaagatctttattctgacaaacactttctgttgtcctaaactgatgtggcagataggatagatttgagtcaaagaaaggg

SEQ ID NO: 114366 - DNA, 1049 bp, Homo sapiens
tgcgacaacataaccagattaaatcagttaaactcatcagccagcctcgccgctgaatgttgggtacaccccaattcccagtcattgcttagagtatgcttctctgccaattttattgttttatgggcatagctcagggggaacatctttgacaacacagaatcttgtggtctcattagagctgcagagtctggaactcctagcatcattctgctcaacaaatgaggttgctgtcctttgatgggggagaagttcatgatgcctgcttctgtgtccttgtacactttcttagcaaggccttcgcttcagctggagtggcaggtaacttctaacagccagacccagtggcagaatgcagagttttaaatgcccagagcctgagtatttaaaggggagtgtttcccaccccgcgcacctccccccgccccgctcttagagaagaatcaaagaattgcttctagctctttccattctgctttggcacattttgcagttaaaatgtaatgctgaatataggttttgggtagagatacatacgaattgcctctcatttccttgctcttccactgttttctctgggtagaagtgagtgtctttagctctcccaccttgtttactgcaccttccatctgtttagtgtattaaaatcctctctgcctcctgccacaggcttcctcagctctcttgtgggcaccttgctttcctcacaccagttggtttccacatagtggctttccatgggagtgtttactttggcacaggtggtccatggtccagatacactcagcatggctttggggatgtggtccaggctagctggcctttagcactcatatgcatttctccactggtaatagagtatttttttatccagccctgtgatgcttcaggcaagcattttcatagtgcctaatttcttcagtatttctagttacttgttcacaaaaatggagatcaacagcgttttaagtcctagtgcaatagctttattgaccttttgccagggtcatttctgaccagctcactttgaacttgcctctttccaaaca

SEQ ID NO: 114367 - DNA, 1031 bp, Homo sapiens
catgcccagctaatttttttttttttttgaatttttagtagagacggggtttcaccatgttagcctggatggtctcgatctcctgacctcgtgatccacccgcctcggcctcccaaagtgctgggattacaggcgtgagccaccgcgcccggccttctctccatatcattttgcagaactccacgcactgcctttatttcttaaagtctttcactgatacagaatgtcagcttaggagaccaatgagactgttttgttcgcagctgtgttgcccacgctgcctagaacagtgcctggcacgcaggaggctctcgggccatcttgggtaagtgaccgaatcaaaaaatgcccttagagactatgtatatagtatagactgcaatagagtatactgagagaaaggactaaggcttaagcaagacttttgggggctaaccatggactctaaaactacttatattctttatttagagaaaaatgttccaaatgcctccaaactgattttttagcacagtcttaaaatacaaatgtctttgtaaactggcaggtggagggttgggagagggactgcatatttcctagttcctaatacacaacaatttgcacagtaagtcagtgcttgttaaatgaattgacgaccttgcatgacttggagattagcataaatataatttctgtgtacagattgaatattcctaatcaaaaaatcccaattccacaatgcttcaaaatctgaaactttctgagcaccgacatgaccctaaaaatgctaatatatataatacaaatattccaaaatctgagaaaatcccaaatctgaaatacttctggtcccaagcattttgggtaagggatacttaatctgtattaaaacacagaaaaattgaaattcagggatgttctcatttaaaacagcaccctctcctccaagcacacaaattccagggaacatattgtgtctttattacatatgtttacacattacagagattttagacatcctagaatattttaaaaatatggcaggcttt

SEQ ID NO: 114368 - DNA, 1033 bp, Homo sapiens
ccgccccttcccggtacaggacccccaccttcgctcctgggagccccgctgcaccccaggagttccattccagcctccccagtgcgagtgcggccgagcgctgacttttgggggctccctcccccgtctcactgggtccctctgcggctcccccgcccgctgtcccggttcagacgtggctgcaccccggaggggggcgccggccgagacctgagacgtggcgctccctctctgccggcctcggcttcaggtacgtgcggttccctcggctaaatctggcccgggggatggggggcaggggccgtctggtcctccggaactcgaactttgtgattttgttctttctgtgtgacatcctcatccgttctgagggagaaactccttaaagaagacgagagagtcagtcgttgcgggttcttggaggagcactttgggggtgagactcccggctagttcgggtcgatttcagcgggattaagtcaaggaaatgaacaaatctgacgaatcagggaggccagagaaggcgtccccaggtagccacgctgagcgttaagagagaagtcccgtatggtcaaagtcattcgtccaattctgtgtcaattattccttgttgcacttttgcaggatccttgggccttactaagtactcaggtgaaaagttgataattgggaagcaagtaaagtacctttgaagacgtgtataattggacactttgttgcagttcttcagtttctggaggaggcggtggggggggagagggagggggtcagcctcgcgaaaagagcaaatggtaaagttataggagtataaggcataaaacttgggttgggagtcctgactggccttgagtggccctttcccactggatgggggtgcgggacagtatctctgggccctttttactcagtctgcgcctcagagggaggcttgaaggtcccctgcatgaggaaatgtgtgaattgccccctcctgaccgcagtgaggtagggacccccgcaaggacccacgttcacaccagcgcccttccagcca

SEQ ID NO: 114369 - DNA, 1078 bp, Homo sapiens
cagattgcttgagcccaggagtttgagaccagcctgggcaacataacaagacccctctctcttaaaaaatggtggaaaaataatgtcttaaatatatgagactaggtatattgaagtgttgaagtgcgttatttaaaactgcttcttattaaaattactgccacatcctgattttatttagaaaactataaatctatgatagacatctgctaaaaatggcatattttataattaatactagaaggtgttcttacaactgctgtcagtgtatcttctgtatttcaatggattgtttgtttatgtgtttgtgtcccagagtgctctttttaacaagtagtaatttttgctcaggtattttcagggactcttaaaaacaggaaattttgggatcatttcctctgactcactgctcactaaaataatagctgttactctccacagatgctgcagttggagaagaaacttgaacgtgaacttgaggatgatgcacgagttattgcttgccggttccctttcccacattggactccagaccacgtcacgggggaggggatagacacagtgtgggcatatgatgcaagcacttttagaggccgtgaaaagaggccctgtacatcgatgcatttccagctgcccattcaagcataaacttgactgggagtgtttttctgaaatattgtagtcttccctgatcttgtagagacttacagctgtgtccttagcaaaggagcataattgtctttggtttggaatgagaaattactattactttccttaactgttggagaaaacaaacgaagaaaaacaggtagatttaaaatctgcttttgatgctattttcttaaaaattgtacttactgcctttccatgcacctggatgcatgaaaagatgaataagtgatggtcatggttatgggtaggaaaataagatgccaatagctcttcacattataaacaatatggcttaatgcctcgataaggagaaatgatttttaaagacagtatatattaccaactgtttgtagtatcctataactttgttcatacttaagttgtatctctttcctttttgtacttc

SEQ ID NO: 114370 - DNA, 1802 bp, Homo sapiens
ccaaaagcttgcgcacgcgcagcacaagacgcgcgggacttatgtttctactgagactaatttcacgccagacagtatcttctggaatcggcggccttcgggaacttctattatccaggaagccggggagggggaggtttgaagacacttagtggaaatcttaggacacacaagtcaagagcagattgaatttgtcattttttaaaacgttaccactgatagtttctcgatagtgggtcccaaggaggaattcattgacttaaagcactatttctttatttcttcgcactccggctccgagaagatggtaggacccatttccggtttttttttttttttttttttttttttttttttttttaaaaacgctgttggaaatctcgcgatggagggaggaggaggtgaggctggagcggcttggcgggttcctgggggcatgagaaggggtgcgggcgggccgggggctcgcggtcagctgaggtctccactgtcgaggcggtgaccgggtgcgggcggctgctctggcctccagcctggccttcggtgaccagagctcctggtcgccgcgcggtgcccgcgccggttctggcgatccttgtcggcgggcgcgtttccccagagactgttctaggctacttagtgcaagtgactcagcctttggcacgatcttaaggaatagggatagtggaggcacactgatggattggaatcgcagttctgccgctcttcctagctgtggctttgaggaaatcccttaacttctttgtccctcgggttccctgtctgcaaagtgacggtggtaacagtagtgcctactcacagggctgctgtgagattcaaggagaacggtgcctggcaagctgaacacagtgttggtaaataaattaacattttgcacaaatggttcagtaacttgccactggtatacagctagtaagaaacagttacacagcctgatgcaatgggtcccacactctttttttttttttttttttttgagacaagactgtagcccgggctggagtgcagtggcgcggtctcggctcactgcagcctccgcctcccgggttccagtgattctcgtgcctcagcctcccaggcagctgggactacaggcacagaaccaccacgctcgctaatttttgtatttttagtagagacggtgttaacgccgtagtggccaggctggtctcgaacggctgacctcaagtgatgtacccgtctaggtctccccaagtgttgggcctgagccaccgcggtgcccggcaggtctcactcttaagccctgtattatgctgcctcagaaagatcttggcaaccgcagctgtcctctaaatctcttatgctgccttcctccccgccctccaagatcatgacttaatatttgataggtttagatttatttgttgagggtttccatccttgcttctcccctactgccatgggcagggacttaactaataaagttgtattattcccagactttattaggcactcaataagtgctgaaatgaatacatgcactataacatttgaccctgtcctgaaactcaagaacagacttggcgactgtgttcccatctactctggggctgaggcaggaggatgggtggagcccaggagttcagtttacagtgcgctataatcgcgccactgcactccatcctgggcgacagagcgagattctgtctctaaaaacagggaggactgactgtcatgggatggttggtgatctgttaactcttcatgcttggcatacttacgcgctagaccttgaagtgttcttcaaggacattttagat

SEQ ID NO: 114371 - DNA, 1002 bp, Homo sapiens
agcgtttttaaaaaaaaaaaaaaaaaaaaaaaaaaaaaaaaaaaaaccggaaatgggtcctaccatcttctcggagccggagtgcgaagaaataaagaaatagtgctttaagtcaatgaattcctccttgggacccactatcgagaaactatcagtggtaacgttttaaaaaatgacaaattcaatctgctcttgacttgtgtgtcctaagatttccactaagtgtcttcaaacctccccctccccggcttcctggataatagaagttcccgaaggccgccgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatggcgtccatggggaccctcgccttcgatgaatatgggcgccctttcctcatcatcaaggatcaggaccgcaagtcccgtcttatgggacttgaggccctcaaggtaatggcacagggacctgctcgcggtgggctaaggggaggtggccgaggccgtggctctgcgcctgcgcgagttgaggagcggctctgccatgtgctccccggaaaggtcgagaatctccgtctccctgcggtctccggccgctcagcccgcttactgagctcgggagacgccggcgcctaatcctgggctcggaatgtgggggccagccaggctgggccgccagcgcccttcggagctgggtggggccgctcagtccggtcgcccgcgggagcaaagcgggaccgcctccccgcccggctcctccagcctgacggccgcgtgggactgcgctccagtgggagggcgccggggagatgctctgtcacctgtcggttaaggcgctgctgcttaacctttcgctggtccacccgcaacggcccttccgttttctttgtcactcgta

SEQ ID NO: 114372 - DNA, 2995 bp, Homo sapiens
gatgtacaagcctagatgcaagggacttgagcatctgtgaatttgggtatcctcgggggctcctggaacctgttccccatggatgctcagggagaactgtggctcctggaaccaattccccatggatgctcagggaggactgtgttgcacagtggtcttgcaacgcctgtaaggtcatagtcatactgtccctcttctcagctgtaaatgggctggtaaaagaatctgtctcattaatgtgttgaaaattcagtgagataacacaaagcacttggttctctttctttacgtaagaattgcttattaaaactggagtcgtaaatgttataatacttaaacctgtctgttgccccttaaatgtagaagcttctagacaatagaaactaagtcataagtgatttttgtagtcatcagatgtgtgcttttaaccattgaaattatatgtaacagtgtttgctttttctgtttgtttcattagtctcatataatggcagcaaaggctgtagcaaatacaatgagaacatcacttggaccaaatggtaagagtccaccattccgtgttttttagcaaaagatttaaattataaaactgtcaatataaacctctctacagaaaggtggagtattgaggggaggcatcttacttccttaacacagccaaaattttttagtgtatttcaggtttcttaaacatggttataatcgtgtgcaatattaggtcggacctttttttttttttttttagcatgtaacatcatttcattagcattttccaaatcatagttgtcttttgagattaacattatacttaatgatgctccataatgttttgccaattatgttagccaatctaaaaatgccttcatgcagctactattttgtgtatgttgcattatttgtatataataaattgcacagataagagctgggtcaggaggtcttgttttatagtttgtgatattggttgccagttttttgcgcaaagcctactaaacgttgttttttagggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttggtaagaaaagacaaaacatcctttctcatttaagagacgtcatttaagaccacagggctaacatgcctgctgagattgttgtctctgaatcagagcatgaggagacagacaaatccaagttgaaaacatgctacaaaacaaatgtcggactttcaaaactgacagtgttacaaaagaacagaaagagggctggggattgttaggcatggagaaatgtgtaatgattgattggacactgattttgcttgtcttttaagctataaaggatgtttgggaaacgtggaagaatttgattttggatcatgtactgcaatgctgagtttcctgagtgatctgtgaccattatattgcagatgtgtaggagaatgcccttcttctcagctgtatacctaaatacttaggagtgacatgtcatggtttctgtaactaattctcaaatagttgaacagaaacagtatgtacatgtagagaaaatgtggcaaaatgttaataagtaaactggtattcgttttagtattgtaccttttttttctgaagatttgaaatctttaaaaagttggggagattgaagacaaaatatcagtaaggttaccttttctgcagatgaaatttgaattcattcaacaaatatttattggatactattgtatgccaagcactgttctcggtgcgcttggagagctgtagatttaaacaaaattcatctttgcgaccctaaaatgaggagaaaggaggatgggggtggggggaataaataataaacacgttttagtctcatcaccaggctgaatttcactgagtagaccctggcccaggaaacataatagctttttacctcttagaaaaatgttctttttacattatattctttagttacgttcttcacatcactgagggttgaatgttcatctgtaaggggacacatgtcctattcgaccttcgctagaactaaaacgaggctttcttttaaaaatagagggcttctgcctctaagatgacttgcagcttaattctagaagctgcttctttccatgatagcatctaacttgtgctgattatactaaaagtgaagttttgttgtttgcctgaactgattgtctgctggcttatttgcagtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtgtacgtttcagtagatgatatgattacccatttgtagaggaggcagtttgtttgccatttcttaaaggcaacacaaaatgaccactggtggatttgtatcgatttgattatttgttttgattacttggttttgctttgtttttaatgtagatgtagacagatgcattttgtatttaagttgagaactgaatttctaagttcaggtataaatccccttgacaatatttgcaaaatatagttattttaatttagcagaataggttgtgttaaaaatcagctaaggctggatgcagtggctcatacttgtaatctcagcactttaggaggccaaagcagtagcttgcttgagctcaggaattgaagaccagccagggcaatgtagtgggaccccatcgctacaaaacaaaaaactagccaggcatggtagcacacacttcagcaactccagaggctgaggtgagaggtcgaggctgcagcaagccatgatcatgccactgcactccagctt

SEQ ID NO: 114373 - DNA, 1415 bp, Homo sapiens
ctataatggatgttgtggtgaattcttggaaagtttaaatgccctgtccagtcctttcagttcctggttagtgctacacttcattgagataagagtgactcttcctgagtgattacttacctttcccattctgttctgaacttgtaaaatagtaacagtattctgtaaaagtgctgcattctaagaagaccttaattcatgccagactacagtggtttcttgagtacattcataatggaaggaaatagtaaatttcagagttagcgaaaataaagatgtaattttttcctatctaagtatacagtcccctttagggcccatggatcacaggttaagaatctgccccagactgttgaaaatgcaggttgagatggcattcccctctagaagactcaaaacatcgtttgatttatatctttgagtaacattgtgttatgtggcctgctttggttgcagtaattgtgaaaccaatgaagtttgttttgtggtgttttcctcagggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaagtgagccattgcatctcacagcttcgcactgttggttaactcttaattccaccaattaaaatgtctttatgttcccccatagaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaagtaagtcttaccagagtcctcagtggaatttaaactcccaaagggtacagttagttaggtttggttagtaaatatgtgtagtctttcttcagttctaaaacatacacaggaaaaaaccaaattgcatagaaaggcataaacagggaagaattctaattttgtcttaaaatggtagcgtgttcaggccaggtgcagtggccatgcctataatcccagcactttgggaggctaaggcaggcagatcgtgagatcatcgagaccatctgactaacacggtgaaacgccatttctactaaaaacacaaaaaattagccaggcatggtggcaggcacctatagtcctagctactcaggaggctgagacaggagaatcgcttgaacccaggaggcagaggttgcagtgagctgagcttgcaccactacactccagcctgggcgacagagcaagactctgtctcaaaaaaaatggtagtgtgttcagggtcctgaaa

SEQ ID NO: 114374 - DNA, 3543 bp, Homo sapiens
tgtgagtgcccgaattagtttatggatccactgaggattgtccactcaggtgagacagtcaagttgcaagtggttcataacattgtttgtttaaaacatactcaggtgaaactactctgtaggtgtttgtgacaggacagagctgttagccatttccccatggttggggaagggtgttagctttgttgacgtttctgtgggttttgcctcactgtaacaatagggttcagcagaattactgcttgtggtttttaaagcataaacaatgaggtgatccccattgataaaatattcactatttagaatttggaactgacagaaaagtggacacttgtctatttccttccttctctttcctttgcttttgtgtttgagtgcacctgccttacacccaactgtgcctctccttttttcaaacattgtaatgaagaataaatacccactttctcttaatacgattgtggtggttcttttcccagattaaagagactggtgctaacctagcaatttgtcagtggggctttgatgatgaagcaaatcacttacttcttcagaacaacttgcctgcggttcgctgggtaggaggacctgaaattgaggtaggatgttccacgtgaagagactttgagaagtaggggttcatcttatgtgttgaggggtgttttgatagccctgccttaaataactgcatcacaccaaggctggcagatgaggggagggtgagctgggagagaggaaagcgctggaatctttgttactgtttggataacagtgctgtgtgtttctggtgttccctggcattttgaaattctctccctgtgttgtctcacttggccctgtcgttgacttactaaggctggaagacctggtctcatccaaatactaatggcagtcccaggcaacggtgcctcggtggttctcactgcagcgcagtgcaaggaacatgcaggctgggttcccagagtgagggagggctgcacagatgggagatgagggtatgagcttaggggacgggcgccgggtgatagatctgggcagcaccaaagccccaatcaagacgtccagctcaagagccttgttacctagcaaggtgctttgggttgaactggagatgtctcggtcaaagtggggcagcagttctagtgaacaagttggtcttagatcaagttttgctcatttgtggcccagttttgaaagttaacttcaccagtactgtcttcatccttctccctgaccaccccaattagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatggtgagaattcaactatttgtcctatactgttgcttattttgcttcatggtctggcttttttgcctgtgtgtatttaacagagacacagtcaccataagaaaaataatcgtggttctcaaacaatgacgtatcatggtgtaaaattactgaagaccatgttaaattgttaatttcacaaggcacatttgcctttctgctgtcccttagagtatacaatatacactatgagatttttatatctttttaaatacttaaacacagtttaaatattcaagtcctggattttagaatgtttgatacagttacattaggggttggttaaactgctagccctagcaacataagactcattttaattacaatatggtattattaccaaggatgacttacatctgtcccttaggtagaaaaagggaacccaagtgaataaccattgacgatctctgttctttgagaatgagtttttagcacattgtgataaatctttgcgagttttgtcagtttttgactcttgcttgaccgtgtatcctagaatgagtcactggccgcctctgcctcttgaattttgttaactacattgcaggaaggaaagctagaaagataaatattatccgatagtggaggccatctaaatattagagcacagcctctctgtctttaaaaaggtgccagatacttggctctaaattgactagatcttgatcacattaattcaggcaaagctgttttccttagatcattgaggaggcgaaacgatcccttcacgatgctttgtgtgtcatccggaacctcatccgcgataatcgtgtggtgtatggaggaggggctgctgagatatcctgtgccctggcagttagccaagaggcggataaggtaagggatctgtgcagacttagtgaaagattcaggcctcgctgatggtggagactgtgaagctgcggaacagcgaggtgctggatgcaaaacaagcatcgtgagctgtgtgtaggtgacaggtgttttaatctaagttaattcccacgttcctgtattcagattctggttaccataacctagcatttctcagctgttttcagccagttcgtccttgaaataataaatctatagtcttttaatgttatttgaaattcaaaattaatattataacttaaaaataaagccataagagctgctgtattttgagacatctctcacatgtatgtataccctctgcctgtattctgtggtgacattataatattctgatagatacaaaaataaagacagcctgttcttacaattctttgtgagctgacttttcaaagtatgtgatacagttgtgttttcacggtgccgctgggttgttttgtttcgccaagtgcactcaccatacttctgtacctttccagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatggtgaggagctgtcacgcctctgcgtggagggggggggatgtctgatttaaactgaataatcatccactgtatgtgctgtgagatgatggtgtctttttaaatatgtaagcccacttcaggtgttcaagtcctgaattttagaatgtttgattgccgtaggaattggttagactactagacctagcaacatgagactcattgtaataacagtaaagtgcatatggtactatcaccaaagatgacttaggttttaatctctggtttttgggaagtaatgccttattgctgtttttacacagatgtctgtcagtgggcagcatatatataacagctctgaagtgggctttagttcacagttcactgtgtggttaatcctgcacactgtggagtgttttctaaatgtaatatataacctctgtagccacttgtgtagctcggctcccaaaaagatatggtggctgtagcttgttgaaacagtggtctcaggcatttctgtactaaatcaggccatgtctgtaatccatccacagaatgacagctt

SEQ ID NO: 114375 - DNA, 1293 bp, Homo sapiens
aaaaaatacaaaattagccaggcctggtcagggcaggcacctgtaatcccagctactcgggaggctgaggcaggagaatcgcttgaacccgggacgcagaggttccagtgagctgagatcgcactgttgtattccagcctgggtgacacctgtctccaaaaaaaaaattagcatttctagatctttcttggaaatatcttacatttcagctgtggtcagatggacttactttagatttcctaagttagggtatggatactttgtgggataagatgttcctgaaaaatgtcaccctgtagctagtcattgaagacagtgccctcccaacagctctctttaccaggtgcgagttccagagtgtccttggaagtaatgaaattacattcatctgaaaatgaaatataactgaaattagtggcttcctgcttggcttccaggagtttgtatttcttaagtcttactgtgattccctaaatcagaaagagttggttattgatagtttattgtatgctattttaggataatcagtgtccttgtatttttcagatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattgaaggggtttgggtggatttttttttctcaaaataagctgtagggactattttaacagcttaaacaggagctctcaagatgcactttcatattgagaggaatatgggcttgatcctcttcctatctaaatgggtgggccatttgattgtagagggtccaccacagaattatgggatgccttaagtgctgttactaggttgctcacagcctaacctggcgtgttgtttagggctgatggagacccatgtgagcctttgctttcctctggccccggccccaccctgaacacagctcatacacagaatcaggaccagcatgtgcagag

SEQ ID NO: 114376 - DNA, 1136 bp, Homo sapiens
ttgtccacccgctgggcctctgggccggggagcggaaggtgaccctctgcgcgccccccgccgtttcccgcccgcgccgccgaggggggcggggaccctgccgggcaggggccggggccggggtcggggcctcggggctactgcaggccggcgtggcctcccttgtccccgccgtcgcgcgctggcccagaaaagggggcctctgtcgctgccgtccgggggcgttttccgcacccttcccccactgggttttgtctttctttacgtccttctgcctattgctcgccaggccctaccccctcgcgacagaacttctttgttgactttgaaacttcgcgaaaaataccccgccagatgacggccgagtggagtgagctgacccctgttgaaaagcctggtcctcggcttgcctgccgctcgagaatctgtttactaaacggggaggctcttttgttgcgatccatttggttttaaatccttgacacctataagcagggttctgtttgttttgttttgcgattgcttgtgttttggatacggttacattgaacaaactgacccttgtaaaatgaatacttaagatataaacgtccacaccttatgtctcttcaaacgcattttcttacccactgaaggtagtagattatttttaaccagctgtgtttttaaatgagtggtgagtttatagaggaaattactaaattttgctttttttgatgttccggttatcgtgcaaatgcttttctactttaggtatatttatgggggtatgagcgtctttcaaccttatgggttgcgattttggcgattttaaacgaaaatgaattatcaaacgccgtcatggagtgcaataatgagtgaaaaaagtttgatattatctatgtaatgagttgataacgacttatttttttttaaagaagtcttgcctttaataaatacctcaactataacatgtggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaatttccctttcatt

SEQ ID NO: 114377 - DNA, 1062 bp, Homo sapiens
gagatgtctgctgcatgtttcttaccacgcattacctttcactgttttggcatgcttgtgaccaagtgtacatgcatttattcgttaaatgtttactgaggacctgttatgagccaggcactattctatgcatttgggctaggcaaggaacaatatagagaaaatcctttctttcatagagcttacattatagttattagcttaagacaaaataaacatgtaaattatatggcataactagaaggttataaacgctgtggagaacagtgaattgggagggaataagaagtgccaggatatgagggcatgggttgctttttttttttttttttttgagacggagtcttgctctgtcacccaggctggagtgcagtggcgcgatcttggctcactaggggtcgcagttttaaatatagcagtaaaggaaggcctcactgagaaggagcaaaggagaaggagttagccatgcagatactctgggcagagcattccaggcagagggaacatagcctatgtgaagtgtctaagatgggagcatgcctagagtgttcaataaatcaccaggagagcagtgtagctgtaacggagtaaaagagttggagaagagtaagtataatatgaggtcagaaagatatggagccaatggggagagagcatgtaggacttcattgacttttatagtgagatagggagctatgggagggttttgagctgacgtgagacataaattgtcttgatatgcagccagctttctgtatttgtgggtttcgcatctgtggattcatccaatgtcagatggaaaatacttggaaaaaaatagatgattacctctgtactgaacatgtacagcctttttttcttgtcattattcctcaaacaatacagtatgatgactacataacatttatgttataattattctaagtaatctagagataatttaaagtacagttgactcttgaacaacatgggtttttgaactacatgggtccacttacacatggatttttttcttcaataaatatattgaaaaaaattttggagatttgcagcaatttgaaa

SEQ ID NO: 114378 - DNA, 1067 bp, Homo sapiens
ctgtggacttcctgaaaccaatcccccagggttactgagtctatctctttcctggttaagacaagtttttgtttgtcttaaattcaaatttctggaagctacaatctcactggctcatcttgggtcagttgcttatccttttgatccaggtagctgggtggtggtgggaaaggtaatggaagaataagaatcatgactggctgtgtccattcttgagctggtaagacagtgcaaaagagatctgctatattgctcaattagaatactttttagactgaagccctgtgagtgattattgctgggctatcctcttccagatgcctacttcccatttcttccaggccaggcttactttagtgggttttacttctgtcctgtaagactatgaagatcacttatttttagtataatacagttagaacagaaagagttcttgaaaagtgaataggaagtaagaaccccccaagggaaaacttaataattcagactatattttagaatgctgttgcagtaggctagatgagatataggagttacattaaggtagagggaatggaaagaatggaaaagaagaaatagaccaaggtagaattaatagaacatagtaattgaagaggtaatataaggaggaggagttaaaaatgattgatttttatattatttcaaatgggaatggaaagagataagtagttcagttttagatattgttttagtttgcaggggctgctgtaacaaagtactacagattgggtgcttaagagaaatttgttttctcaactctggaggctagaagtttgagatgaaggtgttggtaggcctggtttcttctgaggtctctctccttggcttgtagatgattgtcttctgtgtcttcatgtagtcttctctctgtatgtcttcatgtagttgtccctctatgtcctaatctcttctttttttaaagacgctagtcatattggattagggcctactctaaggacctcattttaacttaattacctctttaaagatcctgtctccaaatatagttacattgtgtatacatgcaggttagggcttcaacacgt

SEQ ID NO: 114379 - DNA, 1242 bp, Homo sapiens
aaagagcaggggggaggtgataatgactggtcagctgcttaattgatcacacgttcatattattacgaacaggcttcagatgtacctaatcacaagaaactgagcttggggcgtgactgccttcagcattccttctgggtggcataggcagtttgtcagtttgccaacattctgcgtttatgagaacagtttgctgttcactcttatagcctccagtggtatactgagttgatcacgaccctcagtctttcggcctccaacagttacaaatcatgttgatggcatatcccttgatatgatatgatatgatataagatgccacttcatgtgatttttttccttcccaaaacccatagccccagtctattcatgaatcatgcaatttccagtaaacagacattctacagtgtacctgaccagtactccttaaaattgtcaaggtcgtcagaaacaaggaaaatctgagagactgcccgagcccagaggagcccaaggagacatgacaactaaatatatgtagatcctagaacagaaaagggacgttaggtaaagactaaggaaatcagaataaaccatggatttgagttaatgacaatgtatcaatattggttaagtgtaacaaaagtgtaacaaatcctaataagatgttaatagtaggggatattgtgtgctgggtatatgggaactctgtactctcttcatattttctgtaagtctaagacttctaaaatctaaagtctgttagtaataaaaaataattctttgtatattaaattatcactgatttaacaccagaaggtaagtggagagattttgaagtcttacatcaaagaactttcaagatagataatagcttaagagttataacatgtaccccaaaacttagagttttatttttttcctcatactaggcacttaggataaattattgaactgtactgttggctagaaaaactttgatgaaatgggctgacttccacagtggtggtggttttctttctttctttcccatctcctgggcaatctccacaagaatttgaaaaattactaaggacttgaagcttttttttaattaaaaaaaccactattgtttattgagccaagctctttggtggaatctttaaaaggtatccatgtgtaaagacattaggtattcaaatacagcaacaaaaattgctacaggattaaatagaaatttccctttgaaaaccaggaagagctttgccatattgtttctaagta

SEQ ID NO: 114380 - DNA, 1079 bp, Homo sapiens
tttctgggtctgcctaccttgcactcttgtggggtggggtgacatgaaaagcttgtcttctaactgctgttattgtggtgagtcctcacatgtgttttgtggagtttaggctgttaggactttaaaccgttaaattgttaagactggagtttaaaactgttaggacgctaatggtgacctgattttacatatttttattatttgttgtggagagcgcagttttgaataaaaccatctgtttctcttattttcgactttgatttatttaaaatctgtcatacgaaggaacaacttaacttttaatacattatttaggaattttttagttttagataaacacttgaatagcaacttaatcacaactttcagttctccgtactattaatgttttgtcaagtgatagattcttgctttaatgtccaatattttggtttatgcttgtttcttgcttttttaaaaaagttataaccaaaggaaattcaattttcctttttcattggcagacatatgtagagtgtgtcggtcagaaggaacacctgagaaaccgctttatcatccttgtgtatgtactggcagtattaagtttatccatcaagaatggtaagtcatacttttagaaagttatgtaagtctgagcttcagtttcgtcatgtatacagtaacagggatcatttcaatgtactttctctgtaattatttttaaaagttttattgtattttcctgagcacaggaaactgaaaaagcccttttattgtaaaaattaaaaaatttggaaaagaaattatccattaattcttaataccatggctgttattttggtgtatcctcttccaggtacacgtaattacccattgtttatttctaccatggagagcttattttgtcctctgaaagtgttatgattttctagttttgcttggcataatagtagcttacatttatgaagtactttttgccaagaactgttcttagtggtttgtacatctcaactcatttttaatccttataagaaaattgtgatgaggtggagtattattattatgcagatgaggaaattgaagcatgggaaggctagata

SEQ ID NO: 114381 - DNA, 1036 bp, Homo sapiens
ttttagtagagacagggtttcaccatgttggtcactctggtctcgaactcctgacctcaggtgatccacccgcttcgggctcccaaagtgctgggattacaggcgtgagccaccgcgcccgtccgggatgactttttaaataggctgtcacgcagtttgagatacatactactgtcttatgttcacaaaagtttttttgttttgtttttttaaatggagcctcgctctattacctggggtagggtgcagtggtgtgatctctgctcactgcaacttctgccttctgggtctcctacttcagcctcctgaatagctgggattacaagcatgtggcagcaagccaggctaatattttgtatttttagtagagatggggtttcaccatgttagccaggctcgtctcaaactcctaacctcaagtaatctgcctgcctcggcctctcaaagtgctggggttacaggcatgagtcactgtgcttgcccaagagttcgttttaacatgtgtttttaacatacacatttgaactcaaatttattttttaaatgttttccatgattattagaatataaatgctaagaacttgcctgtagttactttactatatcttgatattaagcattgttgcttgccttatattggcaggcttctttttccctctcacctgataggcttgagggtcacctgaattgctttcattagactactcattgactccagaggaccactggaagcctagtggggctagtcaaaataaattataaacatggcttggttttagctgtcttttacagtttgaaaaattgagccagtttttctgatagcagttgtgaccaaactactttttttctgagtaatgttttacactctctatagaattttttttctgtgaaattttactttaaatttccttaatgtcttaccagtttctatgtattctgtagctcagtaattgaggtcatgtctaggtgcactgtatcagttatctattgctgcaaaacaaactgtcccaaaccttagtggcttaaaacagctacc

SEQ ID NO: 114382 - DNA, 1120 bp, Homo sapiens
ggttcaggtgtcagctaatcaagtttttaaacatgtgtaaaataaagatacagaaactcttagagttggacagagtttttaacctttggtaaattacataaatttaatgcatggcctttgtcaagtgttagactgcttttgtctttttttgcgtgctgcctttctgtttctaggccattttcaaaagataggctatggataggtaatttccatatagttctgatggtatttgatgcctaaataaaatacataatacaagtatgtaaatatgtataggttctcttgcaagtagaatttcaccataatcacaaatagttcttttggagaaacttgagattttcatccaaaaaattatgatttattcttctggctgttttttttttttctgagactttagtataagaaaattttttacctttgttttcctaattttaagtcttctttggagtaattatatgtacttttttttttaatagggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggtaactcccctaccccaaaattgattttacttaggtaggtcatgagaattattgtttctctctgagactcaaactcttgacttccatgtccctcataaacattcttttgttattacaaaggagggcagcggaaaggtttgggtgaagatgaagagagatgtgaaaaatcaagaaagtggtattacgactttgcctcttaattttctagttagagtgggaacagcgttggggggtatactgaagtccatgtacacagtcttacccactgagcagaaatttgaaaacatttcctcaagtgtttgatgacagagcatgtatgtatatatgtatgtacatttttttaaaaatgtattttcatccctgatgctgtcaataaagacaaaggctgtcttataaaaaggactacagaatgtttttaagagagccagatttgttaaccattttctataatgctttgtgaactgttaatccgcta

SEQ ID NO: 114383 - DNA, 1180 bp, Homo sapiens
tgatcccacatcagatacatttaaaaaagatgtctttgaaaggttttgtttttaaaaagaatttagtagagtttatatttgttttctagttttttgtttgttttggttttttgagattggctcttgctctgtcactcaggctggagggcagtggcatgatcacacctaactgcagcctcacaacctctgggctcaagagatcctccttcctcagcctcctgagtagctgggactataggcgcaaaccaccatgcctggctaactttttaatttaagtacagatagggtcttgctgtgctggccaggctggtcttgaactcttgagctcaagcaatctgcctgcctcagcctcccaaagtgctaggattacaggcatgagccactacacctggcctaggttttttttttttttttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcacgccattctccggcctcagcctcccgagtagctgggacaacaggcgctcgccaccacgcccggctaatattttgtatttttagtagagacggggtttcaccgtgttaccagtatggtctcgatctcctgaccttgtgagccgcccatctcggcctccaaa

SEQ ID NO: 114384 - DNA, 1663 bp, Homo sapiens
agttcatattactctgctgcctttaaatcttttagtagttttcccattactaaagaataaaatccagactccacattcctcttgtatgatctgatttctgtctttctactacccatatcattagtcagaatgtccttagttccctggcttccttacttttctcaaatctgccagattctttcctggcttagagctattgaattcctctctttcagataaccttatttattccttttctagcatttatctcaatctaggattaccttactttatatgtattatttatttatatgtatgtttttattcttatttgttccctgacaagcaaatactcagtatggaaatgtggcttagcttctcaacaacagcttacaaagtactaaattttactatttttagtgcattctattttttttattatttattatttttacttcaagtaatctttaaattgcaattatattttcagatgacatgaattggaatgctttagaatgggaccgagctgctgaagagcttacatgggaaagagtaagacctttttctgtcaagtatcctggtgttttaatcctaaaatatattttaaactttggtgtatttagatgtatacactaatgttatcgttacagttgatgaaaagttactagaattttcattcctagtgaaagttaagtgatatattgtttatggtcaaaatattgtgatgttggtggctttttttggtcttacaaaatcttgctccatttaggaaatgttttacctgaaattgtggacttttgaaaaacaaaataacaatttaaatttaagtagtattttcatgcttcagttgacaaaataatacagttttattatgaagtaatcttaattagctgtatatcttgagtaacaaatccaagacggaattgttttagactttataaatcatgtaattttgaataaaaggagacccaaaatataaaactctcattcagaaacagaattttttttattttctgaaaatgataggaagtattggaaagtataggaagtgggtgaggactgtgtttaaagatattgaaaggaaaatgaggcttttcataaattagaatagaaagttctgttgcatcttaaattaatgcttatcgtttttgtttattttagatgctaggacttgatggatcactagtttttctggtaagtaaaactaattttttttttttttttttgagacggaatctcactctgtcacccaggctggactgcagtggcgtgatcttggctcactgcaacctccgtctcctgggttcatgccattctcctgcctcagctttccaggtagctgggactacaggtgcccgccaccatgcccggctaattttttgtatttttagtagagatggggtttcaccatgttagccaggatggtctcgatctcctgacctcgtgatctgcccgcctcggcctccccaagtgctgggattacaggcgtgagccaccgcgcccggccaaaactaattctttctagtaacagaattggagttgtcttagtgattcagaaacttcacatttatagtatgtagtaaaggtcaagatgccctttggcttttaattactttatatgttgaagattgtatgtttagtgtgctgaaaatattgaaaaagcataaaggtaatatttttaaaa

SEQ ID NO: 114385 - DNA, 1065 bp, Homo sapiens
gtgacagtatgtaactgtgggaggtgaccagatggtcaggtgagacaggacaaagaaagtcagggcaccatagggagtggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggtggttatgaaaatctatgtaatttgtcgtagattatttctaaaaaggaagtgtttataaatgaatttgttttttgtacatgtaacatttttgagttttattaggcttagttgtatgagctatctaatgaaaaatgaaagttacatattatgtctagattgaaatcccaaaacaatagagggaaaatttcaatcttagctgtttttactatttggctctagctaaataagtggaatagtccaattaaacatacattaagtatgaattgaatatgctttattgatgcttttttcctttaggaacatgtcttctgggtggtatctttaaatacactgttcattcttgtttttggtaagttgtgtttgtgctttttttttttatagtattatggtaggaatttagttttgtaggagccttgttataggtttattattattttttaacatagaaataaatactaagcagtatatgaaaatagtttcagatacaaaccctgtatagataggccccagacagacagatactttcctaagcagcagtgactgcagttacctacctatctctccctctgttgggcatttctgggttttttttttgtagaagctggttttagaccgacttgaaaatatacagtttcccatttctggaattagttttatgctgattgtgtgtgctcttccctatggtggaatatcttgttttcatctgtcaaaatcctgaccattgccttctagagatcttgacttgggagctgttaccagagctgagtgtaggcttgtgggaagac

SEQ ID NO: 114386 - DNA, 1012 bp, Homo sapiens
tttttccccctttttagcattttgcccttaccatattggtcatttctcccttgttggtttgggatttgaagaacacgtgagtataatacttttacaaagttactttcattcattactcccaaatgtgattattaataaaatagtattctaaagagttacatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtatt

SEQ ID NO: 114387 - DNA, 2139 bp, Homo sapiens
gagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatgtatcctttaatgaaccaacttgggtgtacactaatattattcataccaaagaactcttcattaatggcgaaacttgtctatccttgtcctcttagtaaaagttgtaggtatttgcagtaagggtcagtgtggacaaaatgtgaaataaattaattctgtcaaaaaatactaaatgttggctaagtagttacctgtttcattgtacctttaaatactcagtttttccttgacctgatgctgtagggcttggcaactcttgtgaaatttcatagatctcgtcgcttactgggagtctgctatattgttgttaaggtaattcctgttataacttaaaattggaaatgatttctcctacatttgggtgatactgatgacctttattttcacttaaggtctctttgttagtggtggtagaaattggagtattccctctcatttgtggttggtggctggatatctgttccttggtaagttgagtattcattattgtataatagcataatttaagggcttcaaaagaggaagtcttcagcatgtattctttttaaaggaaagcaaatatttgataatttgcttattcttttggcatgtgtatcagtataggatcttaatgttaatttttcttgagtacctgagtttttgaggctttgtgcaaatttttgatgtcaggatagtttgggtggaatctttctaatagtggaggattttattgcccattttgctgtcgtaaatttgtgtagataatgccaagacattatatacatagagaataatttgataaggaaactgtctttgtagtaataaatttaaccctaatcatttgatttaactaatatgctcagtcttgattatactctttaattgctgttagtgataatcagtttttgattgtttcaaaaatattttatgtgtagaaaagctgcctttggttctgagataacatttaccctcccataccttacttttaaaacttctcaagaatgcagacctataaccaagaaaattttttacattcatcaaaaatagttctttaatagaatcagtattaataaagcttttactaattggtttatcattctttatatttgaagcagtagccaatcttgtatatagttctgtgacaccgtggaatgacattaagtgaactgcagttctaggaattgttccttgcatgcatattgattatttatttcctagaagatgaaaatgttaacttggcaaatgtagggggcacagatttctcttacctgtcctcttttgtctcaggaaatgtttgatgctactctgaaagatcgagaactgagctttcagtcggctccaggtactaccatgtttctgcattggctagtgggaatggtatatgtcttctactttgcctccttcattctactactgagagaggtaagtccacagggaaatgctgatgctgtacatttataaaaaggacttttgctttcaccaccagtcatgtctcaaaggctatgatgatttcctacctaaatcatattctctactattttattctaagagggaataacttataggggactttgacttaattactttaaactgtttcagttgtttgtctccataattggcaagttttaatatttctgtctgagtttgaaagacgattcaactgaggaaaaagataagagtactcattttgtcacacttcgtatatactttagccatcctctaatacagactcttggaattttgtatgatgtgagtgtgtctcagacttcaaggaactgtactgctggaaataaccaaaaggatatggttttgcaggatcagacatgtaaaatcattttgatttaggcgccttaagtatagaattacaatgagggtcctttatgattccagttcactggcctgatggattacctttatttatttat

SEQ ID NO: 114388 - DNA, 1045 bp, Homo sapiens
aagtttgggcagattagatgcgttacacagagggtaactcagtgagtttggaccacatagaactagtacccagactcctcctttaccccatcacctgcagcctcttgggtgatgattttcatttacagggggaaggcaaatcagaccgtctatttagtacatttataaattgcaacataacccttttacgatagtaatggttgtatttatttttcgtctcagaggtctagatttcttgacacattggacccaatgaatgttttttttttcccccgcccctagtgaatgatgatgtcaaaggacatcatcagacacagggtagttttcataaagattctggtttaggaacttactttcctaagaataccatgtacattttctggggcccactttagatgccagaataattctaagtgcttatctttctgttaatgttttagctcatatatagaatttgaagacattggtgaatattcatagtatttaaaatatatttgcaggtacttcgacctggtgtcctgtggtttctaaggaatttgaatgatccagatttcaatccagtacaggaaatgatccatttgccaatatataggcatctccgaagatttattttgtcagtggtaagaagatgtttccattgttttttttttttgaattaattgtgctaacctatagttttgtttaggtttttttttccagttctcaagcaggctgatagagtatattgaataatatatttatctaagcctgtggtattcagttgtcaagtagctgtgttattggttactttgttaaaataaatatgtaaaaagatatttactaaaaggaagatacttccttgttccatagtagtataattcaggggtccctagcccccatgttttggctgggtactggtgcatgtcccgttaggaatggccgcacagcaggagatgggcagcggtcaagcaagcattaccacctgagctccacctcctgtcagatcagccttggcgttagattctcatgggagcgggaaccctattgggaactgcgagtgcgaggg

SEQ ID NO: 114389 - DNA, 1035 bp, Homo sapiens
tgacatagtgattcgcccacctcagcctcccaaagtgctgggattacctcacccagccgtaaatctaagtttttctaaaataaaattcttaaagtaacattatgtcctttgaaagcttttgtagccattaacatggggcaagtcttagctggttacaagtgatttattaagttgcaggcatttctgcttcctcattttaagtttccagctcattccttaggtagcaagtggtgattatcctttgtggcttccgttttagcatttgtgtcctagatgggaggtccttacaggaagaggggcaggcatcttaggaaaacatttttatacaaaatgactcaaagataatgtgtagagtgggaaccgcttgggctttgagtagacacaggcctggactgcatattgcttgagtgtgctcagaagtctgcctgtcttgcacaggagtgattgactcttatagtggtgtcataccctgtttccttctgcagattgtctttggctccattgtcctcctgatgctttggcttcctatacgtataattaagagtgtgctgcctaattttcttccatacaatgtcatgctctacaggtaagttttaaaaatttagaatagctttactaatttatctctattagggatttgatgttcagattacattaaacatttaaaacatttcttatagttactggaaatcatctgacaattaaattttgctttattttacctttatttttattattttttaaattaaatttaatgtttaaaaaattttctggaccttttccactttgcataaattttgccttattttagatcagataaacattagtacttacattttgtaaaggaagatgtttattttttctgcgcataaagtatgcatttgcacaccattgaaatgttttaccatacctaatgagagtgtattagcatcatctttattttgaaaagcacattataaagaataaagccagagttgcacatttaattattaaaaatagggtacaaggcttgtagatggaacatcttttttgctt

SEQ ID NO: 114390 - DNA, 1029 bp, Homo sapiens
cagggtctgactatattgcccaggctggtcttgaattcctggcctcaagcaatccttccactttggtcgcccaaagtgctgggattataggtgtgagccactgcgcccagcctcttatttggatcttaatgctttgcataggaacatgattgttcaaaaataaaaggtttactctacacatagtaaaatctcaaatttgtattttattaaattagaattggaaaatacttatatcctgattatttaaagtggcagaaaaaatgccagtaagggtatagaaagtgggcaggatggggttacaatttaggaatagtgactggtaaagacctgagggggtgacagttgaggaaagccctgaaggagttgagagagtgagccacgtggatccctgaaggcagaatattcttgcagaaagtaggtgcagtggcacccaggtctgtttgaggatctgcagggaggcaagtttgtctgtagtaggaggaggaaggcaaagaattggccctgaagtcagaaaggtcatggagagccacctcctagagagtcttacacgacataagcactttggcttttgcttgagtgaattgaggagctcttggaaagctttgagcaaaggagtgatctaacttaggtttaaagaggatcattctgactgctgtgatgagaggaaactgggttggagtggctaggtcagaaacaggaagccagctgggaggataatgcaatgatcctggtgagaggtgagggtggcagagatgaaggggaggtagcagtggaggccttgagaaatttttaggatattgttaaggtacagtcaaaaggattctctagctgtttggatgtgaggtgtcaaaggaaggagtgaccttttgtgtaacatgctactaatatagcaagtgaggagagaaccaagacctacccatcagtttagcaaaatgaaagtctttggtgacccttatcagaaacaatttggtggagtttgtggggaaagcctcactgagttggagagagaatgaaaggagaggtaataaa

SEQ ID NO: 114391 - DNA, 1100 bp, Homo sapiens
gttttctgtcttgatgaatgagccaattggaagatagttactctaaattatttgtaatgtttctacatattaaaagtattgacatcacaaataagagaagaaattccccacttttgtcctattatttgcataacagtttcatttggtgataaaaacaatgaaaacattaattccctcaaaagcttttttagacctaaaagaataagtaattggcatgacaaatcagagtgtatgtcccagtagagctcgcctccattgaacttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtatgtgtgtgtaatacaagactgatcttgtatgttaggaatagtgaatatttttccagtcatcttaaatttttttttttggcacatttatttccttactatattgtttcaagagagttgattttttgaattagaagaaatactctttcaagatagtggctttctggttcattcttgttcagagtcctacgttcagatatatgaggtttaaaagaaaaacaggttgggcacaatggcgtatgcctgtaatcccagtactatgggaagctaaggcaggaggattgcttgatcccaggagtttgagaccagcctgggcaacaaagcaagaccccatctgtattttaaaaagtatatgtatataatatatttttactggatcatttagtagcatgtttttctttatacacgtgcatgcacacacctacacatgcttatattacttacttaagggcctta

SEQ ID NO: 114392 - DNA, 1074 bp, Homo sapiens
tgcactatctggtatactagtcaggtggctaaatggctaccatatttgacagatacagggtatttctatcagtatggtaagttctattggaccatgttgttctttgagggagccagtttgatcagctttattaattactttaggattgtgcagagccctccctgtataccagtccacctcaaagttcacagatcagcctgtgtatgggtgggccaccgttggagcaggggccttggccagtcggtagcttttcttgggcaaacagaaacctagtcctaagaactggattgtgagaaaaaaacagcccagccagctgtgtgctttttatgtaagagacttgagtacctgcagattttctggatcctaaaaccagtccccgtggatactgagggatgactgtggttgctctgttaggcatcagtctcaaacctcaaaatggaaatagagtttggctcagaaagatcctctttaatgatgtgggctcctgtttcctaatagatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaaaaaaaaaaaaaaagacaaaaggaaaaaaatataatttttaattattttaggtgattttaagcagctggtttagaaagactaattttttttttaattctaggaactcttataaaattgttt

SEQ ID NO: 114393 - DNA, 1050 bp, Homo sapiens
tagtaacagttccccagtagaaccacaaatgcttcaagctagaagctatctgtgagcctttagaatggtttcttaggccaaactttgctccacagtcttaatttgacataaatcagctcacttgaaaccaatgaaatagcctaaagatagtttgaaataaaatcttggcatttattttatttgctttttgagatatccattaatgaccagactttctctaactcttgggaaaacaatatagatttttaaaagatagaagaacaatttttgatggaaacattgaatttgagctgttgaagaaaaaaaattctctgggttttcagtacgttagtcttttgtaaaattgttgccaatcctatagaacttctattttgatgtgaaataatgtaagaaaattatacagcctctctgctgtgtttattgttaaaaaacaacagaaatatgttaaatggtttttaattccctaggactgggcacttggagtcctgcatgccaaaatcattgcagctataacattgatgggtcctcagtggtggttgaaaactgtaattgaacaggtaagcaaaatcagttttcagagaaagacattctggaattggttgtgtttatgtttggcagctataactcttatttcttatcttcctaccttgctgagttttctacattttttttgatgggcatatataacctttttttttttttttaaagacagcagtttagttttaccactgtaggggaggaaaataatttgttctcaacccttgttttttttagttaaaatggaaccctttaataaaagacaacagaaaaacaaaagtttattaaagtacatatttcatatatacatggagatacccagggaatgagtaatttcaaagaggtggctttgaattccaacgaatcttcaacaaagaataataaatttttagagaagtgacaagatgaaggaaaaggactttgagtctctaggggtggcaagtgaggggaagcaaaaaattggcagatgcggctccttagtaaagcttggcagtgttgattcctctggtgcca

SEQ ID NO: 114394 - DNA, 2009 bp, Homo sapiens
ggggacccctcttatccttaggccagtgccacataagtaagacataacagttctgcagcagtaaagtacacctctttttgctgtatgagaagtaaagacagtagttagccaagcatgctcaagaaaatctgttcaaaaagtgcctgtatttcaagattttgattcttaggagtaggggggttagggagccagcaaattgcagtgtgtttgtgtgtgtctctaaagtatgggctaattctgaagtccaccaggagtgtgatggattgggggcttctggcttcatatcccttcaggatcagagtgcaggccagtacactctagaatggccaggttagcctctggcccttgaaaaaggagcatggagatgggatttattcatactggaggctgtggaacatcattgatcttctaaataatttgttatcttattcattgttttctcttgcgtatgtgcgtgtgtgtctctgtaaatttaagaaaaatggttggaaatggttgagaaacactgggatgccttgcttcattgattaaaatgcatttgggttaactaggtgtctttgggaatggcagcatgcctttaaaaggttaagcatgtttgccattcaaattccgaggtgatggggttgagttatgctacattcagtcacagctaagagaggtttaagtgctgctggtgaggcaagaggagaagaaaataacagccttctaagccttgtttctgtctgcactccatctaaattttctgttcccagggttttcccatttccatccattctttcctctgcattactcttgtagaattttctggataagatgatggaaatattctagtaattcttggacttgctttttttatattcactatagaattctttcatactaaatttttaaataccttttgatttgttaaaatttgatttatgcaagcttttcagaaacgcttcctgcttcagtgttttctcatcatactcagataaaatgaatgcaatattgtataataacacaatattacatattacgtatctctttcataagatgtatgaagttacttcaagtaatgtggtcttgaatgaataccactgaatgtcatctggtattgtatagtgcaagtagagtataaattattctagattagtgtcttatttcatcacttagcagagctaactgcagagcgttagtgggtaaatacatttcttcagaaactcgtgggcactatgcttatgttgatataccagaatttgccttgactttagaagaagtaaccagtttgactatttttgggttggcagattcagttgtgtggagattgctgtattaacttggaggaatttgtcttgtatctttgttctaattgctttttgtaatgtttcaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttcc

SEQ ID NO: 114395 - DNA, 1060 bp, Homo sapiens
ctcactctgttgtccaggttggagtgcagtggcttgattgatctcggctccctgcaacctccacctctcaggttcaagcgattctcccaccccagcctcctgagtagctgggactacaggtgcaacgccaccacacctggctaatttttgtattttttggtagagacagggttttaccatgttggccaggctgctctagaactcctgacctcaagtgatccgcccgccttggcctcccaaagtgctgggattacaggcgcgagctactatgcctggcctccttgttttacaaatgagaaagttgggggtcagaaagggctcatgacctacacagattgtagaaagttaacagacctggggcttagaaagcttgtctgccccagtccattcttctaggggaaggacatgtttacgtttcatgtcactgttatttcacatacactgaaagtttttcttttttggttttctaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaagtctggcgttctgttcgtctcttgtttaagtgttttcacttcttaatttatgtatctgatgtgacaaatcataggagggaaacatgctcagattctggatatacttggaggtgggattagcaaggtttgctgacagattgtgacatgtgaaggagagtggaatcaaggacttagttggcccaaacacagggaatatggagttgtcatttatggagctggaaaagactgggtgaaactgttttggagagggaggttttttttttttggtggtggtttttttttttttttttttgagacggagtctcgctctgttgccaggctggagtgcagtggtgcgaacttggctcactgcaacctccacctcccaggttcaagcgattctcctgcctcagcctcccaagtagctgggattacaggtgtgcaccaccatgctcagctaatttttgtatt

SEQ ID NO: 114396 - DNA, 1048 bp, Homo sapiens
gcttgtccccccttgcacaacaaattatagagttaccttatttattctgaggagtaagatttttgagaatgaaatttatagtgttcaagacttctccaaagcatttactgacagtaaaaaatacaagtacacttaggcagtcagagtacaaaggactgtcaactgaaagaaggggaaggggtattttcaatgatgaaaatcaacttcttagcactcaactttttggcagaggagtaaatactgcaaacagaatgacaagcaagacgtgccctcagggaactttctacctgcttctttctttatgctggatgcctgcctttctgcaccctgcccttctcagcctttgccaggggtctagacgttcccattgacctcttctttctcatgctctatcttcttctgctttttcctgtagcccagtgtcctctttcctcttttcccatctgttcctttatgcagaaaggtgttgaactgtagacttaagtgagggcatgtcttgtcagctgttgtatatgtactctttagcacagggtttggtctgtgggaggtgctaagagtgagtgagtgtgtgtgtgtgtgtgtgtgtgtgagagtgtatgtgtgtgtgtggtgggcttgagtatgagagagtgagtggtggtggaagagagggagttgggttcagagtctcctttctctgccactgaattactctttggacttgtacaatttaacttggtttctgtatgctttttatttacttactttgtcattgccataatgctgaccatatttttagtgtatcttgctatttagtcattactgtgtgccaggtagtgctgtgtatattttagtagatattgctcagccttcactgtttaaaatatttacaaaattctcaaagttttaaaatcagtggttggttggggaacagtggggtaaggaatggctaacttcaagaaaagaaggtaagacaaaagaaaaggaataaaacagtgacattatggataaagatgcagtaagattagcgtacttttaaaaaagtgacatattaagctactggacataa

SEQ ID NO: 114397 - DNA, 2922 bp, Homo sapiens
atgttggccaggctggtctgaaactcctgacctcaggtgatccactcgcctcggcctccctacgtgctgggattacaggcgtgagccaccacgcccagccccttcctagctttctgatggtcatgtttttagtctgtctccttagatctgcccactaagttgttttataaaatctgaaccttaacagataaatccactgcataagtttactgtatccctcctggcctccacaggtctgagtttctgagaccccctaaaccactgactgaagcatgtcctccattgcacagcattggaggccttccagcctgtgctgcttctgcagcttcctacaaacccatacctaggtagatgtgtcagcctttacaggtgttcactcgggactccctttgacttgcccaaccattgacgagttttaagtaggagttagatttaaaaagacatatgaatgttttactctgtacattcatagaagagagtaaccaccttgtttttgcaacctaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatatatatatatttttttttttttttttttttttttttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgc

SEQ ID NO: 114398 - DNA, 1853 bp, Homo sapiens
gtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtagtctagtttttttgtttgtttttgtgttattgcaagattgctttaagattgcagaaatatgcattattagccagcatagataatccagatgttataataggaaggaaaaacaactccagttaaatgtgactgtggcgactcccttttatgtatacatttaaatgcatagttgcagaggacacatccctccccttctgtctccctaacttgaactgtagaccgtcctcactgggaagagtaaggccccacattttgtgcaatagcaagctactgcccacttctgcatgtctgctacgagatcagaaagtcagtttcactaaggttgtcttttagctgaatact

SEQ ID NO: 114399 - DNA, 1056 bp, Homo sapiens
tgactgggtctgagctggatcccaagattctgcatttccaaggctctcccaggggatgctgatgctgcgggtccttggaccacactcggaggagccactcacactggaggacacactcaacataaggccacactcgctggcatgcctggaggatggggaggggagggcttccatacggctcccacctggaccccactgcccccgcctcaccgacccaccccaagcacacgcagtctcaattccaatgtgtgcatctgttcagcaaccaaaataggattctccaggctgtgcctcccaggggatcctaggaatttcctggaacagagatggggttttcaggatggccctggtctccagtcccctcctgacaatcctactccgggaggttcatctggatccccctccagcctcctggaagtctggctgcgcatcaattgcctggcacatagatgacagccattaaatgcttttcgaattaatgaaaaaaatctatcagtctatatttgtgtatttcgtagctccaggggacaatcaaaagaaaataaaatcccccagctgaaataactacattggtttatggcctatttattcatttatctgcccttgtggaagctaagaagttcctatttttagcacctcccatgctcagacatgggttattttttgtcttcaaactctcctaaagagttgacatgttggctgggcacagtggctcatgcctgtaatcccagcactttgggaggtcgaggcaggcggatcacctgaggttgggggttcaagaccatcctgaccaacatggagaaaccccgtctctgctaaaaagacaaaattagccaggcgtggtggcgcatgcctgtaatctcagctacttgggaggctgaggcaggaaaattgcttgaattcaggaggcagaggttgcgtgagccgagatcgtgccattgcactccagcctggacaacaagagaaactccgtctcagaaaaaaaaaagagttgacatgtcccagcctattaccgcaaagccgtgccgtgcatttagtgagaggagacagtaggga

SEQ ID NO: 114400 - DNA, 1038 bp, Homo sapiens
ccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaagacctgagaaggactggctggtggaacaccttccaccaagcaaagcacttcaagggaaaactgcagag

SEQ ID NO: 114401 - DNA, 1117 bp, Homo sapiens
tggggcctccccagccatgtggaactgtgagtcaattaaacctcttttcttataaattacccagtcccaggcagttctttatttctttacagcagtatgaaaacagactaatacagtatgtatgtccataaaagaattggaagaggtttttttttttttttttttgagacggagtctcgctctgttgcccaggctggagtgcagtggcgtgatctcagctcactgcaacccccgcctccgaggtttaagtgattctcctgcctcagcttcccgagtagttgggactacaggtgtgtgccactacaccgagctaattttttgtatttttagtaaagacggggtttcaccgtgttagccaggatggtctccatttcctgacctcgttatctgcccacctcggcctcccaaagtgctgggattacaggtgtgagccaccgcgcccagctggaagagattatttttaaatgatgtccctgaatttaaaggacagttgaaggtggattttacttatttctactaagtcagagatacagaaattgaggtagaagtgaaatcccatgtcacagctggctcagtggcaactgattggattggagtggtgggatttgagagcaatttcaaagaaacagagaaataacgacgtatgcttccagaggcatatttatgtcaggtctgatgaaactcagatcagaagtaggcatctgatcagatgggaatgaagaatgaagcatttctctctggcctctgtttctgggatgcttacctggcccttgaattaggacccacacttctggcaagggacattccagctgggagaggcatggacagggaggcccaggaagaagcaggtgtaaccacgtcagcctgtgctcagcagaggtgcccagtgaagggtgttaagtgcattcatagtggcacactttttctgagacaaggaaagacagaagtcacattccagtgtccacttggggaacaggcccagacggggctgcctgacactaacgctgcggcatgggcagtaggtgaagccatgtgttgtggggatggtaagtttcagactcagaccacaccggaactgcctcctggctccaccacgggagcacctatggcacctccc

SEQ ID NO: 114402 - DNA, 1063 bp, Homo sapiens
tgcaaatagagttgaaggagctgggctgagtagttgggatttcactccccgggtgattggtgggacccagcagggccagtcctgggcttttcctatggcaagtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttc

SEQ ID NO: 114403 - DNA, 1048 bp, Homo sapiens
tttgttcttcttttgttgctcagtagtattcccaagtttgattatagcagactttgcttatctagtctcttgatgaatatttgggttgtttgcaattttgggatattatggataaagctgtcctgaacattcttgtatacatcttcatgtggatatagactttaatttattttgagagagtatccgtgaatggagttgctggctcataaggtagacatgtgttaaactttaatagaaactgccagtttcccagtgtggttcttccattttacactcccacctgctgggaacatgagagttccacacccttgccaacatttggtattgtcagtctttttaattttaaccattctggtgggtgtatggcggtatctcattgtgggtttaatttgcatttccctgtgactaacgatatcgagccctttcacatttggaaaaggttataatttaaattttgtacattaaaaaaaaatcaagttagaagacattaatgaacacctgcagaacagacatcccaaagcccagaatgtcatgtggaagccaccgccctgacagctatgagtcagacagacagatgtcagtttcagttacaccttaaatcacaaatgagttgccaactcagtttaaaaagaatagggttggggggcatatatttaaagaatattttgaaaatagaagaaaatgtggcaaggctgtctcctcccacaccagctcccacctgagagccagatagttagcaggaaaatctgatcacgctgctttctaagaccctgcgtggttctccaccaactttggatgcacttcagcctcctcagccctcgtggaagcccgtcatgacccagaattccccactcgtcagctccacgcctttgcacatgcttgcctcccgcctgggacacggtccctccaccatccctggcgctgcggacctcccaccattgcttggctaacgaggctcaacctggctgggtgccaactcctcccagcctgggcaagttgccagtcatctgtgctcccaccatcctctgggccgagcctggcattctca

SEQ ID NO: 114404 - DNA, 1131 bp, Homo sapiens
agtctgttaggaggcttggggccaggggtggggggtgggggcagttttgcctttgccccaggctctgcctgggagggaagagtccttgttgccgccacccacttctgtttgtgttttgcgttttgcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgct

SEQ ID NO: 114405 - DNA, 1083 bp, Homo sapiens
ttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaa

SEQ ID NO: 114406 - DNA, 1028 bp, Homo sapiens
acctaagcatcattcatattgtttctaaagggaaaaacatcttactgtgtcccaacaagtaagctccctattttgggagcacccctgctttgtaagatgtgtcctactgcccagagtgagtcattcctcacagagccctgctcctaggtgcttggtgataaggggaatcaacagaaacaggctgtttcccagcattcacttgcagatgactaaacccagaaattgtggagtagccttaggtaaggagacgaaagttgaaaacttaagacccagattcttcaggcatttgagactctggctgaggaggcaaggcatgccagatcgtttatgctcagggtaagggtgcacatctgtctgcatgttactgtcccttttgcaagggtttttttggtcatgagtgacatcgcactttattaaaaagacatgctttcttaacaagatgagctacctttgatgcttagtctttctctggtttaggcaagagtcctgcaaagccatccagctgttgttggcagctgccaggagttgccataaagaaggtagatggagtttttcctgttgaattcgttaattcaggctcgtgaatgtggtcattgataacaccccatccctcttttccttaccgcctctagctaattgtgcttatcatttaagcttcagctcatggctctatcaccattctcaagtttgccttgaaaagatctgaagaagtacctgttagcctgagctccctctaaagagggagaaaagccaatcttccaggtcagtctggcaaaagctggaggaagggcccatttgcttggggactccagatatcaacccatggccagcagatccagctcagccagattgtcgggtcacaaaaataaatccactatctctaatcgctcttttgcctcttttgcaagcctttgaggcgggcagggcatgagagttactcattcctaagaaatgagcaacaaacagttccagctaagcaccctggttcattcactgcctggccacgaccacaaacttgtgctaagctg

SEQ ID NO: 114407 - DNA, 1001 bp, Homo sapiens
catgtacacgtcctgaatagcaaacctaaaaacatttataatgcatacctcatacagtagaacttcagctatttgtgttaattatagtgaatggtagtcagatgtgctttttaaaaatccagattattaaatacaaagaaatatggtggtactttcatgatcaagccatggcacatgcttgtctattccagaggtgccaggtgaattcctcgtagaggagatgtgactgaaagcacaaaggaggattacttgtaatgaacgtatcaattatttgtagattgagggtcttttgattttaatattctttctactatcttgtttatgttgcctataacctttgacccaatgaacatgaacttcaaattagtgaaatccaacgaaataaggttttactctgtcagaaaaatcactcacccaacaacaggcacagctgtgctcctgtgctcctgcaccctagttagaggtgctgagaacatttcacagcatccagagccttatctgttgaccccaaacgcattcctatatgggcctgcagtgtaggagtccacctgcacaaccgcacaaggactttcccccattgcttacgatgacaaagaaaagtggaagtgtggaaactgttatcattaataacatggtttcagagtcgctgtgcttttcacactgtacgctatagcccgttggtgggtcatgaagtcagttgagtggatggagatcagcagggatgggaccatacagatcccatattacatgggattagtgcatcccaggatacaaggggcagaattgtttgtttagggagatatgtgcgtgtgtgtgtgtgtgtgtgtgtctgatatgtgtatatgtgtatgcctgtgtgcgtgtatgtgtctgcatgtgtgtgtgtatgtatgtctgtgcatgtgtgtatgtgcgtctgtgtgtatctgtgtgtgtatatgtgtgtgtctgtgtctgtgtgtctctatgtgtgtgtgtgcacttgtgcccactgcatcaca

SEQ ID NO: 114408 - DNA, 1060 bp, Homo sapiens
ccaagccaagcaggagcagcttcctgtggctcattggttttctgatggtggacacagctgccagccaccctcttcccaaggctggaccaccagagtggacgaagtaggcaaattcttgcacctgtgagtcttttgtactccaggtttctgttgtcattccagagaaacaaatactaacaatttctgggcagtagtttgcaacttaggcttccatactgaaatcacatggagacccttgagaattgccgcactagttgaacctcaggggtggacctggctgtctgtgtagctggggcaagaacttctgatttcagaatggttgaagcatttcctccctcggatcatcagccagatctagaattacaaggccatgcccttatgagtgactgggtgtccttatatgatacctctgctgccaaccctcctggggcctgcacaggggtctccttgcagacccctcctcccctgctcaacacctattttccttaaaggttcagatttccagttgggttcagggaccttgaaaggaatccatttctctcgactttgcaatacgcaaacaggcaccactaacacacctctgcgggagctcgtccacgtagaagaaagcactaagctctctacttatacagcctgtctccagatgatgtctcagtcagaagaggagagggtgtggaaggggaaagaggctgtggaaagaagctaaccttgattcctgtggattaggcccatgcttttatttcatttcattccagcagtcctgaatagtaggtggtattctccccagtttatgtacaaggaaacagaaccccaaagaggatatcagcttgcccatatcatgcaccgtgctaggtaacgtagcaggaagttcaacccagttctcatggagtgctcagcgggctaggcttccaaatggatagttgccaagagtaggcacccacatgaggaagtggtgcatgttcttggtaaccctgcctgtctgcttctaagtggccttccccattgagtattgtctataaaacctgatacagtatgagttacggagcggccacgtgaggga

SEQ ID NO: 114409 - DNA, 1042 bp, Homo sapiens
ttctcctgcctcagcctcccgagtagctgggtttacaggtgcctgccaccacacctggctgatttttgtatttttagtagagaccggattttgccatgttggccaggctggtcttgaactcctgacttcaggtgatccacccacctcagccttccaaagtgcccatatggagatttttaaggtcagaggtataaactgtacatactcactccctgggagaaattccttgctggactctggttttctttgaattgcagagtaaacagctaggctttgtgaattacagagtaagtagtttatttacccctgaggagggaagaggcagcttatttgtgctagtgtagcagtgagcttgggttctaagtttgaagacatcacttcacgcttcactggggctcagtttttctcctttatgaaattcgaggtttgggcctcggggcaagtcacagggtggggctgtgtttgctgcagtgagtctcacgtcccgcttcagcatcagggtaccagcactgttcatcccccaggtaaactcctctagtaacttcagggcaacccctttagacttacggggtgagctcttgcgggtggctgtcaccatctgtcatctgtctccaagaccatagttagaggaggggcccaatagcagcacccctcaaatgccagcagcatccctcaaatgccaacagcacccctcaaatgccaacagcacccctcaaatgccaacagcacccctcagatgccaacagcacccctcaaatgcgctttcctagatgttacagaggaccatgtgtgaaccttttctggcaggaagctctggtgttcttgtttagtctggcattgccagagagtaggcagctctgaagggtagatagtttttaaaaaaaaaaaaaaaaggcggcccactacactaaaggataatcatcaaggatagccaagagcacagttcataaatcaaaatcactgccttaaaaatgttgagaatgctttcattaagtgcttaaattggataacagacttgtgcctcaatgctcaatcagaaata

SEQ ID NO: 114410 - DNA, 1018 bp, Homo sapiens
tcagagtgcccttatgagagggaggtaggagggtcagagtccaggaaggagatatgatgatggaagccaaaatcagagggatgtaagatctcaagccaaggaatgcgatgcaggcagcccccaggaggttgacaagatgaggaaacacatcttccccgggatcctctggaaggagccagccttgccagcccatttcagactccagccctccaaacacaaacctataaatttgtgtttttcaagcccctgtgtggtgatttgttaaggcagcagttggaaataagagcaggattattccaaattaaagaaagtgttgggtcacttattgaattgcaaacgtgaagaatgatacatatttttaaattaaatacttgtcacttaaaatgcattttaaatttagttacaaagtgtagctggatcatccttgctatatcttgtatactctcacattggaatttggaaggaataagggaacaagtggatttaggtaagagaggagtaagaattaaagtgtcctgggaaggcgagagggaaaaatgagtccatccattgtagaaaggcaaagggataggaaagtgaagcagagagaagaaagcaacagagagagtgggagcttcataggaaaggaaaggtatattgtctattgctgcataacaaattactccacaatttagcagcttaaaacaaccaacatttatgtcacccactgtctaagtgtgagggagtacaagtaggagccacagatttgggtggtcctggctcagggtctgtcatgaggctgcagtcattcgaaggcttggttggggttggaaaatccacttccaaaatttcggctgaaagccctagttcgttgccatgctggtctctctataaggctgcctgaggatcctcatgatggcatgacaattggcttcccctcaaataacaatctgagagagggtttggagggagccacaaagcctttttaatgacatagtctcaagtcacagtcacttccaccatgtttcattggtcacaa

SEQ ID NO: 114411 - DNA, 1058 bp, Homo sapiens
cagggggaaaagccgagtaagaaggactccagagacaccaaaccatggtgattcagtcgtgtttttacttaccaatagatgggacagatgagaagcaggggatcccaggccaggtgggccactgctactagctgccatatgcatctattttttgcacattgtatacctctctaccctcctatctccactgcctgctccttttaactctcctttctcctccttttcctcctaaacctaagctgattctagcatcctgtagccatcaagaggcttgtcttggccttggagattttccctgcaggctaaagagattttagggctcctccaacaaaggcctctcctcccaaatgtcagggacgcatcagatgtcagcgtgacagttctgtgtgaggtgccaaatgagcacctctcctggctctagaggtcactgagtagagacttcagtagatatggctcccccaggaccaagttcaagggcccagctcttgatagaagagctaatctctctaggggcagtagagacctcactggtttgatgatcttttccatttagaagtttaacaggagaactaggagaggaaaggaagctacactgggggaagatggggcctaaggatgggaatagcccttaaagtttgtaggaggcagcaagaaaggaaaactggcatcttcttccccaactggctgtcaactcagcttctgagctggtgacttgccttgggctgctggagtacagtggggagatcacacagggattcagccagactttgagcaaggactgtattcctttatgcttaaaggtcccttcaaggaagatggacaagggcagggtcacaggggagagaagagactagtgatggagggatttagacgtgttcctgcaggagcatggcagaaggggtgaagcaaggtgtaggcatcaaagatgtagggccaaagatgcaaagatatggggtggcagagagcttcagccacctaactggcccctgctaaagcccaggagtcaccttggcagagatggcccacagacataggcagtggcctggtggcctctagcc

SEQ ID NO: 114412 - DNA, 1143 bp, Homo sapiens
gggcatggaagtctttttcagcttttgtaaggtgtttctgtgtgaccctgaaaaattcactgaacggattggtgcctgagcataagcttgtgaacagtaatagcaatgttgatgagtgagtgttttaaaagatttttagatgaccagatggaagccatgatgctgccagggagagaaaagaaaggagagcaggggcccatccagcccctccaaatgctttgggcctggtcagctctccattccctctttgggccatatgtcggctgcctccctggcctgtggacattgtgaagatgcagcatatgttggttccctgatgggcaggactttgcactactctgatatctgggattggttagaagaaatccattcagcctaaggtacgagtctcgcttcctgccaacacggcactcagggatgctacgctgaaaggatctgactttcagagggatctaagtttgactgagacaccagatcagttgaagagcattattctcccccaggagtacaatgaactgaaagcgctgcaccagctctattccccgatggaagagggcttggaggagtaataggagaatgatggcgatgttgaaatgcatgaggagagttacttagcatggagactgtcaggtgccttaccatctaaataagtgcagtattgcagagctataagtgaggagccagcagaaaatagtcattcgtttgcctggcaaggttcatgggacactgagaggcaggacatgctgtagaaagcccatcaaccatcaggctcctgttagggtgggtgataaggtttggctttgtgttcccacctgaatctcatctcgaattgtaaccccatattcctcatgtgtcttgggagaaacctagtgggaggtaattgaatcataagggtggtttctcccatgctgttctcattgataatgagtgagttctcaggagatctgatggttttataagcgtctggcatttctcctgctggcacttattctctctcctgctgccctatgaaggggtgccttctgccatgactgtacgtttcctgaggcctccccggcgatgcagaactggctcttaaacctcttttctttgtaaattacccagtcttggttatttcttcatagcagcatgagaatggactaa

SEQ ID NO: 114413 - DNA, 1033 bp, Homo sapiens
caaagaggtctaaacaccaggaaacaacattctgtccatttatcctctcagcatgagtctttgtctatttaaaatatatttgcctgcctgctatgtttcttctcattcctatggtctgttctactcctccttcctatctccatcacttcacagcagcaaatattagatatgaacacatcattcaaggaagggccatctcggatgtaatgaaacagactgatagattatttcactcaccatatgcagagctgcataggaaagtcataaatgagttggaaaaattaagtagtagttgcaatatctccattttaggacaatttctgagtggcttaaaacgtgtttatccctttaaaaaatattagtgaaaaagcacagcagatgaacagctctctgggtccacagtcttgatacagtgagctaaatccattccaggctgactttgagggttgttaacaacaaactgatggcctcaacaaagcggttcttttcagatcttttattcctgtctgaagagaaagaattcagcaaaatccaggtgctatttggacacattgcattatcttcttgactcatttgaagaagctctttttcaaatacaaacatgactcgagaacaacatagcaaaagctcttcctatatgtcattgccatttgctgcataaccaaccaccccaacccgtagtgtctaaaagaacagtgaatcttcacctctcatgattctctgtgtagactgggcttagctggacagttctgacttgggcagtctcatgagcatgcagtgagatgtcagtgggctgcatcatgtaatggtcccacagggctggatgtccaggatggcacaatctggtgcaggcaggtgaaactgctgtcaactgggagctcagcaggggcaattgacctagcatcttctctacatggtgccatctttttttttggcgtggtggctgggatctaaaagggtatatcccaggaataaacatcccaagagacccacatatacacacagagagggagaaagagagagattgatttta

SEQ ID NO: 114414 - DNA, 1025 bp, Homo sapiens
caacttaatgctatatgtcttctgagcagaacagtttaacactcagtcaaacgctcctagagtgtttggagtacttttgtattaagggaataaaagattcagcaaaacgctactgagtaatacaggagtatggtttgggggcaagtaaaaggcccgtctgcagtgtggagaggagctttgcagagggtgggaccatcctgcaaaagaagggcttgtgttgtgggacatcaccctcatggtttctcctgtgtgccccagaaacttgaaagaaatccctttaattgttttttcagctaggaaaaccaccagaaactttgagatgtacatcaagctttcactgattccctaagatttttgtttcctctgttctctcatgtacattattttttccagtcctatacacagattgtttgagacactaatgttcaataactctgaattttaatttcctgaatcttctaacatatgtaacttctttagaacatttatggcagtttttttgatttaatacaatttagcctgtgtttgttttgcttcgaacttgttgatatctttcttttgccaagataatatagttctaaaatatataatttatggcagtttttttgatttaataaaatttagcctgtctttgttttgctttgaacttgttgatctagttcttttgccaagataatataggtattggaaaagcttgctatttatttatttattttttaatgagacggggtcttactctgtcacccaggctggagtgcagtggcacaatcttggctcactgcaacctccgcctcccaggctcaagtgatcctcccatttcagcctcctgtgtaattgggaccacaggcacactccatcatgcctggctaattttttgtatttttagtacagacagggtttccccatgttgcctaggctggtcttgaactcctgagctcaggccaaccgcctgcctcgccctcccaaagtgctggtattataggcatgagccaccacacccagccaatgaatacacttttaacaaa

SEQ ID NO: 114415 - DNA, 1015 bp, Homo sapiens
ataggtttatgatacagttagtgtctgatacctgacagcctgtataataattacacccatgcaagcgctcacacaacacaaagaaagactgatttacattacaagtaattcaattagaattttgttagcataattgacatggtgttaaaattagttagcagttgtttttcccaagtcgtatttaaaaaaaaaaaatacttgaaggcacactagaaaacattttagaagcagtttctgcacaaaaagaagaacatgaatgtagatgattgtcagtacatcagtgtcatttaatgtttgtgttacttttggaatcctaatctcataggactttaaatatatagcaggcgtctcccatgccacctcaccttaaaatattggcatgttttatgcaaaaacaaataacctgccgcaatgcatctgcctacagtagtttaataacttagaatgcattgaattatataagtgtcatacctgaatgatgtctgacatggtccagaaattttcccctaattcataatagaaaaacacattgtaaattataatacacataagaaaataaattatttgctgttacaaaataaaaataaaaaaactacagctgaggaaaattggtaattcgcatttattgtatcaactgactgatgcggagtttttattttggtgtagcatttttgtgtagttttttggaactggtccagtgattcaaattataattgaggaaaatcaacttatcttcttatgctagaaaaggaggcatattcactttctagaaaaacgaaatgtactctaaatgcagctctcagaattgtctaagcctgtcccctgcacttcttgcatgttaataaaacttttcaaatcatccctttatagtactgtaaaggtcgtatatggactgttattcctgcatattgagaattaagcaggacactaccttgaacacttctaaggatgccattcatatatgtgtttgcccatgaactgctttatgtgttttaaacattggcacctttggcat

SEQ ID NO: 114416 - DNA, 1008 bp, Homo sapiens
gacctacatctacattgttagcacatattgaatccatactgcagcacatgttggcacgaacatttttatttctttacaaaaaagaaaaaggaaaaagaaagagtatatttatgattttttttcagaggatgaatggcagtaccagtatctgtgtaggagttgggaagaatgaaggaaattgtctaagtagttctggcatccctgatcgattgcttattggatgtgtggtctttgttatatttttcatttccggcatctaccttatttttcttattgtagaccagtatctcttctctgttagagagttttagtattattcagtgagaagtgtttaagcaaatactgcattttgaaataataatttgaagtcatggcagttccacttcatcattagacttgaaaccagagaagccatattgactttctgtgactctaagtcataggatacaaaaggattggttctgaggggttgggattttcttgttgatggttggctcagtcatttggattgtggcaaagctttggtcttttctcttttgactagtcatcctatatgccaacagaaaacccacagaaatgtcttatccaattttctttgtaaagccagcagtcactgagatcatttttaaacctgtaaaattccctttacagccccatttgctaagaagattttatttgtaattgtatgttattttccataaaatgtgaatctcttaaggattgttatcatagctaatatatttgtaggtactacaccagctattgagttctatatactgttgtttttaaacatgaaagtcaaatataactcttaaattatatgaaagaagtgtcagtcatgttggtagtgataagtcacaaaagcattctcattttgaaaatttgatgatgaaacaaatggaaaaaaacacagcaagactgatatacccagatatactaagggtattataactgtcttgtctatcaaataataaaagtcatggttaagatatattactgacataatgt

SEQ ID NO: 114417 - DNA, 1023 bp, Homo sapiens
tagagacagatctgggacagaattcacatattcttatttcaagttctgtgggcaaaagtgacacaagaaacagcaggaaaattactactttagataccatttctgtttacctcaaactattgaacatcaacaccctgaggccacctttcatgtgtagaatttgaggctgagccatgttgtcatgattcttcatagtagttgtacatggaaatgagagccaaggattaaacgtgtcaacatagaagcaggggatgtctgaggtcttgtgtcccttcattctccagtggtcccttctgcccacctctctgggtccctagaatctatacctccctccctgccataggactgaaccctttcctcgctcccccaacaccaaccccacagccaagtggtcagtagtcaggtaggttctgagctgtttaagcatccattcaggtcacctgtagctgtggtgaagaagagatggctctgaggttccatgacaggatatgtggtagttcttatacagcaaatgcctcaggcttagtcctagatcagcttgaaagcccttcccagttttggggggctctctgaacctataggagcagcacccagcacagaacatatctagggaaattccaataccctttagtcctcctgcatcatgaaatcttccttaacctgtaagccaagtacccatgtttcagctgtgagtcttcaagctcattttcagaaacgcattgtatatgaaaaattgccagtgcctgagctctctaggccccagttttgccctgtgaagagaagaaataggaagagcaaaaccctattataaaattgagacgttaatgctggatgatgtaggaattgttgcggtaattggtcatgaaatgctttatagacacagggattatgattgcatgacattatgtctgtcatggcaggggaaaccatcaggaaagttggtctggtctgtggatctacttccccttttctctttggctcatccatgttttgattgcactttgccatcctgcagggtcttgg

SEQ ID NO: 114418 - DNA, 1026 bp, Homo sapiens
cagcaaagttatgggaacaaattctgtgttttgtacgctgccagagactgcatagtattcaagttattagtgaaagcagcaaagctgtactaagttagtataagaaaatctaacatttatgaaatatgatgaaataggagggcatttttttctttccaaaaatagatttataataagatcattttatattatcagatggcctgttacactggaattatttggtttcagtgcaattttatctttgaaatcatatgaattaacaatgttccttccaaacgtaagtctgaaatacgactcaatctatatgagaaatgtgtctttatatctttgcatttataacaacatgatataagatgtcaaattaattacaacaaagtaatgatcatttgcaaatgaaattcagttgataggcttgattcagaatacataggaaaatattttggggccctttaaatagcaaatttaagttttgaattaacataggattaggaaggagactttggagttttgatttaggtcaaaagcaaaaatcaagaataaaacaagtcaatctcaggaaacagagttcagaaggaaggatgtgaatgtgcccagttcctcatggatactcctgaagtagcatttgaggcacacctttcttaatgtgccttctttgagataagttttattatgatgaggtattcttcagatctaagatgtaatatttgcacctctcaacaatttacctagtacacatttctgagataatgttaaccaaagttatgttagtttttgtatatctcaaagtgtttatatgctgatatcaccttttccccttggagtttcatgataacaggtatcaagccaaacattttaagaggttcaaagtccagaaaatagctatttcaaagccatcaactatcatagagtacaggctgactacctgcaaagccatgttgcctagcgatgctgacctatcatcatgggacatacccctaaaatcaggatgtccacaaaggaacaacagcagtgtagatttgcaaggga

SEQ ID NO: 114419 - DNA, 1157 bp, Homo sapiens
tgtagtcccagctactggagagactgaagtgtgaggatcacttgagctcaggagtttgagaccagcttgagcaacatagtgagaccctgtcttaaaaaaagtccaccctagagatagaaagatgctctttccccactagaagtgactcttgccccagctatcctgctcattaaggcctttgaagtccccctggtgtggggcccggacaactgtagctaagatcagtcactctgcagcagctgatagaatggtcacagttgtcatggccagcacagcttgtgcttgcagagcccaagctgatgagcacctgcattgccagtgtctagctatactcttgaactgtgcctttattgaggccacttgtgtttgcctaacaaagcaggagtgctgggcacagtggatcacacctgtaatcctagcactgaggcaggagagaccacggcattgatggtctgtctccggggctcctagagaccagatatgtattcatagctagacaaatatgtcctggcttctcaaagggtggtccgtggaccagcagcgccagcattgcctgagaacttgctaaaaatgaagaacctcaggcccttcctcaaacccactgagccagaacctgcattccaattaaggcattcatatgcctgtggcattttgaaaaacaccaaaatacgtggctagtaaatttggtgctactttctacttcctgtgagataggaaacccagaacagatattggttgcaggtgtcaaaccatccctgtgtacttcatatgttttactattaccagtaccaccttagccataggttcctaccggttctttgttaagttgaagccgtgcatgaggggtggggtattacactccatccatttcactagagaggaagaacaaccttccactgcaagtaaaaatgcaaagcttgacacaggaccccacattactcattatactccgttaccactatcattattttccagatgcctgcctgttacaaaaagaactgaacaaaggaagcctgttttcctaacagtttgggaatagatgcttgtggttaaaaagaaagtacaggaacaaggggcatatacttttctagggatgagatcacatggacacacttaccatgatgtcctgggcagtgattttgacttttaaattattt

SEQ ID NO: 114420 - DNA, 1112 bp, Homo sapiens
gccagaacaaagtcagagttgagagggtgtgtgtggggtgcagggaggcaggggaagacaactggcagctcagtgtttcttgagcaaagacagagtggtaggggtggtgagacatgaaggcgcagagggagataaggctgctgcatcccactgtaatggacttagcgttttatccatccagcagacaactgacatggtcatatgtgcttgttagaaactttgttctgggcagtgtgtggaggctggaattacaaagaaaaaatgggcagagaatcactttggaagccagtgaagtagtccttcactgcttcttaaaactctttcccgtttgctttgaaatgggacaatacaaaaattatcacttataaatggttgagaaaaaggctagtcagcgacagaacctactttttatattttttcctgacccaaagtttgtttagtttttttttaataaattaagagttaaatgtattattttaatacatctcatgtagtctccagcaacttgatgaggcagacatgatttttacccccattctacagatttaaaaactgaagcttatggatgataacctccttgcccaaagctactcatctagaaatgacagggatgtgatttgaacctacgtcgctttgaccccagaatctctgtagtcttaaatgtacgtgatgcatagttagaggtagtatatttttgtgtcagtggagaaaaacacgaaggatgtagaaatgcaatataaattttcagcttatttaagtgactcattattttaaagaaagtaataatagtatctaaaaaagctgtcgacatcctattgaatgtgtgattgtaacttcaccagtaccaatttttgttcacttttacaaagagaataacataatcctttcactttcgggatttgtagctaaattaatcctgttttgaaaagaaatacgagttgtagacatgcattgaagttgagtcaaacatcagaagcttattttgaggtaaaattgaaatgaatgaagtggagactcttaaccaatgatttaaatcaaaattgacctaatatggagaggaatttggtcaaggcctgtctaacttgtcccccagtcaaatggacataaaattc

SEQ ID NO: 114421 - DNA, 1185 bp, Homo sapiens
gtgcagtgaaagtgcccagtctattatttgccaattgccattccagaacgggtagagaggcataattgaaacttttaatggctagcatctgttcaatcttctcttcctcccttccctcgatctctctggagtcctcctccccacccacctctcatccctcatttcaaatccctccttcccagcttctctccaactctgtgtacaatcctactcccttttcacaccagcaggctctcaaaatcctctctgctccccggggaaagcctggaagatctgagacctcctgcccagaagtggttgacaatgtagtgttttcattcgaatgcaaatttgtctctggacaagattcaaggaaagtgctttcccctccaactgtctctccagctcctccccagcccttgttgtcttttgtgttcttgtaaataaatgagaggcgaatggctttcagtttgaagacacagctgcagggggctcttaaagggagctagagagagaaagatgctgaaagattgggagcccagtattaaaatctagaaaagggaggcttttttagcattctcatttccaattgctctaattcctctagatttttttttaatgctgaaaagacgaagcgaattcattctgacttagtatttttccctccgtttaacttttcattgtccaaaaagaagaatccacgcgacaatagcaacagaataaactgtaagaagtatgtttattcttgatgttctccagataagtatgtaactcggccaatctcagaggtagaaagtgtatctaatgaaatgacctggggcaagggtggggagtgggggacagaaaaagatttactgcccgaatttctcattaaaacaaacagattgtgattgcgaccagggagatcatgattgccctgtcggggtggggctttaaaaatctttatgtgactaatgcgatgcttctgctatttccgaaataacatctacatgtaagcaaacacaggtctcatttgtcaaacgtgacttccctccagtagtcagctggcctgtgccagtgtcaggacaagaaatccgccccaggagagttcggggcgcaggttcgcgtactgccccgagcgcagctgggatcgcagagccgccgggcgcccgcggcatccccggtgtgcctctgctctcggggccgggctgggccgggtgggccgtg

SEQ ID NO: 114422 - DNA, 1044 bp, Homo sapiens
aatgctaaattacagacattttctttagaaatatctatgtattgttcacgctatacctgtcttatatatgtttccctgtgtgactatgtcagtgtccatctagttactccctctatgtctatatgtgatataagtatgatatacattctgaatttgtgagtgtactcggaaaaaatactgagtattgtgtctcctaaaaaaaagcatgggattgctttgtggtttttgatatcaatataaagaaacatactataaatgtgtaatcaggtaaacagaactgtttggaaaatgattgtgatgagtttaggcatagctgcattttgtgaagtctgattttgaaatttgccctccattgtttctttaaggcaggtgcttgatcttacagtttcactgcacaaatacattagctgcagttaaaaccaactcttggtaaaaagaagcagctaccaatctggaaatttttttttttcaagaaagatgtaaatgttgttatttagaagagaggagagaagggatgctaatattttagtttttataattttgaggtacccaccagagtataattttgatcatcacgccagagttaatttattggaaggctgtcttgttttaagcttattttcagcaacataagtccttctaacctctgtgtttttgcttctggaatgaagaactgcaagccccacaccacgtttgcagctgacaaagttagtttcagcccttttgcatttattgggcactatctcttccaggaacccttcctctgaaatgctcactatgcaccactggctctgtaacccccgagcccatctctttcaccaatttattgatgttatccatccaggcattcctctaactaaactgaaagctacttgaggtcaggacttttttcatgtttgtatcaggagcacctggcaggccacatggccccaaaaaatgaatgcagaggtgagaggcaaagagggttaacagcctggtgcaggcaccactatgtgttcatttatgtgacattcacattattgaagcaggagctggaagtttttt

SEQ ID NO: 114423 - DNA, 1043 bp, Homo sapiens
atccaggatgacctcatctgaagattattaacttaattacacctgcaaaagcacttttcccaaatatgttaccattcacaggtcttagggttttgatgaggacatatcttttgagagaggaaggccctccgttcaacccactatcaatatggaagtgttttctatctgtgtataaatccatggcatgtaaacacttaaaatattataccaccttgagaatttgtccagccttaaaatatagaagaatgaagttgtggggagccctaaattaataatggatgattaatgaaaatagtatctagtgttttacaaagttagaagcacgcaaggatcatcatggaagcttgttatgcaatgcaggctcccagcctaatccgtagactttttcatcttgtaggtctctagtagggccccaaaatacatatacttaagaaatgctacaggtgattctgacacaagtaagcatttggaattactcagaacccatatgcctgagttctagtctagtttctgcaaatgaccaatgggattgatctttaaacagtagtattttgatattcacattcttgaaaagtaatgatccatagacttcttagaggattaaaatagccaggataactatggttctgatttttgaattggtgattcttgaataataagatgggactactttatattaaattccacttactaagtgaacctgttaatttttaaaaggtttttataatttttaaaatcatttttattacatttctattttaagggctaaactttgtagttatatgttactattatataatgtcacatctttttgtgcaagaaatagttgcattggactgaatttgaaatattatcatttcctgtatcaatattgtctacagctctcattattataaaaccattgtccagtttcctaatattgattgactcaggggcaagataccccataacagtcacatgtctcttaatggactactcttgttttcatttacgccagtcatggcctttctgaacattgatttatacccagaattccctttttc

SEQ ID NO: 114424 - DNA, 1086 bp, Homo sapiens
tcacatttgatgggatggtgctaatgatttattaatagaatagttgtgtctgttaagaattagaagctgtgttttaggagagaggcatcttgcagaggggacaggttttgaagtccctcagacttggttttaaacttcagctgcctttgccaccttctagctctgtggtctttggtgagtcacattagttccctgaagtgtgacatggagatgatgccacttgcttgtcagggtagccaagaaagtctgagaggcaaatatacagtacttcaaacacaacaggaactcatcgctgtagccatcaatgagtaacactgatgagtgtgatgtaagatttttctggagaaagtttttcttcaccctacaattgatcagtgtcatatacatatattaggatagatcgcaaacctatgtacttcagacaaatgtgcgcacatattatgtgtatttcaaatttcaaaattcttcaattttaaatgaactacatcaaaagtttagattctatgccagagtattttttttctttctgaaaccagccgatattttataaattactgggtaaagattagaatgcctgtttgtgaacaggctacctagaatgaatagttagaatgaaaagaatcttgaacaatcttagtgtcactcagcatctatctgtattttgatttttaaaaaattataaatcaaacattgtgaggtaatggtattcatccctgaaatccagagagctctgtgtgttttaaaggagctgagctgcagaaagtgaatttcctgggaggaaggagcacttttacacctgtttagctcttctctggacatcagtgtttccagtcacatttttaaaaattattttttcgatacttttaagagaaattataaaattttattcttactttggggtatattttccatagcaactcattttctctttgtggagcatgaaattcatttctgtttaccaatatagtctcttcgttaattcagggacttgtgataaaactatatccaccataatagttgaaaaaccaggataaaaaaagcaaatattgaattgcatttgccgtttttattgatgttcagtagcct

SEQ ID NO: 114425 - DNA, 1021 bp, Homo sapiens
tttttctaaccccaagtatttttttttatcttcacatgaatattaaaagtttttcagagtgcaacataaaagagattatttcacttgataatgtgttgatatatgggtttgggggctacattaaaggaaatgaattttctcgtttgcattatcgtgtcagaagcagaaggaaaacacttcacctccctacctctacatctgttgtttcaacctgaagtctcgggaacatggcaattgtttgcttagcagagcatcatcagaacagcaagggaaaaagtcagatcccacatcagcctgaaacattgtcttcaaatgcagtgtgttgaagagagaaccgttactacaaaacagacttctggttttgtccataagtaaaggaaatatttacaagcaaaattattttggccagagaagagaccagctgtttacagtagctgaattgtttctatggaataattccttagcgataggagaacattgtttcattaaagtaattccaaatcctaacaaccgtaacataaaatcccagaccttaggacagagatgtaatatatagtgaatcatgtaactgctgcttttctctgcagctaatgccgaccaaaaaaaaaaaaaatccatttctttgtatgtccaaagcctcacaacacgagccttatttgtccttatttgctggagttcagcccattcaacgaggtttcccaccgagtattttggaacattgtgcctgggacctcctcgccaggacggtggaacatgccactccatttttgtccttaagactccttgggtccccagccatctgtggctgctcgtgctgtgatctgcacacgaccgtatttcttctgctgttcacagccacttgtcctccaactccaggctgtgggacaggaccctgtgctgtctggtttcccacagcacagatcattaaaagctgagtgttataaagaccaggaggaaacccgtggaggaaatggcttacacctgctctcagagctgtctgcttgttgctcttgatcccctt

SEQ ID NO: 114426 - DNA, 1051 bp, Homo sapiens
gtgtagaaataaggaatcttgttaaatgcagatttaggctgagtagcttgggaaggggcctgagattctgtaatttaacaagattttaagtgatgcctttatttctgtaatcaaagatcatattttttagttgccaagggtttagatcttagagtaaaatttagggcttaaaaaaatgggtatgggacagtggctcattcctgtaatcccaacagtttgggaggccaaagcaggaggatttttgcttgaggccaggagttcaagaccaccctgggcaaattagggagacatcatctctacaaaaataaaataaaataaaaaatttgccaagtgtgctggcatgtgtctgtagttgcagctactcggaggctgaggagggtggatcgcttgagcccaggaggttgagatttcagtgagctgtgattgcgccattgtcctctagcctgagcaacagagcgagaccctgtctctaaaagaaaaataataacgatttgttttttgcttttttctaccttgtgaagctttgattctgttcctaaaagttacagtaagcatttctgcctttgtggggaggggaaactctctgtagaaaaggtgtgaaatccgaaaacattcctccgtagcacctgtttggtacagctgtgtctgtgttaaaatttaaccacatttctgccgaaagagaagtaaagagactagatccagttttaagatttttcctagttcagagattttatgagttatacatgtataaaagaaggatactcatttcttatttaccttttatctatttgtttaaatttctcatttgttttactttgtggtctcttccgtaatgctcaatttctgtatcctataaatgtaaatattctcctgctttcaagcttctcttatgtgatccgctctttaaccctcctactttcctttttttcattattcagtttttttgccttttttgcccttaaagtttactattatgtaggaaaaatgggaaatataaagctgttttgaactggataaacattataaaacatcctatgggatggcttttaaa

SEQ ID NO: 114427 - DNA, 1024 bp, Homo sapiens
gtgcacgttagagagggtggccttacccaggaggtaggtcagaaaaatttcacccaaggtaacgagggcttccagaggctgcagagctagggctgagaagatctggaggctcacttttgtcaaaggacacagggcaggattgggaagctattacttacttcaaaaaaacatttaacaaaacatttggtaggctaatccaatattgtgggcttaacttttaccacaaccattctccattttcaacaagaaccctttgatttttaaaaaattttcatcctatgtgaatgtattctaattcccttttatccaggagaaactatcatggaatgttaaatttcagagattgctgtgttagcagcaggcagagaagaagtcgcctaattagttgacagtaacgctgtattcataagtcccagtcttctcacacatctgtttgtttagtacctcaagagctgaggaagtttaaaaattgtcacacattattcctttgtcttatgcacttatttgagaatgggactctcagcaagattttattgaaaagatctgtccaaggcattgactgccaactttcctcgaaatttaacaattaaccttctctccctaatgtgggaatgatggcatccacctgttgggaagtcctcgtcattttgacatgtctcatttaaggtaaagagttcaattttgtcttttggactcatgtattgcttgtcatatcataaatgctcaacaaattctgaagctctaatttaaggaggtagtagccagggtggtggtgaagacaacggagtttggaaccatagactttgagatttgaatctcagctctgcatattactagtgatgtgtaattggaaagtatactggtaaaccccatttacctatttgtaaattcgggagaataacagttacctcagaaatctgttataagcattaatgtagaagtgttttcaaacaattagcatggtgttaggcactgagaaagtattccatacatgtgggctctttctcttcttaaataattaatt

SEQ ID NO: 114428 - DNA, 1037 bp, Homo sapiens
accctcacctccaaggcagcacctttaaccactaccctctacgcatctgaacttcccaaggctgtaggaagttaactatttaaaggacaaaatgttccagcctaaatgtaaaggatttttataataccaaaggcaaatatatcctacagggaatggttatacaaaaacatgtatatagttacgctttgatgtattgaaatgtgatatatcttcaagaaattactcatttgttttatttctctttgcaaataaatatttttaaagtagtctctttggctagtgccttagccaagcacattgtgggaagaacttaaaatgcttagtcatgtgcctttttcttattggtattccttaggtgcctcagccaagggcaatgacataatacctaagcccagccaaagaaacagggcccactctgtcttgacagagtattattcatgatcaccactttacataaatgttaaaggatatcaagtaaagacatgagctaattatgcaaaaaattgaaacaaatgccactcttaatgctgggtgattaggatgcagtattcttagtagtcaaacaagtcgagttatttcttagaagacagtgccttaaatttatgcctgaggtctagaaaaggataaaatatgatagatgctttccatctggtaataaacaaaaaatactcccagttctgccataaagagactcccaatttgttaattgaaaattttgcattctgcaaagttgcgcttgcgtgtgtgcatgtctgtatgtgtcttggagaaagagattactttaaaaatgagatcctgcctttgttattattgatattatttggaaagaatatatatttatagtaaaactggtgcattgtggcattttaggaggcagtggtgctgattccatatagcagatgtgtttctttacctctaattaattaatgtgttttaaaaagtgtgttctaagttaattttctggcaatcgttgtcgttgtgtatttgataactggatggaaattgctgtcttcaagctttttaatcccaaaaatgta

SEQ ID NO: 114429 - DNA, 1088 bp, Homo sapiens
tcaaatgattgctaaatgtgatctggttataagctctgttttatgataatatttaattcataattgatctctaaattcttttcagtagtcctttgtaaactaaataaaaacgtgatttgtgttattagataaaactatgattgaaaatttcaaggtctgtacatctttttgaaactcattttagcagccagtaatgctgattgtcaggaaatgtattcatatagcgcagtgtaaatttttaattcactaatttgtcacttcctcccctcagcaatcagctgtcgtttatggaaagcttacaagctgagtgcgtgaagccagggggcttaagtgagttcaagacattgactgtaatgtttttatggccttgacaaagatgagggatgtcagtttttttcagtttagtgagtttccacggaatacaacaatacagatagcacaggaagccaggaaataagagctttcccataatggattctgtttattccttggttgtcagtaatttgacttgactgcatctgatctgctggagaacaacagatagattcagaatgcaccactgtcaccgagctattcacaatatctctgacatgtattagggaaattaatacagatttagttcttcatcttgctcttgcttctcacctgctagcaattatattttcctcacctgtgaaaggttacttggacgaggtttatgtaatgaaggcaatggatcatgagtcaacaggaacacacacacatgcatacaagatattttcaagaatttttttttattcttacttggttaaaaagatgtaataatgtaagtaagtttcacaatcttcataaaacttgaagaggaagcttactataatttgaatataggttttcaggaaatacttgtgtaatagattaaaatatgaatatagcaattaatttttgaaaaataaaaatttgctttagtaataaaaataaagtgttcttctggatgatgatttggagaaaatgattttcaaccactttaaatagaattataaccatctgtataacaaaagtcataaagttaagaagcagcttaggtttttgtatcattcaaaatatgaagc

SEQ ID NO: 114430 - DNA, 1062 bp, Homo sapiens
ggagggtactcttcagggtgatgaaacattctgtatcttgattttgtggtgcttaccctgccttaaatgtggcctgttgcctggaactgcaacagagctcatggccctgagttgacaaacaacactcccaggatggggaagcatccagaatgatggagcctgtgtcttcatcgtacttgagccacactgcagaaggcccgccctagataatcccagactcgccaagcaagaaaaataaacttgtatattttagacattgttattcaggttgtgcaaatggatacatcctagcagattagtatcctgtaaataaaagacttattactagtgttattataattcgtagaactactcagatctctccaatatctagagagaaccatgattaaacccttaaagaaaggtttcatcttttcttacttacagcttttcactttaggagatttcttggccccctttggtaatgtttaattgcttttttccttagcaaactgacgcacattatatattatagtaaaaattaaatacaatttattactctgcaatgggttttgttacattttaccactgataaatctatttaagtttaaaaaatcatctttatagccaggtgtggtggcatgcacctgtagtcccagctacttgggaggctgaagtgggagggttgcttgagcctgggatggggaggttgtagtgagccaagaacacaccactgaactccaacctgagtgacagagtgagaccctatctcaaaaaaaaaaaaatcatctttaaaacatacttttaatcatcaatatatttcttctgaatatatgtgagttaccacttagcatcatagctaatatcctacaattagcaaaatgcagaaatttaggagtggaaagttcttagaaatatttaactttgtctctttaaagatgtagaaatggaggctccaagagattaattagagtcatacagtgagagctgtctgcagtgatgatgtttgaagaccctgaggcttttttgtagtttttcttcttttatttttaaacagactttgtaatcgcaaattgttgtgtg

SEQ ID NO: 114431 - DNA, 1038 bp, Homo sapiens
atagttaaaacctgattatgaaaacatccacatttgtcatccttattacaaggagaaatttgtgctttcacattttgtacatttagaattttgcgcaatgctcaacctgcagcattaccaaggaattatatcccaagaattttcttcccattatgcccatattgaagtatctccatgcagcctcagcgatgataattctcacagctttccattccagctggagttgttccattagtagttcaggttaattttcttagtatcgtggatgttttgtctgcagttgtcaatattttcatttccactttcaatatcttttcagataataaatacaataaaacttatttttaatcactgtgttgtttttactaagaaaatagtagggtcctgaacaaacaggcttagagaaacattactgtgttaggaaaatgtagaaagtttggtttgcattgctgtctctagtgaatgtgatgtgtatttctatcagagtttctgcctgtggtagagagaagaaagaaagcagatgcaggagaatccaaggcaatgggtgagaccaactagaaggggaaaatattaaaatagaaaccatgtagttgtaacagaaatcaacttctggcagctatgaaaagcacttcagagcagttggcatgaaactgcttgcagaccaagagctgcagaaaagcactgagaagatctgattctaaattaaagaattcccagagaaagttggggttagtttaagtaatggttgatcttgtcctgatggctctgtgttgtaattgcctgtttgtttgtccgttccccactctagactgtcagctctgtgagcatagcagtttctgtctgtgctcttgagggaggggctctcagctcctcgaccgtcatctgcaggtggtgggagttcattaaatatatggcaataagtgaataaagtatgtttagttatggtccaatgactgtaagtcttcacattatggtttaaatctgtgatgtttaatgtggtgtggtacagttgaggacagggaaggaagtggccatatg

SEQ ID NO: 114432 - DNA, 1045 bp, Homo sapiens
agaactgacacaggggtcaaccaacaggtcatttgaagagattatacaattcaggatcagatgaaatttttttttttggttttgctattttattcttcatgaaggatttgaaataaatttcccaacattttattatgaaacccttaaagcgacagaaatgttgaaagaattctcccacctagattgtgcaggtaacaatttactctatgaattctttcatgtattgatacactttgccatttctttactcttccatcaattcattgttggtgctttcagagtaagttgtgaagcgaagtacactgtacagactacacatttaaatacttcagtttatgtaacatcagctagatctcagtatttccctatgtttcttttaaaataaaaatttacataagatgacacgaataagcttatattcaaaaagttctgacaaatgagtattagacctaagtttatattggatatattgtatgttagaagtcagagtttaaggtacagacaattgtattttgataactggctaacatttggagaaagtaatattctttaccaaaaaatcaatgtgaattaaagatatgatgtttcataatatgtgcaagacatcatcagagaataccatggacattagtagtttgaccagtggtgtctagtttgtgaattgtcaatccctctgaaagcttaatttatctttaaaaataatttctgttaccgggataatcctagtagtaacagacaattgccaattagtttgtgggatgaaatgaacctttcattacttcaagtgcagacacaagcaccttttaaaacccacatcctgcagtacctgaagtttcaaagagtttactcaacttgttcaacagacatagagcaagaattattgagttccccattaacaggagacctcctatcaaagcagcacattaatttacagtccatataggaaaagaaaatcagatttggagcagttgtgtaaattatcataaaggaaatctttaacatagggtaagcagtcaagagaatttcattttaatatgtaaaactc

SEQ ID NO: 114433 - DNA, 1017 bp, Homo sapiens
cactggtggcgatggatattttctccttggatttctttcatcccatccccctgaaataacaggagcagaggcagcataggtcatttgtcagctctcttgtgattgtaatttctgtctcacatattttcattgccaatatacctaccttcggtaaagctaaatacagagtagcaaagaaataggctactttaaaataattttgtgcttttatggaatttttagcaaagtagagttttttttttcttggttctaatcagcacatgataagagatgatgtatttcctttttcaaagtagagaatttctttatgggtacttcatttctttgcttgaactttaaattgtctgtttggctaatggaatctttttttttttttggtagtttggctccttttagtggtattatctaattttaaaaatgaaagcagaatgagactttgcagaaccatagtgtcatgaaagtggagctaatgtgttacagaaggatcatgtgctcacgtcttccctaccatgcctactgattagctagtcactgtcaaagagtagtatgtggttctctaattctcaagttttctcagataagcatattctccacatttctatagttttctcttagaatctagggaaatcatgatcattttagcactctcttctagtctccaatgcttttttatgttgtactttataaattatgtataaaaacgtgttccattgatgaaacattttgctctgttcttgacgtggcccaaccaacatggagtggtgatttgttgatttaaagggggatgatatctcccaacatttggaaactaaacaacacacttctaaattattcatggctcaaagaggaattctcaaaggaaatttaaaaagtacattcaagtgaatgaaaattaaaatgcattgtatcaaaaatttggggacataagcagagcagtgctgaaaggggaatgtatagcactaaatgcatgcattaaaaaaggggacaggtcctaaacagtaatctaatctcccagct

SEQ ID NO: 114434 - DNA, 1031 bp, Homo sapiens
ctatcttatggccagattgctggaaaaggaggtctgagccttggactagatttggctttcaaccctacaaggctcgtgattttcctactcagccattctgggttcctggccatgggcagaatgtgccactgtggtcagatattttcttttctctgtttctcactgtgccagtctaagtgtaagactgcctgttctttggagaaatttacaaaaggccatgagaatcatccgggacacttcatcaagttctccaaccctccaacttgtggtttgagatacatagagaggtgtttaacagccactttgttaacagatagtgaatacctacctttccagttaagggcagtgtgctcactacctaaaccgtaccaccagatggaccagttctttattctgggcatatcactgacagccagtggaagtttcctgattagttgggactccctttgcaaaccatggaaaatgaacttaacctggagtactaggaaatgtggaatttacagactctcataagtaaaaatgctagaggtttgctccgtccccacgttctactgatcatggctcatttttttctctttctgtctgatatggctgtgtccctacccaaatctcatcttgaattgtagctcccataattcccacatgttgtgggagggacctggtgggagataattgaatcatgggggcagtttcccctatactgttctcatggtagtaagtctcatgagatctgatggttttataaggagaaacccctttcacttggttctttctctctcttgcctgctgcgttgtaagatgtgccttttgtcatctgccatgattgtgagccctccctagccatgtggaactgtgagtccattaaacctttttttctttataaatgacctagtctcgggtatgtctttattagtaccctgaaaatggaccaatacactgtctattagttctgctttcttctttactaccttcatctttagcaggctttttataagtagtgtcaatatgtcaatgggagctccaagtttata

SEQ ID NO: 114435 - DNA, 1042 bp, Homo sapiens
gcaaggcatggaaatgtctgttttagaactaatggtaagaaatgcatcaagttttctagtttcctaaaaccatactccatgaatgtacttttgggaagaagtctttgaatagatggaataaattttttcaaaaccatggtgccttcaaagtaagaaaatgtcatgttgttagtgcatacttgaacaaattccaagatttgagagggaaccgtcccaaaatttgaccagctgtcctgaaaatactatagtaaacatgaattactataacaagtgccttcattttaatggaaaatttctattttccataaattattcattttaaatggaatattttaaatggaaaatttctagtagtaagttggttaaaacaggacaatctttgagaaaagtttcctaacaattggtccatatttagataatataaatgtggaaatttgtttaaatcagtagttgaaagaagtcttaatttctatttcccatttaattccatttcacccaatttgagtatagattatctaatgaggcaacaagtgctatagaaaaccacagagcaagtttagagggattgggcacaaaatgataggggcattgttggaagttctattaataaatagggtagtcagggtaggttacattgagaagacatcatttgagctaatatttcaacaagatagggatgggagccttgtagatacagtaaattgggtccctaaggtgtgagaatgccgagtatactcaagaaatgccaaggagtccaatcatggctggcacacaggcacaaagacaaatcataggaaatgtagtcatcacttcagagagatgatgggagaacacatcaagtggactctgtaggccactgtgagggccctttggctttcacactgcagagttttgagcagagaagggacgtgatcgagttcatgttttgcaaggattcttctgactgctctgctcaattgtggggtggggatggtagctcagatagcaggcccttgcagagggcctgaacaaaagatgacatcggtttggacaatggcattca

SEQ ID NO: 114436 - DNA, 1097 bp, Homo sapiens
attacctgccaaagacccctgtctccaaataccattacactgggaattaggatttcaacatttgaatttttgggggacacaaaccttcattctgttgcagaaaccttacccctgtgtctccaccaaaggttagttttccataaattgagattacagagttatgtcttatcagtaggtaataagtttgtcctctgcacctgactgtttgaatttgtggaagtttccctccaggcattaacttccattttcctgccagttcttgcactagcacatgctggggccacctcttcatgcctgaactgagtgagcagaatggtagcaacagcaaggaccaaaccattctctgctcttcaggagatgtggaaaggacaggttttcttgctttgctctgtaaaagccgactaggcacttgatgcattttttcacttccttttatagggaattgagccaagggagagtctgtttatcctcgagcttacttaagtcagggaattctgcagaagcatattctttgtaagcaaattcatctccaagtttgctgactgtacagctcgctcatgagtgtacctgtcattccatcttaactgattgaccaactacatagaaggctcagctttcatgtagctgacagctctccatttcagcactattggcattatggactggataactgttgttgtgggctgtcctttgcattacaggctattgagcagcatcgcaagcctctgctagacgcctgcagaactccaccacccagctgtaacaaccaataatgtctctagggattgccaaatgcctcctaggggacagaattgcctatgaatgagaaccactgatgtagatttgcagaggctttccgtggacccaacccctatcgcagtgctatattctcccttttgattttctccattgggctcttttgctaggcattgtggtagtggatgcaatatgaccatttttccactctaaatcagtctatgtgtaagtatttgccgggtggtttcatgcttcttcaaggcctctctaatattctcaaggtgcagacattttgagattttcatcctgctaccaattacggttgtgtcaggggaattaga

SEQ ID NO: 114437 - DNA, 1047 bp, Homo sapiens
caccttgcaaatgatggtgccccaatgtccacatgcttccttctctctttggatgctttttctttgttggtgtctcaggaaatatggtgtgggaaggtttgaggctggactagagtgagtctccacagtgagtgactgctaacgtgcatgaagcagcaaggactcttagcaaataataacctgaaaaggtgtagacaccgaatttcacggtcagtggatcttacactgcaaacttcagctcaggattccggaaataacatctagtcactttcccagctgttcaagccttagaacaggtttctggtgcagttgtattcagtttgagatctggggtatagaacactgccaaacatttgcatctgttttctctatgtattgatctatcctgaagatttgaagtaaactgaaggtacaaatgctattgtttcttgggctcctgtgaaccctaccttacttgggcctgaccttgtctcttgggagctcatcccagagacaagccagcaaacttttgtaagaaataacacatcttggtgaggagagagagtaaagaagaggtagaagaaattctttagggatcagagccagaaaatgtgtaatatttataatggagttatttatatataaaattgtataccacatttgttaatatataccgctatagtttttcaaatataaaatgaaaaactagaaaggatataatcacatttttgagtgtttctgattgcttttacaatttctgttcctttgtgtgtctgtgtgtgtgtacaaaattgttaagctattctgtaccacactttcaaaagaagaaagcttgagtagaagataattgccttctacatttcttttcttatacacaagatatatttatttgtttctgccatatacaaagtctcagaattttgcatgctgctctttggtacttaaatatttttatatattagatggatttatatatagtttaatgaaacttgatgttaataatttgaaattgtatttttcctctctttgttctatagcacttcttcccaaatgaaagaaaagtctttt

SEQ ID NO: 114438 - DNA, 1043 bp, Homo sapiens
gtgtttacttttatttcatctcatataagaaatgtctgtatctgagaatttatattaatataaaatgaagtattgcttttataaactttaatatttcctgtttggactccactatcatgaaatcccctgcttatttaaattagctgtgcctttagtgaattatgtctttgaaatataaacctgcacacagaaatgcttgaagttatcaaatgtgtcattagactggggaggttcctttggcctaacgagtattttaaggtagttgccctttggtgtttaattgtggctacccactcaaacactaatttagaatgagttgtttctctcttggagcattgaattggctacatagttgtgcatctttagtgtttgaatctgctctaaattgtatcttaaaatcattaactcagtttagtcttagagagacatttgaaggtttgtaactgaaaatgtgttacctgtggtgtgtctgggtgtagataatctcagagctcagtggaaggtggcattctggccccttctccctatcttcagctgcatggttgacattctgcatgctgtctagttactccagcttttggctttgagtcttacagaaagaaggaaaaggggccttcatctgattatttaccaaggttggtacatgccgtgaaaaggtttctatttaagagtcattctaggggctgggcgtggtgactcacatctataatcacagcactttgagaagctgaggtggacagatcatgagatcaggagttcaggaccagcctggccaacatggtgaaaccctgtctctactaaaaatagaaaaattagctgggcatggtggtacgtgcctgtaatcccagttactcaggagattgaggcaggagaattgcttgaactgggactgggaggcggaggttgcagtgagctgagattgtgccacctcactccagcctgggtgacagagtgagattccatctaaaaaaaaaaaaaaaaagagtcattctgagaacttgaaaaatacacaaccaggccgacattgctgtgttgcaagtagt

SEQ ID NO: 114439 - DNA, 1045 bp, Homo sapiens
atacctccagcgctagataatctgtccccctctgaatggtttagtcatttatttttctagttgaagggtagctatttctatccttttcaaacatggatttccaactgagatggctgtgcagccttaattccatcacatctctgaaatccttccctttctccatgtgccgattctcttaaaatgcattaattgctactaggatttaagatctttcagtagtaaacataaatactgtatgtttacagagtaataatatgagtttatatggcttccttgtggcctgataaatcatgcattttacagtagtgcagttagacctacagaatggcaggcggtgcagagccgcaagtgggagagctggtgacagggctgggtaaagtgctgtcttaagttgaacagagtgtgggaggaaatataagcaaagttattccgtagaattttatagcatgttagtctttacaagtgctttctcatattttatctcttgaaagggaggataagaattttgaaagcaatgtaacagatttttggaccagtagtagatttcgtcgtgttcactgattcttggaatatccttaggtgatattcatctgattttaaatatacatgctgttccttacagttatttatcattttagctaattgagatgtggtgggctgggatttggtggctatgtgaggtttttttttttagctctggcccaaagaaggtgctgtctaactccgaagagattttgtcttttttttggcagtttctctcaagatctttgatgcttacacaactgtccattgcctttcctttttctttttattctttagagcaaattgctttgtggattatgagggaaaatatttcttctttgctatagcttattaattttcaatatgtgtacccaggacttatgttaaatagttagttctactacagaagtaatttcagtttgtctgctgaatggttttcatattagtagagcattgttactttcatgtttactgtcagcatagctttgaagatagatatttatggtcatttggagaaatgtag

SEQ ID NO: 114440 - DNA, 2749 bp, Homo sapiens
aagatgctgcagttgggcaaggtcaggaccttgccctgaagccgggcggcgccgcgcacgcctcttcccggactgaggagctgtcgccggcggagggtgcatgtttgcgaggaagccgccgggcgccgcgcctttgggtgagttgcggggctgggcggccggggccgggcgcagcctcctcccggcgccgtcctcctcctcttgccgctggtgggggtggtcctgggctcccggccggcaggcggcggcggcggctgctgcggggtttctgcctgcctcggggaggaccgcgatcgcgccaggtccccctcggaagccgctgtgcctggaagggggtccggggttagtgcctttcttggagcggttaccaagtggctgccctgcgtgctccccctccctgccacccatctccccgggaggaagcgtatttagggcaacaccgacaatgctgctccccgccaccctgagaacatactcggtgcattcatgacgtccctaatatacgggaggagacggggtgggggtggggaggacttccctccagtcttttgcccttatgttcaatgtcattacgatgtttggctagaacaaaatggaaagacttagtcatatgcgtccatggccgtgtcttcaggctcccgcggcttgccagaccctgagcccccttggtctatatttagcggcttcccagcaagcctttgcagccggcttcacaggtttcgggggcttctgcgtgctgacaatagacagccaggctccagaaagcgccgcctgaaagccaggtttggaaggctgtgcgtgtgtatgggagatgagcgatgcaaaattggggtgatccgtaattaatggctgaaagcgaagctgcttttttctttttttcccgaccctcatcttattctggtgtgtagtgtgttttcttcgattgccactcggcaggttgagcctctgctttcagaattaagtcactagaaaggtgatgcagcctccctggtgtttgtggtaggaaaacagacttgggaatttttggggtgtgtgtgtgtgtgtcacaaataacagttacttccaaaatgcccaaagttgtattttgctgtaaccgtgggggtatgaagggtgtgggagatgagagatagaggggcaggttgtgtttccaaggtgtttttttttcttttcttttcttgtgtgcctcatttgagctgatctgattcgccttagctctggcaggtgttattaagatgtatttttactgtgctcaagcaaatatgttgatttagaaaacagagaatgttgtcagcatagtattaggcctgacaggtgtaaattttcacttttaagaactatgtgaccaatatttaagagtcttgggattttctgcagtgacttccatgaaaacaaggaggtgctgaaactccctaggagttatctcattgtgcatacttcatcaggggctgaagctaccgagggcagtccagctggtctctgctgctggtcattcacctacataatgacaaggcttcggggctgcaccacttctaaaatcccatggagaagtgtttgctgtgactcatatcaagttatggcggtgaacctgtcattattttggggatttctgctacgagacgtgtgatatataggggcgagtatcctcaaatacgaactagatgctttaaactgccctcaaatgtcttttattagcatatggttgccatacggagaatgttcctactgttgttggggaaaaatgttaagtggcatcattactgatctgtgggttccaagggctcagggcttgaaggaagacgattacattcggagttaagtgttgaaatttgggaggcctttgattacactaatcacaagtcagtgttgcaggaggactggcaaggtctatacggctcaagttgattgaatactgtgattagtctttagcaatattgctttagtttcaccttattcacattcagggaactttccgagagcactttgaacacaccgttatgcccactgcattgttttaatataaaatttctttcaaaagcaatagatgaagtagcatacatgtctcgtttccttttcttttttccttttgagcctagtgtttcattcttaaacatgatttttaaaggactagttgatactgctctgtgcctgtgtgtgtacccagagcggccgatgggcatgtgaaaaactacatatactgtatatgtgggttttatgttatattgtggattgaaaatgatattatctgattgaatggcaattgtggtaagtacgtgaggttgttgccctaataaaattgtcatagtcttgcggaaaggagttatttaatttggtgtacgtttgtgtagttgtataacccagtcattatagatgtcactaatgttttcattgttcgtaataaaagtcatacactgtcaaattacagtatttctatccactttacatctttcacaatagaatataagccaattctttctcccagtgaaattgttcatcagagacaaaaatgaaattcaaatactagtttgcaaatgcaatttatagttttgttaaataatttctaaggataatattgctttcataatagtttctaaaattaaaaatgaagttataatctcaaatataatattactttggcatttagttgaatatgcagtgtatttgcagaaaatgttacagaacttgctcttttctgttttgccttatcagacttctttcttgtgtggtatgaatttgtgtggacttgtcgaag

SEQ ID NO: 114441 - DNA, 1071 bp, Homo sapiens
gcttaggcctgtgctgcccccgccgccagggctcctgttcatgttccgtttgggtcagaaccaggtaatgtctcactggcttgttcctttcttctgccctccaaaatgacaaacttaactttttagttgtttcacttagaatcaggagccagggcagaacttaagtaggtatcagatgcagcatcccattccagcgatagcctggaacgtctttttaaaagtgaaatctcctttgggcagctctgagtccctgacctagatcttggctctagcatctaggccaacgatgtctagcagggggcagagaggggtcattctgttggatgggtgggtgtgggggtggggtttgaacagtcagggctgaccgggcaaggaagctgaggagaatggagcagtcaaatccatcagaaatctggctttcttttctaagactcagaaacatgggaaaataggttctcattgactggggaggacagatcatggtgtgtttttgagcctggtactaaaagtgccaacctgacttagacaaaggctttccattgcttgcctttcctttctcagccctgaaactctgtttgcatggctgcctgattttctttcttttttttaaattcgttcttgttgcccgcattcggctttgtctttgtagccacagattgaaaactaataccagtggttggatgaaagaaagagaagactttaatagaacttttaaacaattaagggaagttcagaaatagagtgaacagtcctgtgatttctccattactggaagtgctcacataaaggtgctgtcacctggcagggtttggagttgggctcaggggacaggactgctgccctggagaggggtccgggagatgaccttggggctgttcccctttccctgtggactctggctttctctgagtcctcagtgcctaatcattgttctccgcttttctttgggtagttcagggctccagagccctggtgcccttctcctctgctgagcgtccacccagggttcacctcacccaaggtctcatttcctttgctgtcattccgttctctgctcaggaccttggcact

SEQ ID NO: 114442 - DNA, 1017 bp, Homo sapiens
gagaaaaactattacaaatcaaaggattatatatatgtaattagtaaagggctccctcaaatcaattaagacaagacatatctagaaagaaaataggcaaacaattaaaagaagtatgaatggccaaaaaatacatattcagcctcactcataatcgaggaaatgcagatagaaccaatgataccaacaaaagccaaagctcatataagtaattattctctaagtaaacttgaacaaaattgagttaatttggaaagattttatatcgatttgaaagatagtaatacttgtgttcatactttgctatgtaggacctagcttcttataattgcccgggggtgatctagggtaatggtaaagatagatagggggaaataaagattctttcctgggattctgtaatacgtgttaatttggaaatccatctggtgtataagtcaaatctgacttacaataatctttagctatagacagttaccatttttgctgcttcaaaatttcccactcccatgatttgtgctgctgtccagatcgaagatgacaagtggcccatgcaggatgatcttcagcgcctcacagttcctggtgcgaaagaagaagtttagtttcatctggagggcttcgttcctacatgagtaactataggaggtcatttgccctctgttcttaggcattcttgtatataattgacagctacctatttcacggtattgacaattaataaatggatttatgaagtgttagccccacctacttttaagactcataaccataaaactatgcatgaacttgagaaaaacacagttcaaatttacacgtataatcctaaaatatttttaaatggggtttgttggtgcctgttttttcattgtgtgtgtgtgtgtgtttgtgtgtgtgtgtgtgtgtgtgtatgtatgtatgtaggtatatctcttggaaagtcataaaatacccctctttggatttctgtggaataggtggtttcagtgcaagaatgaatgaatatatcggagacta

SEQ ID NO: 114443 - DNA, 2046 bp, Homo sapiens
accctagcagtcccagctttccggtggaggcatgttggctctgttgagttttacaggctcccccggctcacagtctggggagaaatcctgattgaaatcttggccctctgttttcttggctgtctggacttggactcaagtgttggataggaaatctctggctgttaatgtgggggttgggagtacgggaagggcggggagaggctggccagggagggaggtttcccagcccttgctgtgtgtgacacattagaacactaccagggcttcctttctaacttaggaaaggaacggggccggggagtgagaggggcaggagggcaccacggagctgcctttttggggttggttttataaaatggttgtggtcactcctggttttgctatatatagctgtttcgttgtagccactcatttttttgctgtttttcatcaaaatgtgcacgtagatgatatttagttgggggaagcagggtcatttccttcccactgtctcaggcacgtgtcctaggctgttctgtgtgtgggttgcgttctcatcagccatacctcatgtggtcccctcacagtcaatggcatgattttatgggatgcttgctcaggtttatgcccacataaaacttctgagctgttgttttcgagcatcatttccacactgggaatatgctctgtttttctgtgtgactccacgtttactttggagttttaatatttcagtcaggatgattgaaatgctggtctcttgaaggcagacactgtataatcagaaggtagattgtgctctaaacatttaccagtcacttcctcctagtttgccctaggagtttctaaaactttcaagcttttacatttttatgtaattctttccgtttgaagatttctaggattaaaaggattggcctttaagaccctgggttgcttttgacctgctattgtagtatatcttttattttaaactaataaaggtgatacaaagctcaggtccgaattaacttagttgaattgtgattttgctgtgtagtttttggtcatttagttggtccatgtattaattgtggattacatctaaagttatttcggggtgggggtaaacttactttgagaaggcagaactcatcatgctcaaagaagcaagaacagcttcagatccccagttgtaagtatttcaccacttctgctttgtcttcctctgcttctctttctggatatagctaatttacatgttatcttgtttctgaaccatttgagagtaggttacaaatatgatgatgtcccttacctctaaatggttcagtgcatattttctaagagtgaggacatgctcttacatagtgatcataatcaggaaattagttttgatatgatatcatgatctaaatcactaactttaacacctttttaccaattgtctcaggattgtcctttttggcagttaaaaaaattatggtccaggatctcactcaggaccatgttacatttagtttgtcgtatctcttcagtttccttgaatttggaacatctcctcagcctgtctcccttgttaccctgatagttttgacgattacatggtggttattttaaagactacctcccagtttgggttgcctgattctcatgactaaattcaggctgtgcatttttggcagaagggctgcatcctttttggagcatcgtgtctgggaacatgtgatatccactgtcccactgtggtgatgagcactttgatcacttggttcaggtgatgacttgcaggtctctccaccctatttgtccctttgtcattagttagcattttgtggggagataatttgaggctgttcctctcccttctttcatttgctagttgtagcatccattgatgatcttcacctgaatcagttattaatatgatggttgcgaaatgttgattttttttctaactttgtaattccttttgtatttagttgactttgtactataaggaagagctttccttatcttccacttatttatttatataagtatggcctcagaaattcctgttttatgcaatgagctatgatcttt

SEQ ID NO: 114444 - DNA, 3190 bp, Homo sapiens
tccctctctctccctgtctccctctctctccctgtctccctctctctccctgtctctctctctctccctgtctctctctctctctccctgtctctctctttctctctttctttcgagacagggtcttgttcttgcccaggctggagtgcagtagtatgatctcggctcactgcagcctccatcttctgggctcaagtgatcctgcctcagtctcctaagtagctgagactttgagcatgtgccacgacacccagctaatttttgtatctttttttgtagagatggggtttcgccatgttgcccaggctggtcttgaactcctgggctcaagcgatccacctgcctcagtctcccaaaggcttgagattatacacaggagccactgcacccagcctgttctgtgtttttctacattaaatgatgacacggatattacgtcgctgacttggggagacagtctcagtttcatatattatgttctgtactgcccataaacatcctcatgcttgttagattgtgttctggaaaatttggcctctgtatttctagcaaccctttctatgatgacacattttagcaagaaaaaaaatcataatttgcttattaatattttaatggagaagggcttttgatattagaaaactgggaataggccgggcgctgtggctcacacctgtaatcccagcactttaggagcccgaagcatgcggatcacgaggtcaagagatcgagaccatcctggccaacgtggtgaaaccctgtctctactaaaaatatgaaaattagctgagcgtggtggtgcacgcctgtagtcccagctactggagaggctgaggcagaagaagcgcttgaacccgggaggcagagggtgcagtgaactgagatcacgccactgcactacagcctggcggcagagtgagactccgcctcaaaaaaaaaaaaaatctgggagtaaaaagtcatgactaggggtagtgagaatgactgctaataggtcaaacattctgaggaaagtttttgagctaatggagatgttttggaattagatagtgatgaggctggaaacggtgatttctgcctgtaatcccagcattttgggaggccaaggtgggagaatctcttgagcccagcagtttgagaccagcctgggcaacatagtgagattcagtatctaccaaaaatttaaaattcgctgggcttggtggcgtgcacctgtagtcccagctgttcaagaggctgaggtgggaggattgcttgagcctaggagtttgaggctgtagtgagccatgattgtgctactgcactctagcctgggcaacagagcgatgacacgctgtctcttaaataaataaataaaaataaagaacaaaaagtcatggctaaatgtgtgatacatttcagattttgaaatagcttcagttattgagtgtttactatgtataagccacttaattttcctaccccttacaaagtaggcagtgataacattatacctgaggaaatggaactcagagaggttttttaacttgccccagctcaggtggctatagggacaaggttaccacgcgcacagtgggttctgccgggggtggaatccgcctgtgctggtgtctcctactctgacgtgcgtctcttatggaggaatttgactcagttttttctactcccactccccctctccctttttttggtgttagaaaaagtgaaatcacctctatttgaaggaggggattgtggataagatttgaccaggtttcagttgtgatttgatggcatatttggaaattttgtggaaaaacctgggttaacttttcaggaaatcgcagtcaaaaaaaaaaaaaaagagagagagactttgcttccctgtagattgtttcagtcctggtggtgtcttttgagatagtgaagagcatagctgaaaaagtggaaactgatgatgctttagcttttattgttttttaaacattctgggaaagttgaagggagaggcaactttctgctatgcttctcctgaaagtgatattaacattaaaaatcggtgtcattgtttttctgctagtgtgagctttatattttttttctttttttttttttgagatggagtcttgctctgttgccaggctggagtgcagtggcacgacctcggctcactgcaacctccatctcctgagcgatactcctgcctcagcctcccgaatagctgggattacaggcatgcgccaccacacccagctcatttatttttgcatttttagtagagacagggttttaccatgtttgccaggatggtctccatctcttgacttcctgatctgcccgcctcggcctcccaaagtgctgggattacaggcgtgagccaccgcgtccggccgagctttatattcttgaatattggagtcacctctgctcaccagcatatagaccgagacatagagtatgttgttagactctaaaacagaaacggcattaatttgcataaaatcgcatatgctctgttgcaataattttcattgtgcctgttttagaattgagttgacacttcatacagagtattccaactcaattaaaaaagagacatcgcagaagaatttgtgtggctttgaaatttattttgggcacagtccctgaaagaaatgagcctctaaggacttttgttctttgtggtgttttgaaaccttctcgccagttatatacattaagaacacgtagagcaggttggggttggtctgctgggtagaatgcctgcaaagggaccagaggtctgtcagaacaagagtctcttagtgcagtgcctcccgccggggggtgaccttttcatgatgtttggactgtcatctttgtttcccagtttcaaatgcctagctcagaattatttagtgcttgaagtggttttcatcttcaaaggacgttatggacattatttaatatacatgacactgtgtaatgaatgagctgtttatcccttgagtaacgtcaacatgccaggtgccatacagctggagaagacaaaaataatactctgtccagtgggagctgatagtctaaagaggcaagatgattaggcagattctctcttttggcctcttttaaaaatgtgctggggaataatgtagaaattaaaattataaaagatgatcaactagctcaagtctacctaattgaaattgccctcaaggtggaaatgaaattt

SEQ ID NO: 114445 - DNA, 1090 bp, Homo sapiens
ggtgaggaatttggtgaagaccagtgcagaattattctcagatctccttcccgactcgtccctttctcccactgaagctcctctttttgtttgcatggtctaggatggcactttgtaaccaaggccacatgtgatgcccaaacatacatttattattttttttgagatggagtcttgctctgtcgcccaggctggagtgcagcggtgtgattttgactcactctatcttctgcctcctgggttcaagcgattctcctgccttagtctccttgtaactgggattacaggcatgcgccaccacacccggctaatttttgtatttttgtagagatggggtttcaccatgttggccaggctggtcttgaactcctgacctccagtgatacaccttggcctcccaaagtgctgggattacaggtgtgagctaccatgcctggctcaaacacacatttcttagttgcagatcagtctgtcctttgtagctgggcagacctcctgggaaacttggacttcttgcccctgttggcctgtgtgtcttgtgctcttgtacctgtacctctttgtgtttgctgttccctcttcttcctggtttcccttcctaactcagctcaaacatcctttcctttggaaaactgcacttgaccatcctgtcccagcctcttgaggcccattggtgttggcatgacactttgtgagaactggattctggactggttcctttgggttataattgttccttcactcgtgagtttgagttgctgggacctctgaccccagcgccggcccagagcagtccccaggtagaagtgcagtagatggttgttgtgatttatgcctgtggttccttaactcagattttagcataattacctggaaagttttctttaaaaatacagaatccctagagattctgatttagtggttctagattaggcccctagaaatgtattttgaaaaaactctacttgtagtttgttttgagacagcgtctcaccctgtcacccaggctagagttcagtggtgtgattatggcttactgcagccttcaccttgtgggctcaggcgatccacccaccttagcctcctgagt

SEQ ID NO: 114446 - DNA, 1007 bp, Homo sapiens
gtgggtctgggtttcccagcctccagaggtaggaacgccaaccatcctgggatggtaggtggccgctaggcccagatggactgcatccagacctgctgagtgaatgaatgcctttcttctgtaaatggactccttatcattctgttttagctcctctttttctcatttcttcctttctcctgcatttctcttgtttctcattcttctttgaccacttaagagtgacggtgtcactcatggccattgcccattgctaaactgtgctggaggcagttagagatgagtctgatttgtggggcaggaatttagggggatgctcccggtggagagtctgttggattctgcattagcacctcactacagacttcacctgggggtaagccgtgcctggggggcacccccttcttttctgccccaaggccctgggtctgagcctgtcttcttctgcatgtccccttcctgtctctcagtcgtcccgtcacttagtggggtctcttgacacttaattctcttactgcttgatcccaatcccctttaagcacagttttgtctgatttaaaatttgcattttatggtgatcttaatagatttggcttagcaaataagtgtgatgcttcttaatttcggggtaatttaatccctttttctaaattgtggtatattattccttaaaaattgttttggctcagttgccctggtgtcatgtgatttcttcttgacgttttcttttccgagctgcagttcatgttgaggttaactcctactcatccctctgccccgagtgctcagcacatagtcagtgcttagtaagtgttcaccaaaagcaagaacaagcgcttgctgcatccccaagtccagtggccagtttccctgtctcaggaggctggtgggacgtggtaactattgagccagcaaaactgggccagaggctgggccattttatggtgtaatgtcctctccagtagaaattcatgagaggggaaaaaggagaaagggagacggtagat

SEQ ID NO: 114447 - DNA, 1018 bp, Homo sapiens
aatttattgtttgtctgcagcagaatgacttgtatggctctgggtgctgttttctagtgctgtgtttgtggtgcatgtcttcttcctgtttcttctgattctgagttccgccctttttagctagcattcagttggtctggctttatttgacttctttgacttggtgagtgccatggtttgtgagttatactatcatttgtggtttaaacatttcagtttttgttactatatgtccatctatgtggccatcttctcattttaattaccaatacatgtttcagcttgctttttggaaaaagtgttgagatgcaaatgtgtctttggaagtgtcactgagaaacccaaggtctatctggcattccgctcctggcggcagaccgtagtctttgtccacgggttgggaagagagctgtgaaacagggaggccttgccgactgtcctacctgcaatctggactttgcacatggagcctctacttaggggattagttttttgactactgctgtttgatttttgctttttaattgggttatttgaggtgaatgcatggtttaggtttctcgttctttgtgttggacagaattaaagggaaatttgagacatcctggtctacttatgttcaactccgttatattcttttttaatgggcaataaaactgccttttttttttttttttacttttctcttttttagatggaaggttccccatttttatttttacatcacgttcttcctcatacagttttcttcaacagtaccaagagtcgtatttttaagaaagtgtctctaaattttctttgcttttgtaggactatgtcatttctgatgatcattaattggtatgcctaactctcccctttgacccaggtattactaatattgactgaaagatggaaaatttcaaagatggaaaatttggattactgctgtgtctttaccattgagtcccaggaaataacttgcccagtttcataaattcttagacgttggtttctcttgtgattgtcaagtctttgg

SEQ ID NO: 114448 - DNA, 1001 bp, Homo sapiens
aaaatcggtcctcaccataccgtggcttggctctgtttctaatgcactgcaagtattttatcaacattgtctacttttttgttttacttgattattttatatttattcaccatttaatttaatattacagatactgtttgtcatgtgtttggcttttgtgtttgcttttaacaaatactcttgtattcatggttttccttgtttgtggagtaattcattttgccacttcttttaaccattcttccctaaaaatagtctgctagggcagagattccattcggcctttattactttggatttgccaaacaagcagcagaaacagagttgtacgtgtggtcctacaccacaaggatttttaagagaggtcatttgtaggtgatggttgttgacacaggaatgctgtcaattaaaaaaggggagaaaatgaataatattcaaatttactggcatagagatgtttgcacagattccatgtgagagacgtaggctgttaatcttgtgttctggccgcatgttaggaaccctcttatggtgtggataaaaagccttgtgcctgcctggtattagaaaggtgacaggtgttgctgtcaaatattgatgctttgatatcttcacatttcttgataagctgaccgcgtaattgtctaaacagagatggtgttgagagtgaaagagggtgttaccaataattattctagaacagtaggggtaaactgagactgtgtctgtcaagctaggatgtgtgatgactcgacctactgactgaccatagtttcataattcagtatgtagagggtgagagtcatgtgaagatatttatgactcccactggtcattttttgtggctcacccctaacttggataaaatgatgtttgactcagtccaggatacataaaggcatggacagttggccaaggagagtggtcacaggggtgctgctgagtcagcacctcctgtcagtggtggtctgtttgaaaacagacctacagcacatttgaag

SEQ ID NO: 114449 - DNA, 1046 bp, Homo sapiens
cttctgtccactcaaatgttgaatatccctgcattgtcaaattgtacccattactcggtacctgtctacctatagaagttcctttaaaaaaagagctgtctttttactacttcctggcatgtagttttatacattgatcggattcatattattttgtcttacaacttgatgtctaaatatgtaagcaggtgggagtagattgttttcttttgtatttctgctctctttttctctgtaaagtttttaaatggaaataaagtacataaggctcgtattatgtgatctcttgttggcagtataaaaggttttataataattgttttctttctttattgttatacaggtgctccattaggtgaagaggtggagaagggtgaaggatttgaggacttgatttgtttttaagttaaatgttaggttgctggatatctctagatatctagctagtaacttagcttttgaaattcagtgaaatccatgtttcaagggtgggatgttattccaggaattctgctgaaataaacagtatacagaggcatatctctgaatatttagtcattgccagtggcaaagttggtaatgctgctttgtggtatgtttaatagaggaatagtgtatagcctttgtagataatgatttaagtctgtatttatttttacagaaaggtaaccacatacacacatatatgcatacgtcttttaattttgaaacaatttcagacttaaaaatggttacaaaaattacacaaagatttctatataccttttacccagatatcttacatgttaatattttgccgtttgttataccacttatacccttctttctgtatttgcacatgtatcacctagataaactttttttttctgaaacatttataattaaggcagacataatacttcttttacctttaaatatttcagtgtatttttttttttaaaccaaggacattctcttctggaagtaaaatgatgaaaattgggaataccacattcattcaatgctgttatctaatttacagactttattcagatcttgccaggtgc

SEQ ID NO: 114450 - DNA, 1040 bp, Homo sapiens
atgttctctatttcgtgcagtatccattccaggagcacacgttgcatttaattgcagccctctttagtcttttttagtctggaagagctattcagtctgtcaatcaggaccttcacagttttgaagaatacaatctagttaattctagcaagtttgctgaacgacccttgatttggatttgtgtggtatttccttgtgatgtgggtgggaatactactgaagggtggtattgtgctctctgtgcattttgtcaggcaaggtgttgatatgcctgtcctatgggtgatgacataaactttggtcacatagttaagatggtgtccgccaactccattgtcaaattgataacttttttctttgtaatgaagtgtcttgagattctctgtgaaagtatgtaaatatcttattcctcatcacacttttacccattaattttgtactcattcatgatttttgcctgaaccagttgctagtgtggtgttcgtcaaatggtaatttttaaattcttccgcttattccacttttgtagtttaagtcctactgtaaggaagagctttcccttctcattgacttaattgttcagaacaggctcatgggtccttatttgattctgctgattgtgatctgttattatcatgattgactggattgctccgattgttccaggctggccagcggggacagttcaggctgtgcctggtcctgtctttttccaagcccttgcttattttttttgtctgttctctttcagtgtgggggtggggagaggcgcagttgtggattgttttactagattttatccagctttttctccatatctgtatttgtataaattttaaaaactgagcattatttaaatgtttatgatggttgcctttgggttgtgggattactggttattctaatttgtttttctggaaaaaaatcagccatctagcacatgtattatttatatcaaggaagaaaggctttttaaaaacattgcaaagatttgttgtgaggctaggcatggtggctcatgtctgtaattccagaacttt

SEQ ID NO: 114451 - DNA, 2244 bp, Homo sapiens
taatcccagctactcgggaggctgaggcaggagaatcgcttgaatccaggaggtggagattgcagtgagctgagatcacaccactgcactccagcctgggcaacagagccagactccgtctcaaaaaaaaaaaaaaaaaaaggatttgctgtgagtggtggaaatcacgtacctctaagactgactgagactatcttgtgttttgcacctgtcatttgagagcattcatgttttccagcacacatcatatgtgaaatggagcactgtcactaaatactgatcccatgacttgaaatcattattctaccttcagaagctgggaagtcattacattataacctgtgctctccccgtttcttaagacagatgaggcacctggtgcctgcgaagttaggttacttgcccaaagtcacagagttaattgagcagatagatgttctggctctgagtccagtgttcttagaaaattcttaataatgttttgtttgttaactgccttctaatgaccagatactgaatgaagttttaaagatcctttagcttaaatttgcatatgccattcgatgagtcatgttccaaaattttatatccgaaaattatcaaaggccatttggccatgctggatgattaacaacttcaggtgagtctaaattgatttcttggtagaccatagctgtggagtgctgtgattactgcctggtgttcaatgcgtaattacactgttattctatacttgtaaaaaacatcgttggattggaagaatggaggcctgataaatttgtgctgtttaaacttgtgaactttctctggaatcaagacatgcctgccagaagaaaaaaatctacttgggcacgactaagtgctatctgtagattgccaaggaagctttccccgcccctgtgacttgctgtgagtcccctgggctgtcctcccctctgagcaccagatactgatttgttgtgcctgctgtggtggtaattacataaagtgtgtatcgaggtgcttcctgtctgtcttatccccagctccgtcctcagccccagtcgcagagcctttctcacagcaggagtgcaggaaaaatgagaatgctctttaccctgtccaggctatcttgtggagatgggtcttctcttgatctgtatccctctcttttcttgtcttcttcttatttttaaatactctgatttttaaagcagtcatatcattagtcagggcttttggttgcaagcagtcagaactgtctctagccaattataagcatctcatatggcaacagtagtagttatttgccaagaactatgaagggtctgagcttctttactctatttgcaagctaggttaacctgccttagtttgctagcaaaagacatgagactcctgggtcagacagaggactttattattcacagtggtaacagtagtcatgatatcagcatttgttttttgcaccagttcttcaagccctgattctcacagagcgacttgcagaaggccagttgtgcacacacagtgggttgcattgcaggaaaggaaccctgaatataaggtacccgaatctcttatactggactgcaagcatgcctgctttttgttcttaagggagatgctgtctctgtcttccaagtctgtaagcatacctgccctttgctctggaggaagacactattctctaagtctattcactataaaaatatccttgtaatgatagtccagaacaaagatagtcattgcctctgcttaaatcatgtacagaattgcaagagacccacggagaattatctaccaacaatatgcatcatagaaatttagaaaacagaagaaaagtcactacagtcctaccactcttactgttaaggtttttgaaatatatagagttttagccataaatataaatgatttcatatagcatgtattttataaaaattggtttatactgtacattctatcttgtgatgtgatgtttttcacctgccactgtatcatgcccatttccctctctctgctgtctgtattcttcttgatgtggtgaagcatctttgcccaatcttctgttcccttgtgccctgctctctgcctaacatttaattgtactaagtatacaatcagagttttagaggttgaagagcagagatttcagatcatctggtccaaccttttcatttaacatgtgtgttaactttctcatttaacataattacatttcactgagaccttctggaaccaacaagaaaaccttaatatgga

SEQ ID NO: 114452 - DNA, 1084 bp, Homo sapiens
ctcaggtgatctgcctgcctcagtctcctaaagcgttgggattacaggtatgagccactgtgcccggccaaatatttttcattttaaaatgtactttttatttatttttatttttgagatggtttctcactctgtcacccagactggagtgcagtggcgcaatctcagctcactgcaacctcttcctcccggcacaagtgatccttccacctcagcctcctgtgtatctgggaccatggcatcgcaccaccatacatggctaattttttgtatttgtggtagagatgggtctcactgtgttgccctggctggtcttgaactactggtctcaagcagtccacttgcctaggcctcccaaaatgttgggattataggcatgagccactgcacctggtctaaaatgtacttttttagaaaaagaaacgtctttttaaaaaactaagcatactgcttaattcctctagattcttgctcttgtcttgaggactttgcatcctctgaactcaacttgtggtcagattctccggatgtttcttatcctcgaaagtttaactcaacctctttctcccagtaagcctctgaggtcccagcagcctctttctcaggtcccgctgcccttctgttctggcatgtgcctaacctgacagttgctgccttgctcctgaaatttgtcattccatttcgatggtgcctgtgtgttacctgtgtatgactgaagtacatattcgttatctgcgtgagacagtacagattggtgtatagtattttacagccacttcattatatgctatttccgtgtactggcaaaaaagagaataaaacttcctaggatataagtacctactgctgttttggtgcatgtccagttaggcttttctctttttatttgtttgtgtacctgtaactccatataagcatatataatcatgttacatatgtttaaaaggcgtcattttgcaatgcagttttatcactagttttttctctgtcaagggatgtataaaaatggatcacaaatctaaatttaaaactataaaacttaggagagaatctttgtgatcttggattaaacaaagatttgtta

SEQ ID NO: 114453 - DNA, 1959 bp, Homo sapiens
tcggggaactccagccaacttctgtgaaccttgtttccaccccaactctccctccagactcacatacctgctcaaacgtgcagatgctgctttcattgaacctcagatgtctcaggcatgtagggtgttttaaatttcagacacctaaaataaagtgtctgaagtttaaatgttaacctgtgccagtaaaaatagcagaagtgcctgaggaaggcctgtggtgggtgggtaagaattgttggcattattgaagaaaaaggaaagagctatgtccccccaatccccaaaatggagaacaaagcaaattaccctatcctgaccagtgtacatcaggtctactgattgattatagccaggaagttagggtttggcactttattgcttaattttttaatttacacattgaatttgctttgcatcaacttttgagaaagtggttctcatgacttatatttgtatagtactcatacttgttcatttattttctagcaatcaggagaccaaatagggtagcctgtactttcttcatgtttgcctgatgaaaacactgtacggttagttaagactcatggccggatctgatttgtaatttcttgtttctgaccaagaagagttcagttgctgttgaacaacacggacaaagtacactaggggaattcagagcaggtgtgaggttcttcctgctcctagaggtttgtgtgctctttacaaacaaccttgcaaacactgaggttgggagggaaacaagtctgctttgcacttagagcgcagaaggatttctttggttggaatgaaggagaaggaaagtacaatttttttcctgcttctcctccctcctcttttcttttcactcttcttcccctcttctctctcaaaagttatttctaaattatcaggttaatatatgtaaactaatattggtatatataaatgacactatactatattaatacataaatatataaaattatttataatatatgcactatatatatatattaacttgataattaactctagctgctagcagaggcgagcaggctactttcacatgcctgactcaccagttagatactaagctgatgcacaagttagctgtgcttgtttctaacccatttatgccaaggacacctttactatcaacatgtaatttaattaaatattttctgagtattttcagatatgagtgggaaaagtatttctataaaggctaaattgatttgggatgacttgttaaagatggtatgtttaaaataagctgtcacattaagcacaggagagaactgtaaagtcagggaaaattttgtaaacatctatgagcattctgaccttagtttctttcagagtgtgtctgtattctaactccagtttaataaggatgaatgccagaattggagtattagggtttattcaagtaagacaatgaagagcttctgtccagggattcatccttcattcacaaaaagaccatggtactggcccagggcaggagactgacagtgagggacggggctgttcaagtggcactcagcaatgtgcctgtattgagcgggaggatgaaagaaaaccatatttaatgtgtgctttctaatgactctctgctttaactgacttagttaaaaattatcttacctgactacaagtgatccccttgagaaagagagcttcatgcagtcaggcaagccgcagtcagggctgtcactgcttgagtttactgtcatgtgctcctgctggaaatcaatcagattccttattctttaaattacacacaggtggaaacctagagaagggctgggttgactggccatcttgaaggctgaaattggtggcatcagttgctctctgctaccctgacagatccataagccgtggtgttcatggttagagacagagcccttcaggccccaaggaagggtatgccatgggtcacctagggagggctgctggagaattcctctc

SEQ ID NO: 114454 - DNA, 1151 bp, Homo sapiens
tttctgacaaaggtgaaataaacaccttaggtaatgaaacatcctaccttaagtcatttgaactcattgatttcaaatcagtagttatgatgttattttttccttttacagtttaaaaaaattgtgttgaatgaagtgcctttaaaaacttgacttggaggaagaaagtaaaatgatgagaaatttattttgtatgaaaagtaaatcttttctgtatttggtgtttaccatgtgtaatttaaaaaggaggctagactgtctagttcaataataagaatggagaaatgaatttagaccaaaaaaagcagcctagatttcctctacttctgtactgataaagatgatttggagcttatcttcttcacaactgttttaggtgaaagaaaaagaaaaccataacaaacctaactaaaagcatgcatcgttttttatatgatgctaattaagagatggttgaattgtggcagttgcttctactacatttctttcacaaacgttcttttgtagtgactttgttattcgtgtctgccaatgcacactgttagtgtttattggtgtataatgacaaaccttgattgtgatctggaaacctatcacagttttattatgattttacatcttattagtgaatatgctagtgataaaaacttgatttttttccttcagctttctttattcagaccaaccttcttttatatatggccttgagaacttctgcaaactttggtttttcatccataaaatggctttagactaaatgattccttaagtttctttagttccaagatttgatgattccacaaagtttgagatcttttagcgccaagatctaatgattccacgaaatgtgagatcttttagctccaagatccagtgattccatgaagtgtgagatcttgcttgtatgtacaaatctatttgcaatttctccaatggcgtgggttaagttctactactccaaagtgcctaaaaatcgagaaaccataaaactagtttttgttcttctaaatagacaactgaattttgacaatagaagctagttttgagagtcggtgacttatttatgttgatttggttattttaaaaattttctttagcgattaagaactcgtgttctggaatcaaatttgaattccatcccctccacttaa

SEQ ID NO: 114455 - DNA, 1050 bp, Homo sapiens
tgaaacatggcagatgacaatttccaaaggctgtgaactttccaatagcagtaaactcctctgaagaggactgggatgtggaagtgggatccctgtgccgctggcagtgccggcagcaacccttctccggctcttactgagctagggaagctgttgctctgcgccttcttgtttagtttacaagatttaggacaagtgcctcggtttctgatgctgtcagagacttggtcaaggtgaaatctggtagctcagtttatagaactatgacaaggctagtgtggtggtgtgacattggtgaatgtttgtgagatggaaaagtactactagactttagcagagccagtggcataagaaacttaagtttaaggccaagtgctttgtgtgtgtatgtgaagtggagagggaggaggatgatttgctttctttttctataattttttttttttgtttactctgcaaaagcctgaccagatcattgttttccttaccccccgcccacagtggagtaggagaactccatttagatccttgccctgtacttctgcctctgcaaaccttgctttccttgttgaaaatactcagagagtctttgtgtcctatttcagtgctgaaaaaagatctgctgctttctaaagtgtgcctgtcttaccaacccgtgtgggaatgctgcccgcgtgtttggatggctctatcaaagccttaggctgtttctggccggagtcataggggacccttcaggtttgtggattcccagttttagtacagtgtctttaccaccaatcccgtattaataggacagtactgcgggtggcaacctgggccgggtcttctgctgtgatgaggaatcacctgcattagtgtcacctggaatacctgtgaaaacgcagaatcctcagcaccagctgaggcatcagaatctttgggatagggttcagggttcacttttactccaggatctttacctgaggactaacattaaagaaccatttctggaggaggtaaaatagatcagtatttttcaagcagcatgtggcgtccagcagttttttt

SEQ ID NO: 114456 - DNA, 1614 bp, Homo sapiens
ggttaaggtcacaaaagtttgaaacccagtaggttagatgatgtcttagttccctttcatcgcaacctcattttgtattgttttgaatccttagctcagacccccagccagtaaatcatctgctctgagacaaacactaagaataaaagaagctgggaagcttttaacctgacctaagcattgtcttggaaacagtaaaatgcagccccttccagacctcttttctcagtatctttggggcggggctttggaacctgcattttgagtaactgttccacaggattctgatgcaggtgtttatgggaccaccttttaagaaatacatgtgaagttttaaaccttgtaacaattctctgaggggcacctcctctccctcccacttttccctgtttccaggtaagaatcctgaagccccagttgatcagacttggtgacttctaacatcgcagagatgttaaggcgcgggcttggtagggcagcacgaggctgccgttcctcttgcccttcctacttggagagaatcagatggcgtgcagtgtggacatgtaagttcctgattgagggcgtctcccggatcaaaaataaataggattgttgaaaatgatagtgttggaatcctgggcatgaagccttttgtctctgggatagcctttgagacctcctccttccatgagtgcagctgacacagaggcaggtaagaggacaggtagccgtgtctgctgcttatgagttgtcccagctctgccccagctttggaatcttgggcagtggcagagagttatgtgacagcgtctatccctgagagttcttccagattttaaattctatgattctatcttttggaaaaatagtatttcctgtttcttaccttgacagagatactgaatgggtcgacaaaaatgtatgcacgtcttttgagttcccccagaaaaacgatgtaaacagaatcattcgttggcaccctgcagttcagttcagattttgtgtgggacacagcagatctcagcgtgcactttgagagctcctccaggagcaggctctccttccccataggaggctggtgtaagttgcatcacagccatgtcctctgtgtcctattcaccaaggcaagcattgggaacagggcggtggagcaactagcctaggtgaccctgcttggcttcaagttaatcttattacgtaaagaaacagagaaggatttactttcaaaaccccttctgatggtgtgtaggtgggaagccacatccagtgagatttgcgagaacaagaggaaatggccaagtttccgggaagcagggctgcggtgtgcagctgtgcattctgtggccctaaacaggcactttgtttttcatttgaaggtcatcatctccctttggcacatgtgcttcctctctttgtaaatgtgtaatattttaggctcaaattcctatcgaattttagtcttaatctaagtcggattatagaggtacatattgtcttactgttacattttactgatattcagtgtttgatatccccaaagtcttgacttggattcacaagtgattacatttgttatgcttgtcttgatatccaggaagtacatagttagagacagaacccacatttggcctg

SEQ ID NO: 114457 - DNA, 1119 bp, Homo sapiens
caaggaggtgggctgagcatacacagtgcagatgagatgggctcctcctgatgggtgggtcttcatgggaccagcatggaagattccagtcctcccacttaggttatttgatgatgatgatgatgttgatgttcccaactgcctgtctgattggtgtcaccaggttagaaggagggaacttcaagtccttttttctgtagaaccccacagccttgcaagccctgctagcgcagctgtgtttttagaagaccttgtggaggttgaaaaccagggtgttgccagtttcatgcagctttctggttgtgaacaagacttaccctgagagtggagtggagcgtggacgacaaacagaataattttacttacggagcctcaagttttagtaaaccaggaatctgaacattctttttgaaactaagggtagctagatagaagggtttttataaaagtagttttcttttgcacaatattgttttattccaaattatgcatttataagaggctgtaagacatggaatttctaataatcacaacgttatagtttaacattgtccctgaagcttggtgaagcattacgtcttcacttatgtgactaacctgtttagtcaattgccttgctaacccagcaccctgaaaggctccaccctgaagtggaggtgctgggtagagtgtttccatatcttcccagggttcggagacgtggagggcacaagtggccgatggccgggaagtcagaagaaggggaggaaagtggtttctgcagctctcctcctccctggtttctgcagctctcctccctggcttttgcattgccctgtgcttaaagtaggagtccaggagggaggaacacaatctgaagacaagcgtcctccaaacagggaaaaacatcataggaaagcttttcataaactcacaactgctgggacatggagagttgaggcacatgagacagctttggggaaaacatgcggaaataggaaacgctgtgttatcttaacaactcagtttgtcagccaggtttgtcttgttccgcacccgcagtccttgaggtatttcaagcatttggtcattctacccttgatggccttcaggaagtgcacagatgccagccgttgtatc

SEQ ID NO: 114458 - DNA, 1066 bp, Homo sapiens
aaagtctcttatgagtaaaattagaatctagttttgctaatatcatacttgttgtatatttgatattcacagtgaggacagctcatcattaatgcttagccaagtattccattaatagatgcctatgagcatttgtatctgagcttttggggggattcagagggagggtgtgggggcctgtgtggagaggaggccagggagctgggcctgttcagggtttctcatgtccgatttcctagtagaggaaactgtacctccatctccaataaaggaaaaaagaaaaacaggtttgtttttattactgcctggttaggcttgggggaaatgatatttgtgtattttaatgcagtgttccacacctggagctccaattctgatgtgttttatggggcacagaatggacagaaatcaattcctggtacctgtgacaaagaaaaaaccatccagaattggagactgttccctgccgggggaacagccgcaaacatgtgagcctgtggttgacaaaagtacgtcatgcatttcagagtgcgtattaggaatcagaggacaaatggcttgagaatgtcacacagaaagtgcatagcataactgcagcagcacatgactgaatttcctgggcgcaaaagctgttgaggactgaaagtcactcagtagcccatctcgtgttttggatgcaattctttgaacttttagagtagcagattccatcagggaggccacatgtggatttaagcagataatttgtataggcacaaatcatatcattttgactaagttttttggaatgaaattgatatctgctttatcaccacttgtacttattggactattttggctttttagaaccttacttgttagaaaaaaaggctttctgttattaaggttgtttgaataggctgaagcaggagaatcgcttgaacccgagaggcggaggttgcagtgagccgagatcatgccactgcactccagcctgggtgacagagtgagactccatctcaaaaaaaaagaaaagaaaaaagaatataccaaattataattcatagagtcaagccatcctgatctc

SEQ ID NO: 114459 - DNA, 1045 bp, Homo sapiens
tatgacagcccatggagggtaggtctcattatcttcatttttaatgctggagactgaagatgagagacctgtggttgcctaaggtcatatagctggtaggggcagagtttgtgtttttgccactgttcttgatagcatatttctgccatatgggggcttctcccggttccgtgagtgaggcatgccctcctgccatagcctccgttccttctgccttcaatgaatacaccttccataccactccccccaacccctcccattaaattctaatcatcatttaagtttcatctttggtggtcttaggtgtcactgttgcagacaggcatttttctggcccctgcaccagcttacagcacccccactccttgacctctataacgctcagctttatacttggttacgtttatggtgtttgttgctctgtttgtctggtgtcctggactctaagctccgcaagggcaggaattgtctggcatcattgctgcacatgacacctggtggatgtacatatttattaaatgaataaatgaatggatgttcatacttttgtccaccatgttttatgctaaatacacacagagtagataatgagagaggctctaatagcgaggtgtgtatcctttgagctatggatgacaaacttaaaaaattgcccattaagttagaaaagaattgagtatatctttttaatatatgtgtttacttaatgtacacgcatattgtaaaaatacatgatattggcattttaaaaaggatgaaaatatttaaaacaaggagtttctaatatgtttttctgtatgttagaggaccagctggtatccaggacccactaaacttggagctgggggtgccagggcaggccctgtgggaatacatgtaactaaacaagctccatggccacagtggaaccagactgcagttgatcaaagcatggttgagggtgggaagtgctgggctcatgcgagggtgtgtgagtgattgtgcatcaacatgaaggatcactgggggagtggtggggtgtaaggttcattggaagtctgggact

SEQ ID NO: 114460 - DNA, 1048 bp, Homo sapiens
ctacattgatcagcatggtgtttaaaatgccttaacgcccaggctcagccactttctctacctctaagtagatcttttgattgatagattcttagttcgccaataatattgatcaggctttgatagctaggttttgaaaagagaaacggttaccagctgagcccaaaactgcttgcttggttttaatttggaggttgctactatttgaggtagaattcatgactcatcaaattttcttctttcctctaacatttagcattattactctttgttggacaaatttaccttaagaatgttattctgagcagcttgtagtcactgcccatatcctgcctgttatccaccagaacatgtaggaattttcctttttactttttgtgaatttaagtgattataatatttagatgaagttagagatagtgaactttatacatgagaaagtaaagtttatgtcagttctctcgaaacagtgtacgtgtagttgattttagtaggaataaaagttagaaaaatgcacagagattttgttcttggagggatagggtcctggaggtgaactgactactgcatgctgggagggacttcctgcagctaagtgaagagaagcattccattgttttctttgatgctgatttgaatgtggtcattaatttgctcattattttaaaacatttatactgtcagtgctagggttttttccctcctgcatggtatggtgttaagtaaactcgaagccaagtatctgctgtcccatctttgtgccagagcattcgcagcctccagggctccaccagcccatgtgggccctcctgggtccctgtgggccccgtgcaccacctgtcatggattcctgccgctggtgcatgggacacccgaggagataaggggtatgaatctttcttctttatgttccatgcacatttaatagcagacgatattaaagagaattcagtgttaatgtaacttttcatatttcatctttttttctttaaataattcataaagtgctactttaagttaaaatcttacaatgtaggatcctattgga

SEQ ID NO: 114461 - DNA, 1784 bp, Homo sapiens
cattgcaagcttagaacatttttttttgtagcagttcaatacacttgagtgctatgatttttgaagttaaaagtaaattgtattattccaacgacactgtaaatattaattacactgatcatagtcactaatggtgtttgccatgtgccgggcactggtcaaaactcttgcctgtatcaactctcatccttactacagtgctagtagatgtgcatattattttacagatgtggagacagagatatggaaaagttaaataacttatccaaggccacatacctgccaagtggcagagacaggcctggaatccaagcagggaggccttgcttctgtgctcttagcctctggactactgcagtctacttcatgttttccgttgactaacagaaagctcttttctccatttctttactgtggcctcagatatgaatgtatgtattatatgtatataataaagacatgctaaatcatcttaacctacaaatctgagtgcagaataaagatcatttctgtgaaacacaaaagataccaatcttatacaaatcagggctcttgtcaattcttatgattaaaatattattaaaattgatagacttttttctttggggatcctcacaagaagaaaatagtgttgcctaccaggcataaaggagttctggttttgtatccatactggttcacaaatgactatcaggaggaaaagatggtaacatgctccccactgcccccttttgagacaaggtctcactgtgtcacccaggctggagtacggtggcaggatcatgggtcatcgtagcctccgcctgctgtgctcaagcagtcctcccacctcagcctcccgagtagctgggactgcaggcgtgccaccatgcctgcctaatcttttaaaacattttttttacagagatgaggtctcactgtgttgttcaggctattcgggctttttgatctattatttgattgctccaagtcagccagcccttatattcccactctactctgcattgttggaggataaaccagaaatgggaaacacaggccctgccttctctaaatccctctctactccggaaggtaaattgcaggtgagctttgggataccttgctcgggcagagggaacagacacatgcagtggttggcggcccagccagggggtctcttctctcacagccacatctgcaaagacagcagggcttggttggagactttatcaggcccctcagtgtgaagagctcaggaggagctcagtcttgtgttgaagccagtgaagaattccgggcactcccattactgctatggctctttcctgctgcttctgtgtcccctctccggctcctgggattttgggtgtgtccatgtcctggtccctgcctctgctgttactcccccctccctctccattcgtgtgtaccctgccttttctctcaatgttttgctcgcaacttagacatgaaatgttttttttttttaagttagatttaaatttgattaaagattatattccttaatgcaagtaaaattccacccctcctcccaattcagttgtttctagcttagagtccttggctgatctttatgtctatggtacttaaattaagtttccatgtatctgttataatggtaacttttattatgagagtctcttcaaataattagaaaatgatttttggaaaggtgtatgtcaaatagaggtcataatgacaaaacataatatcttataatgaatgtaatattctggactaaaaaaaaattattccataggagggtataagccaaactagtt

SEQ ID NO: 114462 - DNA, 1011 bp, Homo sapiens
atatcatggaagaggctatctttgaagctatagagaatgtagaaatcagatgctttcttttgagactattaaagatactgggttttcatagtagtatgtagaatacttaaaagcaccttatggccagtttttccaaattggttatttacattctagaatatgatttttctgtagaattgttatctgtatggctgggctctcaggccagccctagaaattgtcttgtcctataatgttgctgaactgcagtactaagaatgtcagagaaaataagcattaatcattaaaataaatttgaaattctgctgagcttatgggaccatgtttgactcctcaccgtagcccacagcggcaagaagcagcacctgggaactccacgttccactccttgccgtcagcctggattgcagcgggtccttggtgtattcaggtggcatctgtgaggattgggtcaggctcatacagggaggctgcagttgctggagcagggagcacagggtaaatgaggtttggggtctgtgagaggcataggcagagggggtgggctgcaagggcagctaggggaggtatagccccaggaaaagagagtctgagacaggcccagggggatgcagctccgagttaagtacttgaacatcgggagctatgcatcccacagttctctacagcaaacagtaaaatattactgacagacttgggaaaagccagcgagtcttttgagtcaatgaaaagatagcatttgctgtgatcagcttctctaatattgttcctctgtaagggtttcactgttctcaactttgaacatccactcgccgttctgtggtatatccatttgtccctagtatttaaattaggttattgtaaaagctcctttgcacctgttgaaaatgctggcacagtttctccattagtaaaccctagaaatctgagctctctttcactgaagtttcttatttcaactggaacattcttcttgaatgtgtgtgataggatcagtgtacggttttcaaa

SEQ ID NO: 114463 - DNA, 1758 bp, Homo sapiens
ccctcggctggagcctgggccaagtcaagacatggaaatgtcctgtcactgtcacaactgggtattggatgctgtaatccattgttgtgatgtgtggatgtaaacttcagaattaggggaagattagcctgaactatgaaacatgttaatatgcatttcagttatttccaaatgtagaaatatacttttaaatgagggtttcagctttaaatgaagtcttactaattcgtatatcctattatggtaagatataaaagtcttttaaggaatatgttcttttagattaactcaagacttgaagtgatgttgaagaaactcttgatcatttgaaccctgtttgggaaactttactgaattttatggtagattccttgtaggacacatacatatttgattggtatatgtcatataagattttgcattatattgcacttaaaataggtgttaattttgttttaggatgttatagtctgtgctaagaagagcatgctattttgacaataaagttgataagttggaatacatgggcttagatatataaattaaatatagagagggaagcagaagaaatatagaccactaggcagggcacggtggctcacagctgtaatcccagcactttgagaggccgagacaggcagatcacgaggtcaggagttcaagaccagcctggccaatatggtgaaaccccatctctactaaacatacaaaaattagctgggcacagtggcttgtgcctgtagtcccagctacttgggaggctgaggcagaagaatggcttgaacctgggaggtggaggttgcagtgagccgagattgcgccactgcactccaccctgggcaacagagcgagactccgtctcaaaaaaaaaaaaaaaagaaaatatagaccactgccccttctttgcagctggggttattagcttatgactgtgggatgtttcaatgggtcttgtacctcatggtatattaggaaatcatagagttagaacttggtaatgcaccaagttaaaataatcaaaattagattttgaaggaatcattctttaatgttattaccttcccacttaaaaaattacaaatggaatgtcaaaccttaggcattaggtaactgaaatcttatagcatacccttctgttcagacacttgctcttgcgaagtgtgttgaatgcattttagtaacatccactgccaatttaaagtgacattgagtagattaggaaagtaaaataaagtgatttgatccattcgttacttgaatggttaattttatgttgactgtgtggattaaatacacccggggccccaggcagtgtccctgcacctgctgccgtaggtgagggggacaaggcctgcctggaacagaaggcagctcagggcctgggagtcagtttcctgaggggagccccttgcaagcgccgtccacacagggcccccaagtgctgcccacctatcttgttcatcctccctcgctgtcaggaactgctaccctgggctgtgctttggaacaggtcatcagagctgacattggtggacactgttggtgtgtgctacagtggtgctcagtgctttacagacttctcctgtaatcctcagagcaagcccaccaataagaaattctgatccccatattatgggcaatggctccaaagctctaaggagtgtattaacttggacgtggtacttctggggtttgattccaagcctggctgacttcctgacggtggtgatctctctcaccagactgagagccctcaaa

SEQ ID NO: 114464 - DNA, 1023 bp, Homo sapiens
cttgggcttcaaaccctcagaaactgcttgctgcatggaggaccatgatcgccttgtctggttagtgcattccagcaatgtgccatgtgaggcgcctggaaaggaaggatacaggaagtggggagccctgtggatggccaggccatctttctaccgttggtcttggctctgttctcccgcgagaaaggcaggaaggtttttggtctccaccctcctcctcctgtttcttctccaaccacaccagtagcataagtgggttattgtatatgaaataggctttggtgggctcctctcggaccctcatagcaacctgtagcattatttctacgggaaaatatattttttaaattgagaaacagcagtcttcttaacaaagttttggaacccagaccacttggaggttggagactgagtttatgggcaggtctccccagcagttcctttttggcacttacttgtagggaatcttaaatgggaggaactattagaggaattcagttgagacataaatagaaagggaaacaatggggtatcctgttcttttagtctcacacttttaaagcaaaatatgaaaatctagtttattgttttattggttcagagagtttagaatccaaaattgatttcagattaatctcttgtccactaatatgcctgtttctgtattcttcaactcatttggtaaaaggtagcagcaaatggttgcatccttaaatacatagactggtctgacggacaatacaagctttaaagaggatgtggaatacaaccctttgggaaaacagtttgatattaattcataaacttgggaaagtgcgtaaacggtaagccagccatttaaccctgacatatctctaggcgtagagatccactggccttgggttctcgggtagtggatggggctgttcatggcagcattatttgtaatagcaaaaatgagagacaaaacaaatgttcacttacaagattgccaaaataagttcaagttgtagtcatcaaatggaacactatgcaacagtgaaa

SEQ ID NO: 114465 - DNA, 1022 bp, Homo sapiens
cccattgccttatagttccttaaattatttatagtccacctgggagaagttatggagaaattatttatagtcaggttaatttactatgattgtgtggatttttaaaaatatgtctatttgttagtggctttttaacaataattacatgtctcagtctgttcttttagttttaagtaaagatgtctgtcttaacagaatacaataattttaggtaaatgggcaaaaattcccaaaattcagttatttaaagcacttaccaaacttgtacagctaagtttcagatattaatactttaatactgttacaactgctactgttagcatttgttagtgagttctgtgagctgtgattctcaggctgtccatttcacagacgaggaagcgaagctttggagagactaggtaactgcccacagtcaccccccctgggaggtggcaagcccaggctcctaactagacacctaagtaactgttgacacaaaatttcgttttgagttgtggcaccattgtggtttgcagccgatgtacttaacacttgtaatgctagtgaagtgcagctttgcctgtccccacagcgagcgtgctcctgaatcctctccacacctcatccccatgtgtgtagctcccttttaaggtggctgcttgtaaccctgtgtcatttcctctgctggatcccagctcctggggcagcaggcaccctgaggtctccctgcagggtactggaatgatgctgtaggtgcagagagttggccggtgagggagtgccacacaccttatttaaatgtccttactgcactgccgtttttattactatactaagtttaatttggaaaacgatgttccctgtgctttttagtagataagatactgagatgtcctgtcaggagtgtagcaattaggagactggaaaaaggaaaacagattccccagcctacaagacgttcagctttgcagagtcttttaggatcttaccccactcagattgggcactgcagggcaggtgtctaaagatatgaaactgcg

SEQ ID NO: 114466 - DNA, 1053 bp, Homo sapiens
acacataacagtgtgttttggaagacatatttgtcagctcttactgtttacacagttaaggctacggttagtgtaatgtgtgttttattttgttttagagtataagcttcttaaaatcaggaacatgccatttaggggaaaaatctctggggtttaagagagtaccatgcataaatatgtattttatgaatgccaagcgattaaacacaattctaagctttatcaagggactgactggcagaaagttttgccaaattctttgatgttattaaagatttatttttgtactgagtttcatgttagaatcaaatccatgcttactgaagtggaaataacttttcaaaccttcagttaaaaattctgatgtttgtttgtggcatttactttatattctatattaataggagtaaatgaattaatgggatttttgcagtgggcatggacctaaagtatcttaacgttgtggagtacattagggaaactttggtattttaaatgtgtaatttagtaactctgaatactgtattttaaattcaacataattacaggtcactcagattaattgatagcttgttcagacactcagctttggtgtatgttttccccagggctggaaaatgaatcaacacagaatactggagtagaggggattggtaggcatttgttggtgagcaaggcccctggatgaggattgcggcttcagtgactagtacctgcacctaccccctccttaaacccttttttgtttatctgtggaggaaacattcattcagaatcagaacctttgagttttagggccggcaggaggtaaggctggggtagaggctactcatgtggagataagctagaataagccaaattttaaacccaaatcgtggttcagtgctgggaattcagttcctttttcttctggaaatgtatagactgtctggaacgctttggcttggcctacctgttgtatagtgtttgttgtgtacccttcgtactcacagtgagtcccaggcaggatttcgtgggtaaagtagtacagatgttctgaggagttacagtttg

SEQ ID NO: 114467 - DNA, 1044 bp, Homo sapiens
ggaaaactcatttgactagtttaatttgaagattaggtaaaatttcagattactagtatctgccagtgtcctgggagaaatacaggattaaaaaaataataaaacctatgttttacttaaaaaattttaaaatttgattcatttgattcatctttctgccagttatgtaaaaataccatttttaacataatatgctatataaaagcttttgctcattgtgaaaatatttctagggtgctttttattataaataaatcggagaggggcttgttgttcctggactatttgttattgttgtcttaaatttaatgccacagaagtgaccaagtgagcgagcattctggtcatcagtgactagcttagaaaggtatttgtctcagtgcagcatctctttgcagggtttcaggatgacagatgagtaattgatttggtcagtggggtattagatagttgaagttccagactgttgattcagtggaaagatatttcactgttgaatgataacttgcagaatattccttgttagggcagagagattaattttccatcttatgaatataaatcatactatgattgaaggctaaactacctaacatttcacaaaacaaaaatagaaagtactaaggaattttggggttcttgggtaggggttcagggtcaagatgctgtggaaatatatttatttgttggttgagttcattgattgattgattcattcattcatccatccatctttcttttccttttctttttttttggagacagagtctcgctctgccgtccaggtaagcagtggcatgatctcggctcactgcacccttcgcctcctgggtccaagtgattcttctttctcagcctcccgagtagctgggactacaggtgtgcaccactgctcctggctaatattttttcgtattttagtagagatggggtttcaccattctgcccaggctggcctcaaactcctgagttcaggcaatctgcctgcctcggcctcccccttcatccatctttctacccagccaacccacatctgatgaatgc

SEQ ID NO: 114468 - DNA, 1051 bp, Homo sapiens
gtattttataacaaatcccaaagatcacatcatgtcattcaaaaatacttgagtgtgtaggatgaccctccggccactgaacagtctcttcatgtcagtacctaggtttgcgtttgcattaactgcagtcccaagtgacaagaaatgccattttgcttgtcctcgattaatgagcaaataagagaggtggattaacatgtaaatgacgcatttgccgagtgataatggagaaagatttcagagtagtccaaattgaaagaagtggccacaaagtgagtcctctctgggccctctcccccagggtcctgcaggtgctacccctagtgagtgtatagcagcaggagcgctgtttggttttaaccaaacaaattatgtgatacagatttcaccaatctgtaaaaatcatcagcaaattactggtgtgtgaatttctttggacttgtgattttgcttatgtgtagtttgtaagtctgatggtttgttgtagtagagtggtatgaacacaaggcgtttctacccagctgtacatttgtgtgtatgtcttggggcctgtgagaccttttgctgtgtccagtgcttcctcgtgcttcccagatttgaaggcagcccttcggccattcctcagttagacagtcacagggctggtgtcatatgtgaagggagaacatgggcctcagaatcagactgactgtgacctgggacacatgacttcactttcattgctttcctgatctgaaaatgtgataatgacctgtacattttgggatcattgtgagtatcgagtaagattattcctgtaatcttgcatggtgcttgacatgcagtagcttgctgagatatagtgcaataattttctgatttcatattcacccttctattttccttcaattactttccttttgacatgatttctagaggcagatcacattgttttcttctgcatgctttctagattgtctgggtccggcacagttcaacaggaacgtgacctgagcagctgtgagtgatttgagtattattgctggggtcgcccctccctgccctttttttt

SEQ ID NO: 114469 - DNA, 1095 bp, Homo sapiens
aatagttaatccttctgtaaactgtgcaagctcagcgtagcttttggttttgttgttctcccgcttattcctgttgttaagcctggagtcattcaggattccttttaagcttctttcaagtagaggggctttgtagttcgtgtgcatactgtgtaaggccatgttaggagaaagacaggcttcaagggaatttatcttgatatggtgaagactgatggttacagtgcggtctaccaaacagcaactagtaaaacaaataaaacatattgccaccgttttacaatctcctgtctttggtgtacggcagcagaatatgtgaatctggagtagaatgccttactgggcagcaggcttcctttgcagagctcttggcctccgggcacctgcctcttcctgcttaggctgccctcaccccagtgcctccagggccctggagtttctgtggaatggaatctcgagggattgcaaaccccattagagcccaaggaagtctagaatgcttaatttccatgacaggagactttaggagatgtttctgggagtcccatttgcctctaggtttcatgaaggaggtcagaaaacaggtgatgtttctgcccgtgatgttacccggattgtaacccacgacctaattgggatgtggaggagaagtgatggcatgaggagtatttgaaatcatttcaatttacatccctatgagatagttattagaagttcatcacatcgttcctaatcagttttcagcatttgggtgataaactaagctgctggatctgttttctcctcctggctttagacactgtgctcctctgactgtgagccgccttctgattgggtcctactgctgggctctaaccatacaggcatttttttggggtgttgatgtgatacaccctcttactgatgtagatgtcatatgtactttgcatttgtaaaacgtgggaagctagttagtctgatagtctgaatcaagatatagaagggaatggggtgtgtgagtgtgagttagttgggagggggaaggagggcagggttaggggagtgagcctatgtaagagcatgaaattggttttaattttgaattaattttatttg

SEQ ID NO: 114470 - DNA, 1050 bp, Homo sapiens
acagtggaatcttttagtcattgatatttctgtcagtaacctgtgggcacagcagaacccatccagagacccataagttcctaatttcaccctaacgggtctttaattgaacctcactgtggcaaattaagtagttcagcgtggcagggagactgggctgagagtcagaggatcagagtttttaatcagcctgggggattagagtaactctctttacttatctgcttcttaattccttctctgtaagaggaacacatcagataagattttctggtaggtcctgcaagttcagaactgctgacttgttcttcgaagtaaagactcttctgagagaatcagacagcgcttgaagttgtccagggaaggaagttgccctttcttggtactgccccatctgtgggcttgtgtcagtaatttctctttctggagtgattgcgggttgtctttttccttccggtagatgtttgactggatcacacacaacaaaggcctgtttctaaacagctacacagagattgggaccagccaccctcatgccatggagcttcagacgcagcacaatcactttgccatgaactgtatggtaagacactcggaacagctggaccctggcatgtgacagtgttttagcaaatgggaggcatttggcaaattgtatgctagggctttcaaggggccttcggagtggctgttgattgtagcagctgaccttcacatggagggtgttccctagggttccattgtctcactatcccacattttaagttttaaacaaaaatgaaaacaagcaaacagacgaaccagtgaaacttgaaccaatgacttggctagttcagcacagacacttgggatgctggctcctgtgctgcacttcataggagcccacgggggccccagcaaagctgctgggaggcacagtgagtcccccagacggagcgctgtcagtttgctggctgctgttcatgacagcgaaaggagcaagcctgctgctgacctcagggcactagctagttctcctgaggcatgagatttccttccaagctgagctgg

SEQ ID NO: 114471 - DNA, 1036 bp, Homo sapiens
gtagaaaggagagcttgctttcacacaaatagcctttggttgctaggtacgtgtttttgggtttctgggttctggttaaaaaccagagcgctgggtccctcagttctctgtgactgcctggcagcaggcttgccatctggaccctgttcagtatttgaagccaagaagtgagtaatagtatatttgtgtgcacccacttgtgtatttgattgctttgtgctgaacaattatgcctttcagctagttgatttgtaattttacagttttaaaaatagaaatggaaaccaatacttcaagtttatggaaatctagagagcaaatatgtataatattatatatatcaggtgatgctcctgggagagatgtgatcactgttagaagcctgtgtttcagcaggtggcatctgggcttcttagaagggagcctcctatttgctctcccctaaggagccctcttttcctgcccactttccagaacgtgtatgtaaatataaaccgcatcatgtcggtggccaatcgtctggtggagtctggccactatgcctcgcagcagatcaggcagatcgcgagtcagctggagcaggagtggaaggcgtttgcggcagccctggatgagcggagcaccttgctggacatgtcctccattttccaccagaaggccgaaaaggtcagtgccttgaacccccagcccacgaggtggtaaccagaatagttcttcctccatgaatattggtgtgtgtgcaaacactcttgtgtagcacatactgtgagctccgcatgtgagctctgaagtcacttggccctgagtttaaattccagctcttttagtccttgctgcgtaaccttaggcaagtgacttagcctctctgttttgttttttcatttgtaaagtagaaataaaagtacctgtttgagtggactgttgatgtaaatgtgatgctaggtgccctacacagtgcccggcacagtaagcactaagaagtggcagctgctcttctcttcccctcctctcctggctccttctttgctcttattcc

SEQ ID NO: 114472 - DNA, 1050 bp, Homo sapiens
ctgaaggatcatgtgaagaggccctacctacttaagacacctgcatcccacacctggttaccttatgcatctcacacacactttgtgttgtctgattgtcactttttttccccccaataacatctggcgtaattaattactcataagtcttatgaatcacttttaagtaggaaaaatacataatgtttttctttctaaattgcaccctcaccttttcttatttctttgattaacccgaatactttcatttaattgtagtttgagaataaattgccataatatagcacttgatggcattttaattaaaactaccttttaaagttaatgaaccaaatagaatggcattttaaattttcttttgtgaagttaaattgctctccagctatgtcagaaagtttaagtacatattctatgcctagtgctagattgatttttttgttttaactgaggctttaaggaacaattttgttccattgtgatgatctgctgtattctctttaacatgtctcgagataaaattattacttttaaattttaatttgcagatatcccaggaatgcagtttctgttagttgatttatggcatttaaggcaaatagtatgcctattcattgagtggtatctactacagtgttttgtagtaattaatgttcttttattttcacctagtgttttgcatcatttggctttgtgatgtcattggatagctgatggattgttttaaattttatcctatataaaactgcctctgagtaaaactgtggtgtgtgaatgaatgtctgggcatgtgtgtaatgtgtgtacatgtacgtgtgtgcctgtatgtgcacacacatgtatccaaggacagcatctgtggcacagcctaggccaaacctcagatcgtgaagaatcactcatttcttttgtgggcaggtcagccaagatgggaagtcgctccttgacaagctccagcggcccttgactcccggcagctccgattccctgacagcctctgccaactactccaaggccgtgcaccatgtcctggatgtcatccacgaggtgctg

SEQ ID NO: 114473 - DNA, 1003 bp, Homo sapiens
aagataattgccagagaaagaatacagtgcaggaaagaagaggctggagccagtggtgaagagggattgagaggacagacattgtgggaatgaaatcatgaataatcgtgtttttgaattgtccaaaaacttctacaaaccatgaaatgttggagtttaaatctaattgttgaaaaattccccacattccttgtatcccttaggttgagcataattccacatccgtggactgatgcacttcccaagagggggcctcattaactcttccgaggcagcagcagcaagggcaccccctcctttccccccacaccccatttctcatggctcttctttctctcatctcatgcttaggttagaaaagggcacaaggtaaggaagcccttgggaataggctgaatctggctatctaatttggtgccaaatacttaatgtgcttgaatttaaaaacagcaaacatgtagaaaggtaattataattatgaggccagttctttaagctagctttttttcccctctcaaacagcatattggcttggatgtcagcaggagaaagtgttttttgcaatacacataatgcatatatggtcctgttagcaatctatagaaaatagatattgctcattaaggtaaatatttttgttgatgaatgatctggaatggtctggacttgttgtgtgaacaggaaattgctctgtaggctttgacttgtgaggtaaagagtgaggctggtaagattaattaaagtaaatactgtgacaataggatgtcaaaaccaaaaacgtgtttctgaaactcaaggaattaatgacacatagggaagtttttgccatattaagcatagagtaggagaggcaagtcaagaataaatgaaagaaaaatagtagtactttagaaggacgttaccagcagaagataaatttgtaaagacagtagtaaccgaaatccataaaaacatagtaagccggttagagacacgacagtggttttcatttgattgttttgag

SEQ ID NO: 114474 - DNA, 1021 bp, Homo sapiens
tctgttgtttataaattactcagtctaaggtgttttgttagagcaggctgaatggacaaagagagcaccagagttacaacatgcaaagtatgagtgaaccttcaatactatagctgtgcattaacaaatatgtttaaatatttaaaatcttttaaagtttttagtttttagctaaagacatcactgacttagttttttgctggttatctcctatccatcaaagaggacaaagtgggcatttgatgtagtgtaaatgcagttgtccctcagtgtctgcatgatcgcccacatataccaaaacctatgggtgcctaagtcctgcatttggtcctctgtatatgtgggcttcacgttctgcaaatactgtagtttcagtccacatttggttgtggatgcggaacccttctgtacggagagccgactgtacttattttttaaaaccacataaaagtggacctgtgtatttcaaacccatattgttcgcaggtcaactctagtttgttagatattgtcagcgttttgtgatttaagtatgagacccaatgaactactcagttccaactacgaagtttaaaacataagattatactgctttgtttttactttttctttagtgtggtggatttcacctagcaagaacttttaagtaattaaattcatgaaatgcttagcttttgcagcatcttagtttaaagaataaattatccaagctcaagactgaggcatgtaagtgttaggttttacttcatgtgtttgagtcttctaaagaagagatggaaaaaaaatgactctgtagttaaacttgaattgccttagtagtgtagctttaagccttataaaattgctaagttaaattggccctgtgtgacttcctaatcactgtcttatacaatacccagtcagtttggtggcccagtggtgcatagataagttgagatttaatttaatcattattgcatgcaatgtttatacatagaaaggtttccacttttaatgtaagagatgattaaagtcctgctgg

SEQ ID NO: 114475 - DNA, 1056 bp, Homo sapiens
aggggcaaatattttaaatggttaaaatgtagccttgctccttctgcctcatttagtttggtccttttttaatgtcatgatcccaggatcagttccttcacggtctcctcagtacccgcgctggtttcaccagccagcgggaggatgagcacatccagtgtgcggtaaaatatccaggatgttgcggggaatacgctagtttttgggtttttttttttttaactaccaggtggaagggaaaacgtttgacccctaaagattcatggcgcttcccctagaattgagaggaagtgatttctatagactctaacagactaattctagcacgttttcctcatactgtactatttttaggagtaaaaagatttaaatgtgggatgatgttaagtttactagaccaagtgacatattttgaacaattggtaggaacccgaatgtgttttgaaaaatatctagagaaggaagattttaaaactgtgatctttcttattattagaagagtttttcttagaacaaaaacagtaacagtggctagcatttacttatttcttcactctgcattgtcttctcattgaaacttctaagcaactttttttttttttttttttttgagactgagtcgcccaggctggagtgcagtggcatgatctcagttcactgcaccctctgcctcccaattcaagcgattctcctgcctcagcctcccaagtagctgggactacatgtgtgtgccaccacgcccagctatttttttgtatttttagtagagacagggtttcactatattggccaggctggtctcaaactcctgacctcaggtgatctgcccgcctcgacctctgagtgctgggaaatacaggcgtgaaccaccacacccagccccaagcaactttttgaggcaggcattattaccatgcccattttatagatgagaaaacagagctggatccaggtaacttgtcaaagttacaccctaggaagtgttaagtcagtgcttgaacgcaagcagtctggctttgcaacctacactcttagtcattattgtctattacctcc

SEQ ID NO: 114476 - DNA, 1056 bp, Homo sapiens
cccagccgatttactgtctacttctagtggagaccaaatactttttcttttctttctttttgacttttagcttctcttactatttttgaacaccattaggaatattactggatttttgtatatacggtatattttacacagttttggtaatttttctctttggatacacaaagagaaaaattatttatcttctctttcggtatctgtggccattgggaaccccttcatctggcttctgtgtccatttatttatttatgtttaatttgtttaaacagctttattgaggtgtgatttgtataccaccaaactcatgcatcttaagtgtttgacgtctctgtcctttggcagagagacatctcttccttccttacttggtacagagtgagaggtggctgcatgtatattttttttgtcttgatcttaaataccttctttcagattatctcagacctcgagtcttggaatgatgagctttctcagcaaatgaatgacttcgacacagaagatctcacgattgcagagcagcgcctccagcaccatgcagacaaagccttgaccatgaacaacttgacttttgacgtcatccaccaagggcaagatcttctgcagtatgtcaatgaggtccaggcctctggtaagagggctcactccatctgtgtccgttgtgatttcttcatgtcgtcatggcaattcggcttatttcagtgggatgactgcaaattttgttagttcctatgataaaggtattatagatacctgttctttaaaagaacgtttgcatttttatgtaatacagtcacatttaacatggttagagtactcacccatgatattctcacatactattttaagtatcatgaactttaattctacacaatgatatgttgtatctctgtaaatgaactataaatcccaggaaaacattttcacattctttatttttttagtttatgttttaccagcagatgtcactataggttcagaaatgtattagaaacttagcaacaacctgcatactgcattattcattttacacaaattaaatgcttaccaaa

SEQ ID NO: 114477 - DNA, 1055 bp, Homo sapiens
taagtaaacgagagggcaataggtattatataggttacttgaggtcactgccacaccttactatccagaagacctcccacaatctgtggtttccactgttagaatttacttcctctgagtgtgtgtgcagttgagaagctcatggtttgaacctgatcattgtagcacaatgttattcataccttggttattatgccattcaacactgcagttaagttggaaaaagagttcgtgaaataaattagttcccccttttcaagcatttgccaatttttcagtcctaaaaatgctggaaaggaatgaaaaatatttttcttgattatcagggaattcctggtgtcagtaggttttctaaaatatggcccataatctgttttgacttgtggactaattatcaacaatccactggaccctccaccttttcatttcccatttgctactaaaaataacagaactaattaaaaagatgcagcacttgcagtcaggtaccatggaagaacatcaggctgttgcctggattttaggatgatgaaggcatcagtgcctcgtacctgccaggagcaactggactatcttgcacgcttgtatctcacccctggtggtccacaggattctctgggaagtccactgcttggagttatcctgtgtaatgtttcaggtgctgggttggatccgcaacggagagtccatgttaaatgccggacttatcacagccagctcgttacaagaggcagagcagctccagcgagagcacgagcagttccagcatgccattgaggtaagggcgctgggcctgcctgtgtgttggctctttcattcctcaggacaaacatcctgaatcccccaacatggcactgaccatgggaaccacatggggctggcttggtaaagacgactcagaggacccaaattggcaacgcttctaagtctgcagctgattacaggaaagggaaacagtgtggtgccacggtgaggtgaggatctgcatcccagccaggcagcctcactgcaaggatcccaaaggtctcggaggccagggggttcctgttgttctc

SEQ ID NO: 114478 - DNA, 1091 bp, Homo sapiens
caatagttcttgaaaacttttcactggagtccagagtttaagttgcaagtgaaaataaaaagcattcactctggccaccttttctctgcttgttcatttgcttccagcagctattatgagaaggatcaacaggaataataaacttggaacatttcaaccacttctttggctgttaagggtctttcctgctatttctcagactaagaaccctacaaccgagacccattctgggaggtcctgatcaatttcatccttcattagctaatttaaacatagatctagttgtttctcggcataaaaccttttttgctaaactgtctgctgtgcttttagaagcatcctagtgagtattaactgaaggtatttccacaaaatcatgaagaacagagtaactgtagccatcctggttcctttctagtcagtggggacactgacaaataagccttcccttttgttctctgtctctagaaaacacatcagagcgcgctgcaggtgcagcagaaggcagaagccatgctacaggccaaccactacgacatggacatgatccgggactgcgccgagaaggtggcgtctcactggcaacagctcatgctcaagatggaagatcgcctcaagctcgtcaacgcctctgtcgctttctacaaaacctcagagcaggtcaggggagaggttcccttccttgaactccactgatactttattttgagcttaatttattggacagctcaatcattgttaacatgttcatcgttattgaaacaatcagttgccagtcaagcagggaaaaggcattctggagttaaaattattcctgtgtaccttagatgtcaaaggtaataagctagaaagtagctgagaagacacctctcttcttgtcatttaaacataggacctgaagcacattagagagagacaggatatttgctttggttttgttctcgctctgaaaagtctgcctgcttttgaccctgtagttgttctccagccaggtggagcccatggctccttcttatggtcttgatcctcctgacagcatcttcatccccagagcccgactgaaagggctttccagggataccagtcggcag

SEQ ID NO: 114479 - DNA, 1025 bp, Homo sapiens
gtagagctgggagtctccaggggtggcccagtgcatgcctggcaagagacaaaaggagcctgcacgttgtgttctgaactctcaacttcagtttcattttaaatgtccgtttcatgttaatgaagtccttactaatgatcttagtttaataataaaaagattaaacaaatttataggttgatattatattgaataggttgataatttattgaataagttgaagaatataaacagggagaaaatgcaaattcaggatgatatttactgacattggctattttgttaaagtaagtaaaaaataaatagggggaaagggaaaaccagagttatctataggcaaaggatttttaaaagctcaaatagagaaaatacatcccaattttatcactataaagtattattaattttgtatacctaaggcatagttaataaaaacaaattgaaaaataataatatataggttatatcatttgagtgtaaaaacctgtaaaaccgtgtttgtgtgtgtgtgtgtaagtgtttagaaaaaggtctgggaaaacgtatactaaattgtaataggattgatgtggaaggaaaatggataaagaaactaaggcacaaagcaagtaactttgaccagggatacacagcctaagtttagttttataggaaaaaaaattgtgataatcagttagcaaatgattcatctcacacttttcaaaacaatatgattggcaaaaactttgtacattacattctactgtctgctcatctgattcatctgttagttgtcacaaaataattttgttacaccactataattctctaagttctttcagtaaaacatatttattgatgggctttttcttctggaaaaatgtgcaactcacaaaagcaaccgtttttctgcatgaataagtcttctgggccagcaagttatttgcattgataattggtttatttggctcatttcctgtagaaataagttcacccatctctcaatattgctttcatttgttggttgtgtcctgtcttttctgatt

SEQ ID NO: 114480 - DNA, 2105 bp, Homo sapiens
aataaaattatgaaatcgaattatctttatggcatatgccatatgtgtgagtaaatatggctttttgaggaaaaatataagaatctgcatattgacctgaatgttgtcccaattaaggcttatacctgcagaggctgagtccttccaagaactcacaacagttttgaggctcttttcaagtcaccattacaacctgtggggttgttgtttttcagagtctgagtatacgtcctttgtagtattttctgaagtgcctctattgttgatgacagatttcgagtttttggaaaaatctgacaattatttcaaatgtataagagtgggaaataaatgataagtgggataatatttttggttaaaaagaagtgtttctataaagtagcaagattggttatctcctgtggcccctaccctggctttgaaaacataacaggaatttttcaatcatgtagagagaggacagctactttgtattatatttatttgtccatgtttatgttttctgttactgttactgactcctcctgctcttctttgccactctctgctcctggtccccaaagctctcctttccctcggccctgaggtgctgggctctctccttttccacggctcctatcctggaggctcacacaggcaagcagggctgcagagagaccaggcatggggggcgcagcaagaagacccggcccagggtgggggtgtggtgagcactgggggagggcagggcgcaggaccaggggacagtagctgcccccagaggcacaatgagctctaaggagggccgccccaccctcccctgcagggagggatcatggcttttcctcctccacatacacacctggctggacagttttcactttttgttaatatttagatattacataatagttatgcacattatatgatccgtatttaggggcgtgtgtgtgtctgtgtgtgtgttagacatgggatcttgctctgttacccaggctggaatacataatagttatgcacattatatgatctgtatttaggggcgtgtgtgtgtctgtgtgtgtgtgagacatgggatcttgctctgttacccaggctggaatacataatagttatgcacattatatgatccgtatttaggggtgtgtgtgtgtctgtgtgtgtgttagacatgggaacttgctctgttacccaggctggaatgcagtggcaccataatggctcagtgcatcctcaaacttctgagctcaagggatcgtcttcaaactcctgagctcaagggaggctgaggtgggaggatcgcttgaggccaggagtttgagaccagcttgggcaagatgacaagatcctgtctctacaaaaagaattttttttaattagttgggcatggtggtgtgtgcgcctaaagtcccaagctatgtctgcttatttgaatattgtttgattataaaggtattaagaaaatgcctaacatcacataccacactcaaagctagatttaagatttgccatctttcacctctgctccactctgcaggccattgtgtatggccagacagcctgctcactgcccagctccaggggccatgcatgggggatgtgatgtacacatgactatttggaattgagtaacatggtggcctgctccactaataaagtgtatatgaaagaatttttccattcctgaatactccttttcctcaagtttgatgtgtggttattgaaagattgggcaatgacaggcttatttttattcttgtattttataagaaatgtctaaaattgtgagtgatatatgacctttctgatcctcagatatgtagaactgtttcttttgttgggtttattgaattggttataccaggaggaactggtagattttgaaaagaacacccctcacctttccttttcttagcaatctttttctttggtttctgactgcctttcccttaatcagaaaacacctgctttggtgtttggagatgtcctttgatttttcatcatgagctgaggctccctcacttgccttctgtcacccgatcttagaatcttctaagaaaccattttgcttttactgtatagagaattcttagctctgaaaggaaagtctttcagtgcacttgtta

SEQ ID NO: 114481 - DNA, 1034 bp, Homo sapiens
tgtatggttgtctgtgtatctctgtgaaaaataataaactatgcttaacttaatgaaagatcttttctgtgtacatacaaaatagaataattttagagagagctctcaaacagggaaacaaaatttacagtacctctatatagatgatttcctgactagtgaattttccttcacattttctgagagttaaagcaatcaacacgacacagaggagcttcatgaggaattttgttgagtgcctgctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccatgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctggggctttggtctcagtttctaccatcagccggttttcctgttcagagctcagagttggagtcaagtcgccactgtgtttgaggtttctggcagtcggattcatttgcctcacaatactttcctgttgttttttgcagcaaaccaaagagagagtgaagctattgatacagctggctgatggcttttgtgaaaaagggcatgcccatgcggcagagataaaaaaatgtgttactgctgtggataagaggtacagagatttctctctgcggatggagaagtacaggacctctttggaaaaagccctggggatttcttcagattccaacaaatcggtaaatggccttgtgcaaactgaataaattatggtcttcttcctaacgccctctctgctgatttaattaactgagttcattggctctgttattccacagagtaaaag

SEQ ID NO: 114482 - DNA, 1032 bp, Homo sapiens
tcccctttgaattagcgggtggatactgttctatttgtgattcacctctccaaaatgatcaatctaagactaatacttttagacccactctgttatttcataaatccataaaagtagatagtgaagtaagctgcaccctgactgtactcctcactgtcttcctctctttaaggttcataatggctgagctcattcaaactgaaaaggcttatgtaagagacctccgggaatgtatggatgtaagtaagttttttttttttttttttgcttgtttatttagattgagcataagcttgctattttattcttacctgttggtagtccttagaataatcacaatttttttctgtcatttttttaaatgtaaagtatgcttcagcagccggtttcatgtttctgcacttctgtagagttctaggtttgtttttcactcattacagagatgatacagcattaatcctctcattctgtttatcacatgatggcctggctaacactctctttgtatagaattgtacagcagcttcagagaaatgtgcctactaattatgactggcaactaatactcagtggtatcaggaatattggttatacttgtggagtaggttaattccaaaatttgaagctgggaataattttagagttgaaaagtataggaactcctctcaagtattaacagcaactgagggccttttttagaagggttttttatgttttgtaaaagggtccagtccttagttatactttcacttatacattaactctgtgtgtttacagatgtcagaaacagctgtttcttgaaaatatggtgattatttttgtctaatccctgtttccctctcggctagacgtacctgtgggaaatgaccagtggcgtggaagagattccacctggcattgtaaacaaagaactcatcatcttcggaaacatgcaagaaatctacgaatttcataataagtgagtggctttttctttgggagcagttacgcttgaaatccatgtgctgaagtttcatcacaagaaatgaacca

SEQ ID NO: 114483 - DNA, 1030 bp, Homo sapiens
attgtaatatatagatgtatgtttgtgtgtgtgtatatgttattatttatattcagtcatttataatatcattactatttatattcaatacattttttcacctgtaatactgtatacagaaggcataaactattaagcttcttttccccctcagtaaaacaaaaataaatgtgaatctttttatttttcctattttaatttcatgatgttacgaattttcaaaaacaacctaccagtaaagttttacaaatagtgccataacaactaggataattagaaggttaactaattgtgttctcattggagtaaacgtagatacaggtcatctgtgttttgaaagctgttgcagcggcttattcagcacaaaagagatggagctttagaacgtgatacacagagtgctttctgggtttccagaacttggtcaaatatgtgccaatacattttgattgaaggataaggtgctattgaatagtgtgcatagtttggtgcataaggttgtgaggatgttggacttgttttctgtctttacacttgtgcatggactggtgggatcatcagctcttatgtgaaagtctggggaagtagaataaacttttcagtttctatctttgagatgaagccctacctgtagatgaccctgttttaattgtcattctcctgaccattacattacacattacacatcactgcctttgttaataggaagccttctcccaggccaaagtggccttttcttgttaatatttcacatgattctaggtctttgccatcagacaaaattcagcacctgtatatggagttagaaatattttagtattaagtatttcacttaaacagtgagggcacatagcacatttaatgtttggaatcaaagccattttagaaacccttatgccccagcaaaataaactatcatcagagtgaacaggcaaccaacagaatgggaggaaatttttgcagtctagccatctgacaaagggctaacatccagaatctacaatgaacttaaacaaatttacaagaaaaa

SEQ ID NO: 114484 - DNA, 1136 bp, Homo sapiens
gttaacctcccaacaatgctagtctgcaggcatggaaactagcctcagactgtaaggagtgtgcccagaatcaccactcaaacacgttaacaggctcagctcagaacacagatctggctgatgcccagggcttccactgaagccacggagaacccatgcccaggaggcttcctctgtcttgttgcttgtccctgatgtcacacccctcgcggcacaccttgtccatacagaccgcaagtattggagtcaggctgacctctgctttttattagttgtgagtgactatagttaaaatcacatttaagaaaacaatagtgattagtcttgacaatagaaaggtaaacaaaacttagaatttgtgctaagagttgtcacaaaatgtattttatttttatattatatatcatcaatacacattttcttgactacctaaaaattgacagattttgtctggtaatgttcagcataccattttctcagctggtgaatgttattaagcattaaaatgtagaaacatgcattcatcccagtgatggtattctatgaatcctgccatgttccagggactgccctaggctcgacaacgggaagttattatgtaatttgtctagatataaaagaaatttagaagatggagttacaaatgctggaactcttctttaccctttttgttagcaagaaaaatctacagacagtaataagtagctacatcgttttgtgaaagtgatactattatgggatttttcaattggaaaagctctcctgtacttttatatcaaaatgccgttaagtgattatgtgaccattcccgcagaaatatatagttactatgaatgcaaaataagtcaggaggctaatttgttcatattcaaatttgtcctttgctttctaattctacaaaggcagtttacctttcagtgtcctcaagatgtaaggattttgttttcagcatgtagttctgctaaactggtgcttaaatttgtaaacctcgccttactctgccagaggttcttcaggagaacagtgataagctctcttgagctccccaacaaggaaggttttctgccagttgtcagttagtaggctcagtacactgcatttgtgagcagtgtttgccatgctgcttagaatcacag

SEQ ID NO: 114485 - DNA, 1156 bp, Homo sapiens
ggagaatgcatcagggggaccttgactgtgggggaggggctgaagctattgacctttctctgcatgcttccatgttctgcatatattacagagggattttgcctcttagccgttaaaattattgatgaaatactaaaagctaatgctattgataaagaaattggagaataagctgttaaaacatcatttgccctctgggaagctgtgtcattaatactgaagagaacatggtggcagcccttttgcaaccaggaaagactcattttgcagtttgttgcttgtaagattgcaaatagtcgaatcttgattgtcagatagtaggattttcacatgttggtttccttcccctgaattttttgctcgttgacctgcactggggtctccagtaagagacgctcacaggaagcgaaggatgaaaccagtcacctgtagcctaagaacacaatgtcctcattataactcacatgacagctgagatcactagtgacgttcttataacctaacatggccacaagtaaccaaaacctgtttccttggtctctgttctgcatccttctagaattttactgtcacctaattatataattgtctttttatccagacctcagagttgggtgtcacagaacatgttgaaggagacccttgcaaatttgcactgtgggtggggagaacaccaacttcagataataaaattgtccttaaggtacgttcatttgaagctgggaatgtgctgtttgaaacatttactgtggccatccatgcttgcttttccgttgttttcatattattattatttgttgttgttgtttgtgtgtgtgtgttctattcagattggtgactaccacaaaaagaatagtggaataaattcagtttggtgttctggtgatgaaacaatttgagttaaactttcacttgactcctgaaagggcaaatgaagcaaggtctttttatatttttcccattcttccagtctttgaattcattgactctataagagatgcaggaagtcagggtacaggaggaatgagatactgaccaaaaactctgattgcgcacttgacctgtttcgaaaggaaaaagtcacctggtgcgtgtttgaggacctgcgacaggaagtcgaggccaaccgtacccacagtccttacagagtcctcag

SEQ ID NO: 114486 - DNA, 1728 bp, Homo sapiens
caggcagcttgaccagaatctctgtctaggagacagaggccatcatcaaaaagtcgggcaacaagggatgaggatttagacgtggagtccaacaaaagacataggaactgcaggagcaggaggcctctgtcccctgggaagcagagacccaggcttgcctctgctcagccccacagtcctcccccttctcctgccctgtgtgtgaagaggggtgctgcccccacgactggaaagacattggcatgtgccggcctgcccatgccagccatccacatgcctctgcccgtccactctctccttttgagcctcttttcagtataagagctgttcaggcttgaaggatatgcagcgagcgagttaaacatggcccctctttgcacaccatggcatgcatcattctggcagctgggtaagaccccctccagtatcagatgttcaggctgccttgcctcaccctcgcttcagaactcagggacggtatggaactggctttacagatttgcctcttgttgcttgctattaaagttagtttcttatatgtctctgactcttactgctctgaccttctaggcaggaggaaggagcaccttcattcagttctagtgtctctacattttcacaacctcagtgcctcagtaattttttcataacaccctgatccaactttcacatttttatgtcaaatgtaaaaaacatgcctattaaggtcaaatgactatttatttgcttgcgaataataagctgttttaaggattgcaatgagtctaattactcagatcagccaagaagggtccaggatcatgatgagccgtgctcaggttcacgtggtggttttgaagctgggctagacttggaagtctgtcggacactgagaatccatggaatttatgaagaccagatttcttttatcggctatatatccttaaaatgatttgggagaggataaaaatacagcttattttaaatgaacaagaaattcaattacacaatttgtttttcaaggagataattttgtgtctgaaacaagactctgctgtgaacatcattccattgagaaatgctatcttgtggccaggtgcggtggcacacacctgtcatcacagctgctcaagaggctgaggtgggaggatcgcttgaggccagcattttaaaaccagcctgggtatcatagcaagacccagtctctttaaaaaatgccatctgttttgtggacgaagtttgctttggaagcttgcatgtcccggtgtcctttgggccggccagccttcgtgtctgatggcgccttctgctcttgctctggctgtccttcctccgtctcagcatcttggtcatgaattaaacagacgccgggcatagcaggattgaataagggttcagcaaacccttgtgctccagcagtcttatttgtgtttgtcgtttatgctgtctgccgttacctcagaggctctggggctggggcctaggcctggaggctgtgtctgtgcccccagcgagtctcttctgcattctgggctgaggcccactcacctcccttcactctcttccactcgagtgtgtagtacgtgggctcactgttgaaatcggtgtcacgtcaccattgttgatggctcagtaaatccaagttctctttccttcccattgtctcaacttgtaaaacttgtcacttttatgtatttattgacagtcttggtcacaggaagtaaacagaaatgtcaagaatgtgtatat

SEQ ID NO: 114487 - DNA, 1184 bp, Homo sapiens
aatgttgacttttctgtgggtccaccctgcttttctccaagctctccttgcttctctccaagctctctcccaagggttttcttgtccacccgaatagtttacttttccacttgactgtcttagcaactttttcaaatctgaagtattcagattccctctcccaccatctccccacttgttcacccaagaacatggctaacgcacgtgagggtctctccactgcccaccacagtttttaaaaactggtaaactccacataacaaaatgtatcatcttaaccattcttaagtctacagatcagtggcattaagtaccttcacattgttatgcagccgtcattaccattcacatctagaattcttttttccgtcttacagaactgaacctctgtgcccatggaacaaaaccctccgctctctcctcccagcccctggcactgcccctttcctttctgtctccatgagtttgactgttgtaggtgcctcatgtgagtagaaagtcatgtagtcttgtccttttgggactgtttatttcttgtagaagattccgtgttctgacttttgtcagaatttcctttctttttaaggctgaatagcatccccttgtatgcagatgccacattgagttcaacattcatctgctgatgggcacttgggttgcttctgccttttgactcttgtgaataatgctgctatgaacatggatgtacaagtaatctcttcaagtccctcctttcagtccttctgggtgtatacccagaaatgcaattgatggatcatatggtactgttgtctgaatgtttgcgtccttccaaaatccgtatgttgaaatctaaccgccaatgtgatggtattaagaggtggactgttgggtggtaattagatcatgagggcagagcccttgagaatgggattactacccttacaaaagaggcccagggagcccttttgtccttccgccatgtgagggcacagaaggcaccgtctttgaggagcaggccctctttaaatactaactctgccagcgcctggatctcagacttcccagcctcgaaaactgtcagcaataaatttctgtgctttataagttatccagtttaaggtattttattatagcagcaggaatggactaagacatatggtagttctacttttaattttttgaggctgcccactcagttttgt

SEQ ID NO: 114488 - DNA, 1026 bp, Homo sapiens
aaagatgtttccatgctagcattctgaatctggtataaattttttaaaataataataaatgtatacatgaatgaagagaaatcattcacctcctgaaataaatcagtcatatagtttaaaccactaattgcacaatttttaaaaccgttttgcctgggagagtctttttgtgccacctgcttcatttaaagacatgtttcaactttttaaaaaatctgcgtatagccccctgcccccaacgtctttggtatcctctttaacaaagcagccaaagtgatttcattttttttcaacaaatcataggaagacattagccaaaaataaatattcattatgaagaatacacttccatatgccttcttcatgtaagattagatctttcatttctaacactctgtgtttaatgtcaagaactattatgcccatgggttcaacattcatgtttcttaactgggtgagcacctctggaaggcagactcagatggacagaagggtgtgtgagcaccgtgggactgcttatttcccccagaattaactttctgtttccttacatgatggttgtctattcaggacaataataagtactttattgccttgggaataacttcccatatagagaaattaagaatcaagaacccattattttataacagggagaacttcggtatccctcagtcagcagtacacaaaataatagtctcatacgcatgctgaatttgttttgttttgttttgtttttaataatctttctttgtatgagtaatacgaatcttgggtaattttgtgaaaagaacagccatttgactttttgggaacacagaggatcagaaacatctgaaaaagccacacaactagaggagcattcagaagttcttgctttctgagcatttaaacagaccagagcccagagtgccgcagcaggctgtcgctccttgcctgcctggggcgggggctgggggaatatggggtcacatgctgcatcctcgccctcagcctccatcagagcgtgggttgtctcacagcagg

SEQ ID NO: 114489 - DNA, 1124 bp, Homo sapiens
ccttgccagcacttgcgaaagttacggttagaacgttcccttgcctagtcacctctttgaaaaaaacactgtgatgttacatgactgcgattcaaatcagacactgtctgcttcccacatgtatctcagacaggttttatttaatgtttcttgtcagaatattgtaaattcaaaaggatgactttaaataaatgtaaacaaagacaaacttgtggtctttttgtctggaattactttcacaagagatggagcttgcaggggaatttactgtctgaccagttactaatgtgagcccttgccccaccccctccttttcttaatttcttctgtaggcctcttctcggttattagtccgccccaccagctccgaaacaccgagtgcagccgagctcgtcagtgcaattgaggaactcgtgaaaagcaagatggtgaggcctcccagagaaagtctgacttttggaagctgctctgtgttgctacttgcagatggatttgcccttgtctttgtattgctctgggctgcagaatgtggctgtggcttatggcacatctcaggagtccccatgaccaccctcgggttcactgatttgaaggactcagagaactcaggaaagccattattcccacatttgcagtgtattcccatgaaaggacacagatcaaaataggcaagggaagaactgcatagggcaggtctcagggagtgcctggttcaagctgccagccatgctctcccagtggagtcaggcagacagaggattgccaaccacagcagctcacccgagccttggtgttgagtgtctgtttgggctcagacgcatatggctgactgctctgtgtggctgaccttaggtagtctcctgcccctccagagatcaagacactgtcacattgctagcatagactatttgccttggtcccaggcccccaggtaaacagacattctcatcaagcagaacattccaaggacttacaagttccctcctagaagctgggggcaaacctcactgcacataccctgcctgcagtcactgcaaatgtggtcagctccagtctgtctgaagatgtgccagggtcagtggtacccacagttagactctccgttttgttttgcaacccctgag

SEQ ID NO: 114490 - DNA, 1050 bp, Homo sapiens
aatagaaattttaagccacattttagcagcatattcaatcaactgttgtttaaaaatcagtttataaaaagaatattgttaaacccttatttaaccgattacacaaataatccaaaaagaaaagaaaatctttctgtttctaagagataaatgctgaaaacaggagatatgattctgaccaaatatttaatatttacaaactgtttaatgaaaccatttacatttatttaaacttctttaattccttagaagatttttgatctgtgaatgctgaacagtccagggaaataaaattacagcaatgaatgtaataggtatattccaagtatcagttaaggatacttttcatatcggttttttttgtttgtttttagacaaagaactggttacaagacagtgcatgtgtccattttgccctctgtgactattaatcaataagccactagttgattcagacatattccatgaaatacacttatcataactgtttaattgtagggctacatggcacttatgaaagaagatggtgttcctgatgacatgaaaggaaaagacaaaattgtgttcggcaacatccatcagatttacgactggcacagagagtacgtaaacatgcattgtgcccgatggtgtgcaaagcagccacacttgctaaaccaaggcaggccaggccaaagggaatttattctgttcatcgtattacctgtgtagcctcctggagggagctggtgcaaaggagatattgatgtacccaggagttctgcagtagcatttggtggcacggagagagtcttgtctcttcttcgtgctggtccatgtcgagagtctgtggaagggagtagctggaagcaccagcgtggagccagctgccggagctgctggcctggtcctgaccccgagccctcggcctccctgctgtacacttccattcttcatctgcacacccacattataatgtgggttttttgtgaagagtgactgagttaatacttttacctcgtgggttttttgtgaagagtgactgagttaatacttttacagagtacttag

SEQ ID NO: 114491 - DNA, 2123 bp, Homo sapiens
gcagcttgaaatctacgtaggaatgcctttttgttgtgttactgagagaataatatgataaagtagaactaaggcaccagacaggtgtggtggtacacacctgtagacccggctacttgggaggctgaggcaggaggatagcttgaggccaggagttggaggctgcagtgagcttatgattgctcctttgaatagccactacactccagcctggacaacatagtgagagcttgtctatttaaaaaaaaaaattctttcagaactaaagtgctgaaccccaatgtctggccagtgtgagtggccaaaaaggttagcttgtgtgcattgtctcattcctgtagtcccagctactcaggaggccaaagcaagaggatcacttgaggccaggagttcaagaccagcttgagtaacatagtgagaccctgtctcttaaaaaaaaaaataaaaggtcagctgctgttgtctttgtcaccattatcatgtcctctccatttcccttgcaggacttcctcaagtattccaaaaaggccagcctggatacatcagaattagaggtacatgcatcagcggctgtgggcacccaaatccccaccagcctcttttcctaatccccaagtgtctcctaacagtggtctggccctgggagggggtcaaagcagtggatgacagagtctctccagtgcatctccataagccctgcacactagagggtggggaggaagaacagaacttcatcaggtcagagggtgagcacgtcagattttccctagaggaacttgagctttcactcttctctctcccctcccacagagagctgtggaagtcatgtgcatagtacccaggcggtgcaacgacatgatgaacgtggggcggctgcaaggattcgacgtaatgcggctcttgttttttaagagagctcctctgccttcatctctttcttttgtcttggattatttctctccacatagagaaagctgatccttttcacttggttttctggcttctctcactttacctcaatctgattgatattttatttcctttttttttttttttttttttttggtgcgtttggtttgcttttttgggacttgcctgtgctcaaagcccagtgtctcatggcagaaacaagcaggaccgggctttgtctcttgggcccagtactgtaagagctgagtttcctttcctcagcacttaagaccatggttagctatggatgtagtaggacctcggaggtccccactctctcatctctgggacttgatacttcctcattagtttaagatatgtttgcatgagttgctagactattcatattacatattagctattacatatcctcaagatgaattcagaaccagaatcttcttttaaaaatttgactacggagttaaggaggcaggagaagtttttattttcttgcctactgttttgctagagaattagcattgaaagttctggtgctatggttctctctgacgcacacacagaggccgttggagggcttctgaaaactcctgtgcatgcctgatgagttcctgctggcgacccagggaccacactttgagaaccactgttctagtataaaccagacatttaaaactccacttttaatctgtgactgtaattgaggcgccagaggtctatacaaatgttggcaagaattttatttagataattattctgtttagagccaagaacagtaaaagaaaaaaaaaattaaactccataaattaataaaagaaaaatacattattccataggaggaaatctaaagaaaacagcttcagataacttagaaggcaatgttttcttctccccttccttttccccctttatttcttgttttaggggaaaatcgttgcccagggtaaactgctcttgcaggacacattcttggtcacagaccaagatgcaggacttctgcctcgctgcagagagaggcgcatcttcctctttgagcagatcgtcatattcagcgaaccacttgataaaaagaagggcttctccatgccgggattcctgtttaagaacagtatcaaggtaacgtgtgtctctgtgtgatttctctgtgccagcgcatgtacccgtcacaccgatacactgtttccttttaatgatga

SEQ ID NO: 114492 - DNA, 1037 bp, Homo sapiens
aaaatcactccagcactgtaggaatttcgtatatattttttacatatttttataaaattatttgacatattttaatcatgatatcacatacaattttataacataggttttagtgatatttgagatttgtttaatggtgtcatttactccctgggaagtaagtaaggataaatactgaggcatcatagaggggtttgggaaacaggtaatcccagacgcatatttctagttaattgttcaggctgttagttcaaactattagtttaacagccttgtattccccatgtacctgagttaagaggcattaaaaagcttcagatgttttctgaggcagtaaaaatggcagttcaactgaaaagtgcttgtttcaggattgagttaggatgaacttcactttgcacttggccagtggggatcaatgtgctttaattttttgttgtggtaaaatacacataacataaatgttccatctttaattacctagctccatgggattaagaacattcatgttttgcagccatcaccatcatctgtcttcacaactcttcatcttgcagagctaaagccctgtacccattaaacagtaactccccacttccccacccccaagcccctggcaacctccactctacttcctatccccacatttgactactctaaggacttcctgtaagtggaatcataacaatagttgtattttgagactggcatatttcacttaacataacgtcttcaaggttcatccatgtcgtattgtgtgtcggaatttctttcctcattaaggctgaaaaactgtccacatagcccacattttctttgtccattcatcggtcagtggacacatggtttgcttcctttccacctgttagctattatgaataatgtttttttttttttaaggtgagttgcctttgcctggaggaaaatgtggaaaatgatccctgtaaatttgctctgacatcgaggacgggtgacgtggtagagaccttcattttgcattcatctagtccaagtgtccggcaaacttggatccatga

SEQ ID NO: 114493 - DNA, 1034 bp, Homo sapiens
cagactttttgtgttcccttaaggccttcggctcattggatgagggccattcaccttagaaagggcacatgcctttactggacccatcaaaatgttcatcttattcagaaacaccctcacaggaatacccagaataatgtttgaacaaatatctaggcgtcctgtgacccagtcaagttacacataaaatcagttatcacaggcacctttatattttcatcctcaaactttaagagattgttggttttatctcctggttcttaaaaaaaaggaacattttctctaacagaggtcacagttcgtagaggatttcccatccccctgcacacacatacgttgaatattcagcttttctttaacgcttccaggcagcacttggtgaatgttggaaaggcataatacccacagtgtgttcatttcccctaggaagtcaacatcttggcacacagcactccgtttaaggaaaaaatctgagaaaaaagataaagacggcaaaagggaaggcaagttagagaacggttatcggaagtcacgggaaggactcagcaacaaggtatctgtgaaggtgtgttcgggggtcttcaggagtccgtgtcatcccagcatgagagaaaggatcagggagggcagagactctgcagacctgaagctgggcttgcttatgacctccctcccacccaccagccccgtgccctgcgtgtcctgtagggtcttgttaggggcactatgctggccagcacagggatgggtgcgtcctacaaggaaccaggtagacccctgcacacttccgcaggtgcacatgtggcttctaaagaatatggttaggtttgcaaatgaagcacagagactaggttctcagaagcagcgaaggtgcagagaagctatggctcaggcttccttcagtgttcctgccttaaagccaaggggaagtggctagatgtgggggtgcatatgggctctctggctgtgacagatccccttggggacaacttcagtcagctttagtcctataatcggattgcctgacacctgcg

SEQ ID NO: 114494 - DNA, 1050 bp, Homo sapiens
agcctgtagcatgagaaaaacacacatctaagcagtgtttttgtgtttgtgggtaggaagaaaaagacccacccaaattagtgtgacatgaaacttttgagtgcagtgaaaatgtggtctgttttgattgatgcccaggcaagtcagtttctgcaaatctttcaacaataattgtagccctggaatgaaaggaatacaccttaaagtagctcatttcagttaatgcttgtttgctgtttccatttcagcttctcaatcccaactacatttatgacggtgagttctgttctttttcttctagtcctagagatgattctagacctgtggggcatgtttcagagcacttgagtgtggcctctggaaatgagttttccgtggcgctctaggcgtgcatagcaggttaggtcctatcaatctgtcggggacatgtgggtgggtgtggaggaggagccagggctgatgggcctttaccgactcctttcccatgcagttcccccagaattcgtcattccattgagtgaggtcacgtgtgagacaggggagaccgttgttcttagatgtcgagtctgtggccgccccaaagcctcaattacctggaagggccctgaacacaacaccttgaacaacgatggtcactacagcatctcctacaggtgagggaggcccactcctggtgggtttcgctggctgggagcaccatcttgtcacttggcaactggaaattcctccttcacggatggatttctttggctgccttcggcactccacttcttccgtgagagcccatttcacgcctgggtgtacagctcctcatcagcacttgagctcctgccttcccttgatcctgaaggaggaggccagcgctgatggccacgtgctcagcttttctgatgcgcagtgtgttcccatctgtgccgcagtgacctgggagaggccacgctgaagattgtgggcgtgaccacggaagatgacggcatctacacgtgcatcgctgtcaatgacatgggttcagcctcatcgtcggccagcctgagggtcctaggtaagcac

SEQ ID NO: 114495 - DNA, 1054 bp, Homo sapiens
atagcttcttcagtgggaaggataggattagcagggcgcccccatggggtcatgtaggggcagactcaagctcggggcccctcgccggcaggaactccctccaggccctgtacctgatgttgtagttattgtcatttttttcttaaagaaactataaatgcctccccatacccttcctagggcaaggctgccacagcgtcccacatggccccacatgcagccttaccagcttcctcgggccgcccatgtgccatgggtgacagtgggtgtctcaggaaggcctcccacccatggctgcacagctagaacctcccccagcacatggggacgtgcttccagcccgtctttcaagaatagaaaacacatctcatggcagaagggcagacggtggggcgcagtgaggctgagcagtgtgtatggagaggaggtccactggcctcgcctggcctcagtccccgccctccctctcatcggctcatttctcaccctggtgtccttaaaagtcacactggctttggagggttgtcgtggggccgagatggggcgatgtgtgtggaagagccgagccgacatccaagccgaggcctggcctgggagcctcaggacccgggaggtctcctttctggctccagacgctggtgaccaatggccactgctcaccttccctggggagttttaacaaaactgtggcttgagtgcttgtcacaaatctcctaaaggccttcgtttctggactgacatttcagtgctttcagctgtcatttctgggaaacaaaatggtttggcctcaccatcctgttaataggatccgttttcatgacagattactcctgttctcaccggcgactccccattgctagacaggcagctgatcttcctacagatttctgttttgcaaagagagcagcataggccggtgttgagagaggtgggggccagaccacctcagtccaatcctggcttctccactctggagctgtgggaccttgggaacgtttcatgctttctctgtcctgagtttcctcgtgtatcaaatgggtacactaaggcccac

SEQ ID NO: 114496 - DNA, 1686 bp, Homo sapiens
gcttccaggcgcctcgtctgtgtgcatctcacgcccgacgtggcttctgaaacgtgcattcaacctcaaacttttgcataaaatagaatgaatcgttttgctctgatgaaatgtaggccttacttgtatataagactgttcctgccttcggtctgtcattttcccacctgcctcccctacccaccccccacccaccacctggggcttcctctgggggtccgagggtcttcccatcacatgaagacatcaggttgggtcctgccccactgcccctccccctgttcctgccccaagccgtcaatcagattgtggagcagtacacagtcagatgaaaatactgtaaatgcactcattgggggttttttggttttacttcatatcatgtgcaatgttgtggctttaacattttatgcaactatttatgaagacctctgttgtacctgtaataaatatatagaaaaagcacatacttcgtatggtgagctttatggttttgtgtgtgtgttggggttggcgggtgggtgggtagggtcgtagccctgtgccatcggttcaaagagacttttcgtgaaatttgttggttttgaggactgtaaaagtgatttcatactctgaatataaaactggataatagggtaatgttttaaaatttattatgctattattcagaatgccaaagtattattttttttcccaaaatcagtctggacatttactactttttagactttttgacgttgaactttctgtataaaaattggctgggttttgagcttttggtaagaaataaaagccgattaagcactggccgccccgcggctggtacccaatgcccgagtcactgtggcagcattcgcactggtgtggggagtcctttcaactcaaggaggctgggtttctgggcaccctcgaagttttctggatgtctttttatctttctcgtgtgaactgcactacaaaagagaccagcccgcttcccaagccagccagacacctgggtcttgagccataaactggcgtagttaagctttgcagcttccagtgtattttatttattcttttgttgggtttttgtttgtttcttcttgtaaaattgtacagaaactttttaaaagaaattggattcgaaactggatgtgtattcgtaacctcataatttttatttgtgtattgtttcttttattatttcagttaaatttttacattattttgcatgtatatttctttgtacagagaccttacatgtttacacagtatgatgtgatgtaaatattttattttgccatcagttattttaaaaaattaaacatatttgcctgatttttgtgttaggctttttatttaaattggtcactgttgaatcagaaagacagatggctgagggagagactgatgcagagacttctcgtgggcgggaggtggcagaatgtactggattgagaaccctctgtacacactcagaaatgggagttgctcagcctcctgcagactggttcacagacaccacactcgagaccctggtatgtgccagaatgtcgactgaccgtgcacagcgaggctgtagcttgtcctggttagaatagctaaggcaccctgttgcctgatgaacacagaattaagcgagggaagagctcgttcatgctggcctcagaaaagcaaaggtaatgtccagatagattcaagaaa

SEQ ID NO: 114497 - DNA, 1017 bp, Homo sapiens
tggaaaacattctcaatctatgagtgagggttccaatttgtccacatcctctctaacacttgccattttctttattgttgttgttttttgtttttatagtagccattctaatgggtgtgaagtggtatctcattgtggttttaacttgcatttctttaatgattagaggtgttgaacatctttttatgtgctccttatcaatttacataatttctttagaaaaatgtcttaattttttattattatttttacttttagagacaaggtcttagtctattgcccagaccagagtgcagtggcatgatcatagctcactgcagcctcaaactcctgggctcaagtaatccttctgcctcagccttctgagtagctggtactacaggtccctgctaccatgcctatttaaggttttttagtttccatagagacagggtcttgctatgttgaccaggctgctggctagtttttaaattcttgtttagggataggacctggctgtattgcacaagctggtctcaaactcttggcttcaagtgatcctcctatctgagctttccaagtacctaggactacagatgcatgccaccatgcctggataattttaatttttttttttggagatagggtctgactgtaccacccaaggtgacctcgaactcctggactcaagtgatcctcctgtggcagacttctgagtagctgggattacaggtttgagccaccttgcccagctatgcagggtatttgaccatccattgtctttaaaacattacgccatcattgtcgatatccataaaagttagaatttgagaaatccttatctttccacttccttcttgcattgtatctaagcatacactgctgcttattcacacgaagcccctgaataactacaaaaacgttaataccaaaatcagtcagcgtcaacttttctaatagaggacagtatatagacgtcaataggtgccaatgacagcacttaactgagcacttaaaaagggccagcctctacatgtt

SEQ ID NO: 114498 - DNA, 1724 bp, Homo sapiens
aaacaactaattgttggtgttaacaaaatggattccactgagccaccctacagccagaagagatatgaggaaattgttaaggaagtcagcacttacattaagaaaattggctacaaccccgacacagtagcatttgtgccaatttctggttggaatggtaacaacatgctggagccaagtgctaacatgccttggttcaagggatggaaagtcacccgtaaggatggcaatgccagtggaaccatgctgcttgaggctctggactgcatcctaccaccaactcgtccaactgacaagcccttgcgcctgcctctccaggatgtctacaaaattggtggtattggtagtgttcctgttggccgagtggagactggtattctcaaacccggtatggtggtcacctttgctccagtcaacgttacaacagaagtaaaatctgtcgaaatgcaccatgaagctttgggtgaagctcttcctggggacagtgtgggcttccatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgctggctatgcccctgtattggattgccacacggctcatattgcatgcaagtttgctgagctgaaggaaaagattgatcgccgttctggtaaaaagctggaagatggccctaaattcttgaagtccggtgatgctgccattgttgatatggttcctggcaagcccatgtgtgctgagagcttctcagactatccacctttgggtcgctttgctgttcgtgatatgagacacacagttgcggtgggtgtcatcaaagcagtggacaagaaggctgctggagctggcaaggtcaccaactctgcccagaaagctcagatggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcatgtggcagttttaagttattagtttttaaaatcagtactttttaatggaaacaacttgaccaaaaatttgtcacagaattttgagacccattaaaaaagtttaatgagaaaaaaaaagaaaaaaggaatgatgtaaaattatagttttttatgaatgataatgaatttctagtgtgttagattctatcggaaataagtcatgattattttaaaatatctataatacaatggaaattatatcctttaaaactaagtttctcatagaaaattttattttattttatatataatgtacatattttgggggacatgtgataatacattcatatagtaaagatcaacttagtgtaattgggatgtccatcaccttaaatatttgttttttttaatgctagaaacattcaaattctcttttagctattttggactgtacaatatagattattgtaactactgatctatcaaacactatgtctcatttcttccatcaaactatatatttttacccattaatcaacatttcttcatccctcctcctccctactcttctcaacctctagtaatcaccagtctactctcatgagat

SEQ ID NO: 114499 - DNA, 1010 bp, Homo sapiens
aggctgcagtgagtcccatagcctgaaggtggttggtgtgaggacgtgctgtgggcatggcctgctgtggaatgtcctggccgtggttggagtcctgcaaggcagattgtgctttggctcaaccaaaagcaccatttcactccagcagccctcctcagggtggtactttctaagttcctgacttctagatttaggtcctccatcctaagcccacatcacagatttgcagaattaattctggaaacaaagttaggttttatagactttgtggtttcttacagcttggattgtgtggtggatttcttggaatgttaacacttctttatctctttgtttctcgatgttgtagttaccagaaaaactcataagcaaatacaactggatcaagcaatggaaacttggactgaaatttgatgggaagaatgaggacctggttgataaaattaaagagtcccttactctgctgaggaagaaggtttggaacctgtagtgtcctgtctgataagggtgaagctctcgttcttgcttgccccagaagaccagtttttagtcttcactcagtggattttcaaatgctcttggctgatttttaggcaaaatggttttaaatgaattcaaactcttcccacgagggctttagtaaaatgggaagtaccaacattatatattcttagagcagatgccatgtactagggtatcaaataatgaagtgtttgactttcttaaaaggaaaccttaacaaatatagtctttgttccaagtcatatttatgtttcaagaatataatttggttcctatttcttatatcattagtaatttattaaattctttccaattatgctcatgttttaagattctgcccatatttatcagacttattttctttctccgtgattttccagttagtagatttagtaacttgtctttagaaaactgtcctgagagtttttctgaaacagaattgtagggagaacttggtcttctgattcctattgatttggtctttgaaa

SEQ ID NO: 114500 - DNA, 1146 bp, Homo sapiens
gtcttgtgaaattgctatttctgctttattaggtttttctactataattagaccctcatttttgggaatgcttgagtggtgccaatttgcaataaggttaaaattactaataatctgagccagcattactaacacttctatgccaggctccacactaaaatttcatgtgttatttaattctcacaactatgaaggtggtgtcgctgtggtcatcactgttttttaggtgaggaaactaaggccaggagctcagttaaatgccctgcaaaaaccaccacagctgctctgtggtgaagccttgattccatcccgactgactttagagccatgtccatgattggcaacttggtctagtttggaaaatatgagatacagacaagcaagtaccagccttcagcccaaatattagagggaattgtatgcagtcattaccattgaattcactcttgtatttaaaatccataatggtgtttgagaggggcactagttattgttgattcataaggaatggtatttatgttggcgtctcttattctcattcactgtaacttaaaagcacatatatttataggttttcttttttaaagagtttgtctatattcactgaatacctaacacattactttattcttaatccggagtcaagagtttcctgaatggatttattcatttgaagttcatatatatttttgaggttagagggataagtttagtaaattattattcaggagcccctacgcccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaa

SEQ ID NO: 114501 - DNA, 2173 bp, Homo sapiens
tttgtcttctttctaaccctaggcagccactaatctactttctgtctcaatggatttgcctgtgctggacatttcatatgaatggaatcatataatatgtggtcttttgtttatggcttatttgatttagcataatgtttttaagatttcatccatattgcaccatgtattagtacttcattcctttttattgataagtaatatcccattgtatggatggatcacattttattcatctgttcaatagtttgatgggtatttggattgtttccactttttagttctgtgaataaccctgctatgaacattcatgtataattttttttatgtgaacatatgtttgtagttctcttgggtatacaccgaggagtggaattgctttaacattttgaggaactgccagactgtttgcaaagcagctgcaccattttacattctcaccagcaatgtatcagtgtcctgtttcaccatatcttcaccaacacttctgactttttgtattggggtgaagttcatataatttaaaattgaccattttaaagtgtacatctcattgacatttagtacactgctggtgaccaccacctatatgaagttctaaaacatgtcacccccaaagaaaatcctgtgctcattaagcagccattccccattatcatctttttggttatagtcattctagtgggtgtgaagtactatctcattgtagttggatttggattttgatttccctaatgactcacaacgttgagcatcttttcatgtgctttcttggtcacttgtatatcttctttggagagaggtgtctgttcagatcctttgcctaatttttaagctggttatttggttttttgttttgttaattgttgtaaaagttctttattctggatacaggatccttatcagacatatgatccattcttgattatctgctttttttttttttttatttaaatcgaaaaggattggggctgggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttgga

SEQ ID NO: 114502 - DNA, 1454 bp, Homo sapiens
aggcagagataccagggggcagggcttggtgggactccactggcggtggggggttgaggaggaggtttccaggtgggaggtaaatgtgcctcctctagatggagatgtcaggggaaagcatgggttggggacgtagatttgccccttgtggtattaagagtaccactccccacagggacagtgaatgatgctggggccagcgcagctctgtattgtctttaaggcaaccaggaactgaacatacttgacccgatagctaggcctgaccctatgccatggacatggcatagcccatgcactgtggccgggagcacagctctgaagccttcaaaaacatggttggtgttagaggtagtaagagagaagcacagtggaggtaggactgagatctgggattttaacaaaaggagcagtaaggaaggaaataggcaatcccaagcgagtctgtaggatgcctagaatcttactgactacaggtatgtaatgaaacactttctacaatgtcttatgaggagctaaaaaaaattagagccatctttctttgaggttaaaacatgatgctttaagaaaagagtgatgctggccgggcgtggtggctcacgcctgtaatcccagcactttgggaggcagaggttggcagatcacaaggtcaggagatcaagaccatcctagccaacatggtgaaaccccgtctctactaaacatacaaaaattagctgggcgtggtgacgtgtgcctatagtcccagctactcgggaggctgagggaggagaatcgctcgaacccgggaggcagaggttgcaatgagccgagattgcgccactgcactccagcctgggcaatagagggagactccgtctcaaaaaaaaaaaaaaaaaaaaaaaaaagtgataaaagagtaatgcttttcccataaagactaagaagagtaagaatctcttagatgtgggcaggaggattgtcgggctctgtccttctcaggctcaccaaacacttgcttcattttggcattcccatttgagaaggtgtatagagaagttggagagggttcagagaagcattttcattactgaagttttgggaagtaaaagtaattttaatgcagaataaaatctgaagaaataggttatatttaagtaagacagggagtttagagaaatttcccagtggttagaagttttagcaaccaagggaaagggcaaaatgttaatctctcaggtaaatttgattaaaagggaaactgtaatcaggattaggaaaccaagtaactttgcggtgagtaaacagatgcatggttagaataaaaaaaaatcaagaaactaaaagcaatctcagttgtatgccaagtgtttaagctttacttaaagtaaaattagagtatgaaacctatttgacaatatatgaatacaaatccataaaccctgaaacaaagcatatataaatgctcttaccaa

SEQ ID NO: 114503 - DNA, 1074 bp, Homo sapiens
tttatttgtattttagagacggggttttgctctgttgctcaggctggattccaactcctgtgcttaagcgatcctcctgcctcagcctcccaagtagctgggactacagatgcacaccactgtgcccagctaaatattttaatgtgattggtttcaacagtttatacccacagttttgatgtgaaactgacaaacctatgggctgacagccacagcccatgtagaggaatgactctaagcacacttaattttgtttaaaaaaaaaaaaatctagatcactgctaatgttcagatctgaaatgaagaatgaggtgattttattcttccattgtaggatctcatacgacgttctaaatcctagatcataaacagaatgttagatcaggaaggggccttagcaataatggctcaagcctcccattggacagatgagcaaggtgaggccaagaagcgtgagtgatatggaagcctccagcttgaatacacttcttaaatgaatgagtgtcggcatggaacagaatcacgtgtgtggctcttgtccactttcccgaagccctttgattaactccttggccctactagctttagacagttccctgatcagtacatcattaagcaaccaaaatatctcattaaatccaaggagcagcgtatttgccactgcaaggcttgtggatgtggcagccctggggtaagggacctgctgcacggtgacatgaccatcgctgtggggtgctgggtgattggtgttgatgtgtaccctgtactcctttgttacgcaagggtggtttgaacttagctttcagtagctgtttcattcaaaccgtgggtccctgcatgttcatggccccacacttcagggaaccagcatctacccggttgtaatgttcccctaatgttccccaactccagaggcgccatttcttgccctggcttatagctagggaacattgcctctaaatcttatagtgagaatttccatgaggttgtacagtgagtggtacaaccatttttagctggtctgtccccttctttaacctaaggaaaccacttaaactcttggagagagaaagg

SEQ ID NO: 114504 - DNA, 2038 bp, Homo sapiens
cagtcagtcaggatgacacttcggcatcatctcttccctctcccatcgtattttgttcccttttttttgttttgttttggtaatgaaagaggccttgatttaaaggtttcgtgtcaattctctagcatactgggtatgctcacactgacggggggacctagtgaatggtctttactgttgctatgtaaaaacaaacgaaacaactgacttcatacccctgcctcacgaaaacccaaaagacacagctgcctcacggttgacgttgtgtcctcctcccctggacaatctcctcttggaaccaaaggactgcagctgtgccatcgcgcctcggtcaccctgcacagcaggccacagactctcctgtcccccttcatcgctcttaagaatcaacaggttaaaactcggcttcctttgatttgcttcccagtcacatggccgtacaaagagatggagccccggtggcctcttaaatttcccttccgccacggagttcgaaaccatctactccacacatgcaggaggcgggtggcacgctgcagcccggagtccccgttcacactgaggaacggagacctgtgaccacagcaggctgacagatggacagaatctcccgtagaaaggtttggtttgaaatgccccgggggcagcaaactgacatggttgaatgatagcatttcactctgcgttctcctagatctgagcaagctgtcagttctcacccccaccgtgtatatacatgagctaacttttttaaattgtcacaaaagcgcatctccagattccagaccctgccgcatgacttttcctgaaggcttgcttttccctcgcctttcctgaaggtcgcattagagcgagtcacatggagcatcctaactttgcattttagtttttacagtgaactgaagctttaagtctcatccagcattctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaaaaaaaaaatattttaaagatataaatatatgctgtatatgttatgtaatttattttaggctataatacatttcctattttcgcattttcaataaaatgtctctaatacaatacggtgattgcttgtgtgctcaacatacctgcagttgaaacgtattgtatcaatgaacattgtaccttattggcagcagttttataaagtccgtcatttgcatttgaatgtaaggctcagtaaatgacagaactatttttcattatgggtaactggggaataaatgggtcactggagtaggaatagaagtgcaagctggaaaggcaaaaatgagaaagaaaaaggcaggccctttgtgtctaccgttttcagtgctgtgtgatcatattgttcctcacagcaaaaaagaatgcaagggcataatgttagctgtgaacatgccagggttgcattcacattcctgggtacccagtgctgatggggtgtgcccacgtggggacatgtccttggcgtgcttcctcagagtggcttttcctccattaatacatatatgagtactgaaaaattaagttgcatagctgctttgcagtggtttcagaggcagatctgagaagattaaaaaaaaatctcaatgtatcagctttttttaaaggacattactagaaaattaaacagtattttttaacatgtgtgactttcatgcttctggggttggagcttaaagatccaaactgagaaagcaggccgggcatggtggctcatgcctgtaatcccaacactttgggaggccaaggagggtggatcac

SEQ ID NO: 114505 - DNA, 1050 bp, Homo sapiens
ctgcgtggttctgtacacatccaagtactttcaggtctttttttattgcttgttaaagctgtaaaaattatatgaataaacatgtccacgtggaactggctgagctgtttggcactctccttaacccttgccccaaagcacactggttctgaacgggtctgctcacccactcagaaataaatgacccactcttggaggagccacatctgctctgccgtgggggtcccctgggtacagacatggctaatggaccagggcctctgtggtcagaagagagtcaagcaagcaggtggcagatctgggaccagcatgcccaccacccagtcaggccggttgtccctctttcgtaactctccaaggattgtgccacacctgatctgctcatttcacctgcttacactttttcctcacaaccctgtttgatgtctttctccccagctctgtttcgtgatgttttggacacccaacgtgtctgagaaaatcttgatagacatcatcggagtggactttgcctttgcagaactctgtgttgttcctttgcggatcttctccttcttcccagttccaggtaaagaaaaacagaatgaaggaagcattcctgtttatcctcatgcctaattaaatctttctttggaaatgtttgcaattatgtcaccaacacaaatgtaaaatttcactgtggcttagaaagatgcaaaaacattagccagtaggttaaaagttcaagaaatgaatcaaacagtataactttttattttatttatttatttatttatttattggagacagagtttcattccgtcacccaggctggaatgcagtagcacaatgtcggctcactgcaacctctgcctcccgggttcaagcacttctcctgttcagcctcccaagtagctgggactacaggcacccaccaccatacccaactaatttttgtatttttagtagagacggggtttcaccatgttgtccaggctggtcttgaactcctggcctcaagtgctcctcctcggcaaagtgctgggattacaggcgtgagccactgcacct

SEQ ID NO: 114506 - DNA, 1048 bp, Homo sapiens
cttacttcctgtaggttctaaggcacagagccagcccagactgtaaggcagtcatcccttagctcaattctttacagttttactgctatgggacatattgggggcccaatataaagcaaagctggaagcagggatgatccatgtatttgtggggatgggatatggacagggaaatagtgttccaactccatgctgagtgttgttttgaattgtaatgtgaagttgccaccataccagggctatgactgtgtacgatgtctcacccttgtaggctagtagctttgcagtgggaaaagatgacagggccacttgtccagggcattcaggtaataaagtccctgagctccaagttgctagatctaaggaagtattttttccttcatgtcaaagatggggtgtgagtactgtcatcaagcagtaggattaaatgagatagtacctctgccatttttgaaaaccagtggaatatactttgccagatgcagaaaatacgtaggggaatggctctattgcacttacaaagcaaaacatatttataatagatctccagtgtattttttttttaatatttcaacatgacatagtaaatagagcttggctaattccatgaaacttagtgtactcagagcctaaaagaatgttatattctaaaattttagtgttctgttcttaattcattttagaatgtattcagttttattgtagagaagaatcacttgcattttaagaaaaggagataaatatttgatgaaactgtcaagtttttaacaggatcttccaaagttatgttgttggattttaaaattcaggtttttaaagttagcaccaagttttccaagtcagctctgtaaggattgtaactcacagtagccatgtccccagcccacctcttcagtgctgctcacttccaccctgtccctttcctactccgagaggcacccccaactcttgatggattgtgactacgataaactctgacgctgagccctgattcccttcctttctcaaacaactttaatttttcctggacttaataattgtcaattat

SEQ ID NO: 114507 - DNA, 1017 bp, Homo sapiens
ggaaagtgagtctgtgtcagattgcacaaggccttgaatgcccagtggaatttatagtccatttggtagagaggagaggagccctggaggacactgagcagggccatggcatttagggagatgccgatggtggccaggcacagggtctgctgggaccaggagcggggtgcatggggcaggagcaggcttcagagccaaagccccaggactgggcaagatgggctgcccaggcagaggggaggtgactgagttggaagagctgcagggcattgagtcgagaattcactcaggttaatgatcctgtacagggacctgacagctgcccgagagacactcaacatgacagccgcctggcaaactgtcacttgaaacctctaattcagacacatcagataaaacaaaagcaagatgctcttcaagatcccccggtgggttcagccaaggataagccgggcccattcatgactgtggttttctttccccagaataaccccagcaacaaactggtgagcacgagcaacacagtcacggcagcccacatcaagaagttcaccttcgtctgcatggctctgtcactcacggtaaggacagaggctctctctgcctcttctctctgtttggtttttgtaaaggggcaagttgctattttaaagggggaaatcttattttccacaatgtaatgtgatgctggattaattagcaatctcttcaatacactttcttcttcaaatgtgaacgattgttattcaaggaggcccttgagtctaggaataaaggacccacttcaggcatttcttgggacttctcaaatgctgcagaaaggaagaggttgcctttaattggaatagtacacttgtcttgctgaaaaatttctagcccactttttaaacatcgaaagtcaactttacaaccacccctgtctcttttccaaatttaatccgcgttacttcagtgttccccagtaaaatttcctttccagttatgtttgtgctgacatagcttacttacgtggccatc

SEQ ID NO: 114508 - DNA, 1007 bp, Homo sapiens
tctgccacctcttcctgttgcaggcagtggcgattttgacagccacataccctgtgggtcacatgccatacggctggttgacggaaatccgtgctgtgtatcctgctttcgacaaggtgagaacccgtgcggtgtcgtgtctgaaacatgcttttgaaatgacttcttgatagacagggctctctgatgagggacactttgttgcttctcagtcctgcttccctttgtaaggttaatgtgacgttgggggcattgaaggaatattttcctcagaaaataacaggggcaagttgaagcttacctttgacgctgatcccaggatgcttttccaaagtgatcagcctgtggttactttcaggttattcccattgagaaatgatttgtttgcgaaagggaaaataaacttcccccaaaatcaatttatgggattttatttctgtggtttgtttctttaaacgaatgctttgctgaccccataccagatggctaaggtgtaggcaggaagccgtgcgtggctgtctttctgtgggctggcctacctacatgctcaggttggccacaggcaagacctgggtccagtgttttgatattgcagacgtattccagtggaaagcctgttgacagctgctctgtctccccagccatgggagtcacataacccttctgccctgtaacttgtgacccagtcagcactgtcctgctgtcattcaattaaagtctattttatagcgttatcatttaaacctatagactttttttaatactctaaaacaaatggctggtgaaacatactccaaaaatagtctacagtgttttaaaatgatacacaggaaggaagcaaacagactgctacttcttaccgtgaagggcacctgttgtgccttgaatgtctgcagaactagcagccactgccagcatcacactgtcttatcccagccagagcctgtgaagtgaggagaggaagcctcctggccaggggtgtccacagcgctcagctctggcagaat

SEQ ID NO: 114509 - DNA, 1009 bp, Homo sapiens
tatgaagaaatcattctcccaaatccctgactgtaggaacttagtctaatttataaatcataagaattcaatctatttttccactaaaattgttcatgcgctatccttggtagaagaagaaaggacagaaagccagggctgagtgccagggctcagagaattggacccaacagaaagtgggatgtaggccttcttctcagaccgcgtggaaaggtagctgaatccacttcctggttccttctaaatgtggggaagtgacctgtgaatggcagccctgcatggtaacaacagaggattataagaacattgaagaataattcctaagagccttccctctaggacagagtgacagacttcatagtgataggccacgcagagggcacccaggcaagtaaacagtgaccctaagacatgccgaaaggtactaggtatgactttatgctcatctcatgtgcatgctctttaaaaataaaggtcaaaacccctttatttaaatttaaattcttacaacccatattctagcaagattatacatactgttattacagggcattcccttttctcattcatttagcaaatatttattgaggtctctatgtgatgtaacggtgctggcaaaaccaggtcgaatgcagagtgtactgcacagtgaatgaatataaatcacacatcagttacacacgccagaaggggactctgaggagctctgattgacacacagaccatatttacctgagctatgacatctgagattgaggcacatcccaccaggaaactgtatttgtgttttaagagaatgccagcatgggtccatgcctgccagaaagaaaagaatttggcatgagatacaccttcaggattatgctgtttctggttgttgagatttactgggcattcctgaaatacactttataccccctcaaagccttagcagcccaggtctgataaatctttggttggtaaaattactgtaacttgatctggtggctggctccatgttagagtttac

SEQ ID NO: 114510 - DNA, 1099 bp, Homo sapiens
tgatataaactgttagactcgttttcagaatgtctcttgccattatgtcaattcagcctgcaaacaaaatttaacatttttgtttttttaaaaaaatcaacttttaaccaaaacttcttagaattatttttcaatattagcataaaatatttgttggtgttttgctattattttaactgcagtggtcaggtatctccttcacaaaaagaaactcaaactgaagctgatgtagatgaaaatgaaaaccaatcacctttatccaattacatgagatgcaccctataagctacttagtgtttctatagaaacgtgatctgctgaatttcatcttagaggtatgattccccagagaagagatgacatttctaatgcttgtgggtttttttcccccttcccaggccttgaaccggggcattgctgctgtcaaggaggatgcagtcgagatgctggccagctacgggctggcgtactccctcatgaagttcttcacgggtcccatgagtgacttcaaaaatgtgggcctggtgtttgtgaacagcaagagagacaggaccaaagccgtcctgtgtatggtggtggcaggggccatcgctgccgtctttcacacactgataggtgaggccgccgaccgccactgacgaatctagctttggcaatttcttattccttttcattgatttaaatgtatttattgagataagtggtttcttcactaattatcaaatgtttcttatgaaattttcaggggatagaaggaaagcgcttgtgctcctagcttaagacaataatgtgttttttctggggagctgtagttttgtgtctctgattcccaaagtgaaaagcagtgatttcattagtaggcgattacatctaggaataacatttggtaaggccaataaaatagcaggtgctttcgttagagatatgtgtgcgtcattgtactgggtcattaaatcttaagaataaaaatagaatgacttatttagaattaatgcttattagcagtgagaacaaatgacagattgttctatttattaatttgttctaggatcttattctattttattcaaagacaagactaaatgctcttgtgatagca

SEQ ID NO: 114511 - DNA, 1057 bp, Homo sapiens
ataaaatcatgggccagacatggtggctcacgtctgtaatcccagcactttgggaggccgagctgggtggattacctgaggtcaggagttcaagaccggcctggccaacgtggcaaaacctcatctctactaaaaatacaaaaattagctgggcgtggtggcacatgcctgtagtcccagctacttggcaggctgaggcgggagaatcacttgaacccaggaggcggaggttgcagtgagctgagattgtgccactgcactccagcctagccaacagagttagactgtctcaaaaaaaacagaacaaaacaaaatcatgtttctcatatggaaacagcttttcaaattcttccacaaaaaagggtgtccagttgaaagctgatactgttccctaaaatagcaagagattattatgtgaaatgctgaaagttgcatttttgactttcagtaagatgaatacttcctttacttgcctcatcctagactagaaaaaacaatgatacctaagagccaggtaattattttgtctcgttcagaaccagcctgggctgccatctatctaatccttttgataaaagacaactcctccgtctacagcttcaatgatctcattatacttacgatgacatcaaggaaactgaccattgtagtagacgaaatctagttttaaaatgtgccttacaccctaagtcgtcagaaaatgtacatgtgtggacccgtggaaaagtcagacgtacatgtgcaggcacagttacctgtgggaagagcttcttccaaagacatggagaatcagcaatttcggattttggtcctctcaaggagcctgggttcctgtaattttccactgttattgttctgttggtctgagttttgaaaagtggcttgggttaaattggatcatttgtcttcccggtagttttccagccatgctttattttcccagggatctatacagctctaaatgagactccctcactctgtttagctagagcttcagccaagaacttcacgcccacacatgaggttgtggttcagggggagcagcagtcaaacggaa

SEQ ID NO: 114512 - DNA, 1053 bp, Homo sapiens
gggtcatcaagaaaaaaatctactaccaagcagggagatagtaggtagggagagttggttaaaagactcccaggatcccagacgtaaacctgtattccagattgttgtttctggagttggtggtgctgtttcaaaatctggacagaatcttgagatgttaactaagcagtatcatttgagaaccatctctctttgtaagtataaaaaattaggaaatgtagtaaagctgtgagattgaggtggggaataagcattcttaaatggcacaggaagctttggggtttaaatacactacaactttcatggtagcaatcctttcttgtcaggccttctaccatcttgaattgaggttaaatttagctgggtgaataagcttcatgtttcatgagagatcaggagaattcaaagagggtcttatgacactaagtctaccctttcatgatggagcatattttcatattaagaggtcatacaggaaaatgctttttgttttctcctgacatattgaagacaccaacaggagaaaggtgagttagccaaacatcgttgtaccgtgcttggttgtttgtccctattcttaatggaagctcctctccaggtgtgggaggtgactgaaaacaccactgttgtattttggacttgcccaatgttgtcttggggttttcaggaagcactaaatatggacagcaccacacagagcagtcactttgactcctgaagggaccaggttccgtttgactgctgctccccctgaaccacaacctcatgtgtgggcgtgaagttcttggctgaagctctagctaaacagagtgagggagtctcatttagagctgtatagatccctgggaaaataaagcatggctggaaaactaccgggaagacaaatgatccaatttaacccaagccacttttcaaaactcagaccaacagaacaataacagtggaaaattacaggaacccaggctccttgagaggaccaaaatccgaaattgctgattctccatgtctttggaagaagctcttcccacaggtaactgtgcctgcacatgtacg

SEQ ID NO: 114513 - DNA, 1379 bp, Homo sapiens
gaaatcaagatcaaccatgaaggaaaagtaaacagggcccgttatatgccccagaacccttgtatcatcacaacaaagactccttccagtgatattcttgtctttgactatacaaaacatccttctaaaccagatccttctggagaatgcaacccagacttgcgtctccgtggacatcagaaggaaggctatgggctttcttggaacctaaatctcagtgggcacttacttagtgcttcagatgaccacaccatctgcctgtgggacatcagtgccgttccaaaggagggaaaagtggtagatgcgaagaccatctttacagggcatacggcaatagtagaagatgtttcctggcatctactctgtgagtctctgtttgggtcagttgctgatgatcagaaactgatgatttgggatactcgttcaaacaatacttccaaaccaagccactcagttgacactcacactgctgaagtgaactgcctttctttcagtccttatagtgagttcattcttgccacaggatcagctgacaagactgttgccttgtgggatctgagaaatctgaaacttaagttgcattcctttgagtcacataaggatgaaatattccaggttcagtggtcacctcacaatgagactattttagcttccagtggtactgatcacagaccgaatgtctaggatttaagtaaaattggagaggaacaatccccagaagatgcagaagacaggccaccagagttgttgtttattcatggtggtcacactgccaagatacctgatttctcctggaatcccagtgaaccttgagtgatgtgttctgtatcggaagacaatatcatgcaagtgtggcaaatggcagagaacatttataatgatgaagaccctgaaggaagcatggatccagaaggacaagggtcctaaatatgtctttacttcttgtgattttagactccccttttttcttctcaaccccgagagtgatttaacactggttctgagacagattttattcagctatccctctatataataggtaccaccgataatgctattagcccaaacagtgggtgttttctaaatattaatggggggcttgattcaacaaagctacagagttatgttgaaattttcttcaggaattttctagtaacccaggtctaaagtagctacagaaaggggaatattatgtgtgattatttttcttcttatgctatatccccaagttttttggactcatttaagtaaaggctagagtgagtaaggagaatagagccaaatgaggtaggtgtctgagccatgaagtataaatactgaaagatgtcacttttattcaggaaataggggagattcaagtcatatagattcctactcga

SEQ ID NO: 114514 - DNA, 1048 bp, Homo sapiens
attagattgtgcccaccagattaagggtgggtctgccttccccagcccactgactcaaatgttcatctctttcagcaacaccctcgcagacacatcaaaaatcagtactttgtatccttcaatccaattaagttgacactcagtattaaccgtcacagcaagaaaaggtagagtcaaaccttggtcatctctagctacctcaagctgccatacaaatacattgagaatcacgtcgttggaggaccttagaggccatcagactcacacaagacgtcccagtgattactctaatatcccaaagccagatgtgccagagaaagaaccaaatcctatgcctggggattccccatccagtctcaccctgtttgaaatgccagtgagcgctgatagagtctttatttctctgttcaaaaaacatagaaagtatccatttcctcaactctaggtgtaaacctagcaagagtataccttaattagagaagtcagcaggggtttcacaacattttattctattttcagcccctgtgagactccaacaacagttttcagtccatcactgacaatcacattatttttacagaagaaacaaagtaagcgtaaagtagacacagactctcccagcctattacctgccaatcagtcatggactttgacacagtcattcattcattctgccgttcaacactacttatttggggcctagaattgttctgggtgcagggagcacaaaggaaagaggatgcctgcatacctggaactttcagttgtcaactgagggacacaagtgacccattatggtgtggtgggagggctgctccgaagacggaggcgcagagctggggacatacattgcagaccaggtttcagatgggcactcactgtgtgacctggggtgagtaatgaaattctctctgcctccgttccttcgtctctgtagaaaaggagaactagctgggcatggtggctcacatctataatcccagcactttgggaggctgaagcgggtggatcacctgaggtcagaagttcgagaccagcctggccaaca

SEQ ID NO: 114515 - DNA, 1041 bp, Homo sapiens
cagtgctttctttagttagcaggctacttttcagccaaaggctgtttttactgtatcaagctttttcccctgaaaatgtggaagttgtgcttagtgaatgtttatgttttggtttagtatgggcagtgaagatggtacattaatgccatttcaaatgcttcaaagcccttacagcaagtataaaccataattaccaaaaacggtcagtgttaattcataaccggaacatgtcacagagtctttgtctgatcggattttcctccctccgatctggaatacgaactattttatgtcattccattttcagagtaaaagagctgttactgtaattctaagtgagatgataacatactatgtcttcctggccaatttaaacggttgttgtcaaccagatggccctcattttgaagaagctatgacctttgggtttattagtgttgattggagagggaagttttgctagattattaccctcaagggattggtaatagaggcatgttctcagaattaacttggaatgtatctacaaactcacacatgtatcatttatatgatgtcgggctttaataaggtcttggcatgttttgaagtttaataactgaaatttttttttttttttaagacagggtctcattctgtcacccaggctggagtacagtggtatgatcaggtctcactgcaacctccatctcccaagctcaagcaatcctcccacctgagcccctgtgaggtgctgggactacagtgtcaccaccacccccagctaatttgtttgtatttctggtagagacaggttttatcatgtcgcccaggctggtctcgaattcctgggcttaagagatccgcctgccttggcctcccagagtgctgggattacaggcataagccactgcacctggctgtaataacttaaatttttcttatggtagaaactgacaaaaattctctcctttaccaaactttagttaagctcccctgagccttcttcttaaccttctgtgcctctccctcctggtctgcctttagcaagaattcttccaa

SEQ ID NO: 114516 - DNA, 1036 bp, Homo sapiens
ttttgtttcagttttataaaaacatagggaacaattagaccatccgtctgtctgttgctaacaggtgataatctcttgccttttacctctagatctcaaagcattttccactgtgcaaagttagaatattctttatcacatttgttcttcaaagttattttcactgagttgagaaagtgatattgctcaccttttggggcgtgtaaccagagctgttggaggtgggaggctactgatatgccccctgacaggccaagcagaagtcaggggccaggcagaaaatagaagtatcagggctaactccttgggctgttacagtggtaatttaatagggactttgggcttgggacctcagcaccaccttgggaaccaggagtgttggcagtcgctcctgtcagctgatgaaatgatctcacaaactgcagaactgttcattttatttattactggtactgtttggaaattacttcttattttgtattatgattaacatacagctattcgcattctatgaaccaatattgagggtaccctttgattctatgggacattgagctgttgtgttttagaattcgtgaccatgaacattccttcctaatttaaatgcaacttaattttaacattaaaaaagaaaccgcttttttatatctctattattggaaaaaatcacccagccgttgttgccctttatgcttctagtccagttttggtttttattttcaaacgagaatacatcgtatgcagcagacatgtcatttctaggctagatctgcttgattaacttgactaattttttttccaaaaaaatctgaaaaataaatcacttttaattttttcctatttacatttcatcagagactattttttttccttctttcaaggaaggatggccctgctgggaacagattgtttcagcctctatggctgtggagataaaatgtcatggagatgggtttttgtctgcagtcacagctatctgagggctctgcagactcttggttggggtaaggtattcttacataccacagtgggtttc

SEQ ID NO: 114517 - DNA, 1917 bp, Homo sapiens
tctacttaaaaacaaaaacaaacaaacaacaaaaacaactataaaaatcagccaggcatggtggtgggtgcctggcgcctgtaatcccagctactcaggaggctgaggcaggagaattacttgaactcaggaggtggaggttgcagtgagctgagattgcaccactgcactcccacctgggcaacagagactccgtctcaaaaacaaacaaaaaaacaaacaaacaacaacaaaaagtttcctcttcttttcttttctttcttcttcttttttttaataccataatgcagttctttacgcctataccatggaatgaaaccatcagcaatatgtcttctaataagaatctcaccacatggaaaatttacttgtgaaaatatatttaatggcctggactctagacatacaattggaaaatatcagcttattaaaataaagctcatccccttgcactatatccaaatcagagggagaagaacaagctagaaaacaactttgcccaagtcataggtacatatctttaaggtctgaattactcaagagaatttcttacatggtaacattcagaagaagcaatttctggctggctgcagtggctcacgcctgtaatcccaacactttgggaggccaaggcaggcagatcacgaggtcagcagatcaagaacagcctggccaacatggtgaaactcgtctctattaaaaatacaaaaattagccaggcgtggtggtgggcacctgtaatcccagctactcgggaggctgaggcagtagaatcgcttgaacctgggaggtagagcttgcagtgagcccaagactgcgcctttgcactccagcctgggcgacagagagagactctgtctcaaaaaaaaaaaaaaaaaaaaaaaaagcaatttcaaagcatggacctctactgcagtttttgttaatctatgactcttactgtccattgtaatgaagagtacaagagaatccagaaaggcttacccagaaatacttattttgctgtacagatgcctgaagtccccctgttctccttcttcaagcttgatggtcaaatttctagaataattcatcaaacaatcaaaagctgaatgtgctacacagttaagattcagcttctactgaaaaatgtcaaagttctacaaataatacaggttctgagatatgaaagaaaaaagtgtcaaatctttactttataaataaactaccaaatgcttaggaagaatgcatttgggcgagttgcctgttctcgtgcagcaaaccaacagaaatgcctgacatatgatctagaattcacttctgccaggctagggctgcccaaccacaacacatcttgagtgtcttaagaatcagtctttgagaaaacctcctcacaaaatcattacataaaaagatttgttgcacatttcctgcgttttatttagacaggtacctgagaccaatataatctgtcctccccatcctcaggataaatagaagacataaaacatgaataccttctgtgttttcatcagtttataatctcataactgaataataatttcagcaagcaaaacatccacctagcctctaaaatgaccattctcaatattagcaaattaaccatttcatataaacccagggaattatcaatattctatttctgattctggttttgcaatttctggattgggcaagaggaagagtcacttatcttttgtctgtatgagagatggaggcatgaattgatgtgaagaaagtccagtgttttaccttggaaagcacctcactagaggatatactaaaatcagcacaacagactgaacacatacctatggacgactacgaagcaagaatttttatgtgaaggtagtaagcaaaattgttacatagacgtccttctgtgtatttgaggctgcctttcaaaatcatcctctt

SEQ ID NO: 114518 - DNA, 1024 bp, Homo sapiens
ggtaattaaaatttaatttatccgttcttggaaacttacttcctccaactccttcttcagcacttttaaataaatctattagaatttgttttaaattctcatactgtgttttctaggtgacttgaatggttctataactccgttacttactgaatgtaatctgtttattttgacttcccctctacccttaggaccatgaactagcaatttaataattgacttcggttattgagttttttgaaaaggatgctgcttgtttataatccagaaatgttttttaaccctcactgcagctattttgggagcttataaaaaatcgcagtggtggaaagcatatttatttgcacatggagaactgtcagaattcccagagacaataaaatttttgtctgtggcagcaactttttaatagcttttaagtatttttgttatgtttttagtttttaaattatgtcctactttgtaaagataactgcttaaggaatgatttcttagtatgacttttcagaccagaaaatatatatatataaaccacctgtatttggaggttattgattaaaaattgcttttcttagaagggggctgccaggaaatttcactgtaattttgagtagagctgtgtgcactgctggtattatgagctgttgagaaataccatcaagaattgaatattttgctgggccagaacattttcccaaaaaattttagggtaaaagcaaagtatgtcttgtaatttattagtctttgttcctgaaagttcattcatcttccttatctttcttaataatttaatttggtgatgaaaaagattcatatatgggaaatactccatggtttggtaactgcttttccttaattagcacggtgaatatgtaggttgaggaaaacactgttttcaattctgtgccttagttgagcaagtgtttcaaaatttgctgcaggataataagttttgggtgaaaattggaccctgtgatcaagtaaatctgaacagtgctaagctgactacattgaagatggtttc

SEQ ID NO: 114519 - DNA, 1047 bp, Homo sapiens
ttcttatactgaagacgaaagaaaggaatctctgtgggtttttttttttttttaactgataagactttgagttgaggctagaagcatctagcctcagcttggcagaatatattatgataccatttctttgaagagatcaagtaagacattgagccaaaactctgtctgtgcgtgtgtgtctgtatgtattcaagttatgaagttttaacttatcgatgttagcatttttacttgtcttcgctactcttgatattaaagattataatgaaagaacataatctttccagaaataaaaaattagtttacatattctgaatttggcacttaggtttaaatccaaggattcaagtcaggatgtgaagattgtgagtgctgtggtcgctatggctgcatacatacatcactacctcgtatgtcccatgttttactttgaagactctccccgccattaagctaacatggcacaaggctcagcttgctaaaagtgaggtaagggtctattggataactgggtcaaaatcactttaaggatctttgctgagatttttacgaatagtttttcacttgggttgttgttcgaagggagtgtaatgtcatttaacattaacaaataatcaagtcttcaggtctttgccttcacgtggatagcgagtcggttccttggccaacatacgcacaccttaggggctgggagggacttggctgggttttttcctgggcacacctgcagtttgtatacactggcagaaaaattcacaccacggagtgttttgttatgctcattaagtgatttattgaaaaaaataaaccatttctaaaccctcctttatcagaaagtgtgcagagtcgtctgccaaacaaaataatccagctggaattaagcaaagctcccctcaggactgggtatttgtgttacagcttgtcccatcctctgcctcctctctggcgcccccaagcaggcgtggggtcccccaggggctgccactcacgtgtgccccagcagggttttgccgcttcaggcccacactgagaaggacatacataccc

SEQ ID NO: 114520 - DNA, 1262 bp, Homo sapiens
gaggtcgcaccattgcactttagcctgggtgacagagcgagacttcatctaaaaaaaaaaacaaaataaatgttatattttatgttatgtctattttatcatgatttaaaaaataagtataaaatattatcacatattttatgcattaattatttttccttggagctcttaagaggcctaagttttttcttttgttttttaaataaaactttgtcagctcttcattcctctacccatttttttgctcagttctacctaatgattgtaaaatctgtcctctcagtagtgacaattagtatcctcatacatattagtcatatatatccccgctcaaaactttcagacatgtgttgtaggctgaaggagaaaagaccatgattaaggtgttagcctgtcaagttataaaaaaccaaatggcatagtatagtaaagcagctgtgatttttttgtctgaggcgccactcagaaatatcctgttttcccgttcattttccctttccatagatgcccttgcagtcaccttccaggatgccccttggctgtctttaggtgtcagaaccttccactttcctactgactgtgaagggcatgtaaatgcctgggcatcattagaaagccagggagagctcatttaacctgatgtgtcagtagaattttgaagcagataatttgaaaatgtgtaataatactcgctaaatcagatcatttgtcatttctagaaaccaccttatgaagcaaattcataagcatccacttttgcttgaaacaggcagctaagtaaaccattagaacaactgtcacaaatcaagaaaatgcacaactcaatatactttggatcccaaatctcatatggtaaaatccagattctaaacatcagaatttggtagagctctgaatccagaaaagaataatgtgtgtttttttatttttccatgttcaacagtcaccttcctcctagaaaaatgcagcacaaacaacttaatttggttttgtcctagggcaaaatggaaaatggtggacacttctaccctgctggaatactatagctttccttcttaaaaatctttaaactatatcttgaatacagaaagaggaaaaaataaactgttcttaaaaagtgctatggaaattccttgccctggccagacacttcacttgttgaggatagaagagcattggatctcttcatgagcaaacccagcatgttcagagaggcgtggtaaggatgagagcaaatgttatcttccatcctttataaggca

SEQ ID NO: 114521 - DNA, 1121 bp, Homo sapiens
accacacttggggagtactaagcatgaggcagagtgaaacaaatcactgccactcagagaatgaagttttttctctctgcaaccaagtgtcttatttgctctacggtgaatgggaacttgactccaggtcaaatcttgtggatgatgcaggaacacggtttttcccttttatccctctctccttcgaggaagagaaaaatgtggtgtccactaaaaaaatatgatatcctggtttctacagtagttcatgcttatatttacataccttatatgcaaaatgtgtgcccactgtgtatgaatggtactgtctgggctctgtcgttaaagtgagtcgagatttctttattgtaacccttaagttatccttactgcttcttttccatcctccctcacccagagaataactcaagagcgagcacacactgaggaggtaagtggaaggttgttagggcgaggtaataggagagaaacgcatgttaagcttgagtcttctcccttcttgctcaggttctatattctgaccagggtctgttagtctgccctggttttggcattgcctagttcactttttctgctactttcagataggctcttttttttttttttttttttcgctaatcccctgatagttgtttgggagaagggctcattagttggggtctggtgcattataaaaaatgagagctggccaggcgtggtggctcacacctgtaatcccagcgctttgggaggccgaggcaggcagattgcctgaggtcaagagttcaagatcagcctgaccaacatggcgaagtgccatctctactaaaaatgcaaaaattagccaggtgtggtggcatacgcctgtagtcccagctactcaggaggctgacacaggagacccacttgaatccatgaggcggaggttgcagtgagccaaaattgtgccattgcactctggcctgggcaacagaacgagtctcttctcaaaaaaaaaaaaaaaaaaagagaaccctggtggctctgcaaaggtctcgtttgttagggagctgagtggcccaggagatgggctgctgctgctgagttgtaggcaattagcaatgtctgaatgttctaattgcttaatcactcctgggcatcta

SEQ ID NO: 114522 - DNA, 1047 bp, Homo sapiens
gtgatgtcttcaaatctcagcatggtggtttcaggcacaggacagatggaagaaagacggttctggactcgttattcatccaagctagactcttaacatatatactcgttaaataaagagatcaaacaatatccatttttgttttttgccagaataacaaaatagaggcattattggaaagcgtgtttctgtcaacaccattaatctggatgtggaagggtcagataccttattaaagtcctctttgaaagttcagttgtaggaaaagggccttttttttttttttcttgcacgcttaggtaaacaggaataaaagagcaggaagaagttgataatatgatagcttggtaagtaatttctcccctgagggaaacatttttaagtagaaagttgataccaaccctatggctccaatcctcccgaaagatgctcccagaaacttgggagttctctgagaccaagacaatgagcttgttatgcacaaagaaaagaggagtggggagaaacaggaaaggcagaaataactctcaaactcaaaacaaacgtgaaaaattcttcaagtctgaggagtgtgctgccaagcaaatcccgaatctacagctccgcatgtaccactgcagagcagatagtcacagacagtgaaaggggctcgtctttaaatagccacctgtgaccaccttccagttgcaattacagatcaagaaaatagaaggttctccctgaccgctgttgtttctccagatctctgacttgtagctaaaacaccctaataaaaatctgaatagccaccatcagtacttagcaaagtgagagcaaggctgaagcctcagaaggctgcagtttagatagaaacagcattcatgtctttctttaggtgaaggacctcttctaagtgacagtttgcttcttttgagccagtagccaagaaatttggcaaaagcactaaaacactgcattttgctagaaacaccttaggccaaaagtagggtcagagaaacttggcaagtgaaacaattgtgcttttagaaaataagcatgcctattcac

SEQ ID NO: 114523 - DNA, 1027 bp, Homo sapiens
tcttagtcggcctaggaaatccagctagtcctgtctctcaacagaatctcggtccatcgccaggctggagtgtagtggcacagtctcagctcactgcaacctctgcctcctgggttcaggtgattctcctgcctcagcctcccgagtagctggaattacaggtgcaagccaccacacccggctaattttatttttagtagagctggggtttcaccacgttggccaggctggtctcaaactcctgacctcaagttatccgcccacctcagcttcccaaagtgttgggattacaggcgtgagccactgcacctggcccagagtataaaactttgaaaacaaatttaaaattctaatcttttcctgtcattttcctagtgtctcgtaagaagccatggttatttgaaagcatatggtcttcccatattgagtaggagaaaatctctttatcctaagattgtcagagagactgggtccatatctataggcacaaaataaatagatctttactgtgccaatccatatgctttgtgctttggcagcctgagcagtagattgtcattcagctgacgtggccccatgcagtttttactaatccagaggacagctagaaggaccaggcctgcccagaccaggctcacaggaatcctgatggaagcctgaatgtgccctccttctcgacggcgacactttgtctgctgggcagccctgggaccttgctccttgtctttgctgcaacatgcaggttccggcgatttccgagtggaacctttctcccacagtcaggactcaatatagtcaggatgcactagcacagctgtttctcagagccacatcctcagcctccacagcaaaggagactttatttccaaaccagtaacagcccctttttcccccttagtaatctctgtgtttttactggctacataagcattcactttgaggtgccaacttttctctctttcttttccccaatatggatgaaaataataaatgaaaaattttgctctcattaaccagccactgtgtc

SEQ ID NO: 114524 - DNA, 1024 bp, Homo sapiens
aaagagtggggctgtccccaggggatatgagatcccactgaccacttttcttttcctcctctgaggtgaacccatcttccttctgagccccgaatggcacttctgtgcagagcttctcttggagcacagaggaaggcggagtccagtcttggtgttacagagaactgcacacacaggcagtgagaggcagagccgcagatagcctgggatcaaaggccccagcctgcagccagccttccttttctctgggtgttggtgtcctaaacctcctgcttgtcccctttgagaatcatgcactgttggaacagagagtgaggcttcctggcagcattgtgtgggtcgtagcacagcctcagtaggattccatgtcataggcaggttccgcagtcctcctggaattctcttcttatatacactgctcttttcctccttaaaccttcataacatcaccacgcctttgcctgcccccactgccctctcctaaactaatgggagcacctcacagttccttatctgtactgcagagcaagactttcttctaatctaatcatcaggagaaaaaaaaaaactcgatgagggctctctgggctttaatcgtttgtgccttctggcagacgtcgcagtttctctgcctttcagcaccttttcacaaatcaggtctgtttcaaagatttttcctgcttccaagcattcattagtttcagattagattgctcagcttgcctttgtaaagggttcctttcctctccacagcagccagctccaggagagggagagagtgcatcacggcattcaccctgcctttccaggaggtgccatagtaggactgttggcactgccacactctgtccccatcttaccgtgaaccccggaggggggctgaggtgtgattccagcctactgtcctggcttctggcttccagactcagcacacagtagggacttcagagggcttgaaggaaatcagcggctgaatgcctgaaaatataagctttcaaatgcagtttgcttaaggttagtacag

SEQ ID NO: 114525 - DNA, 1071 bp, Homo sapiens
tgatgcacactcccgggggtaccttgacacggtttggcggacaggagggtgggtgtgaaacagatctgcttgggtggaattaatgggtgtgatgggaatgaattctcctgggtgaggctagatcttctgcaggatcccacaggatacctattctctgctggcatcatgaacccaggacagcttgagtgggccgggatggtaaggtaaaaggaagatactgtgcattcttccagttgcacgtgaaagacatttttgggggacgggcaatagaaagttgtgcctgtaacttgatataatttaaagtatagtagtggccagttgtctgctgctagggacacacgtaaggcagtttaaaatgtttttgaactaatttacactccaggtgacaaaataatctgtaccacaaacccccacaacacaagcttacctatataacaaaccagcacatgtacccctgaacttaaaagttaaatttttaaaaattaatgtttttgcatcaaaaataactcatttctgtatggttagagaaaggcttgttctgattgtcactatcagtagctgcttggactttaaaatttctgttctctgccctgtaatttgttgtgacctaatcatgtgctatgcaccaggctaatttccaggggccttgctgcttccatatcatgtttccttttccttaattagcccttaaggagcattccatttctttcttttttttgagagacaagatctcactgtcacccaggctggagtgcagtggcacaatcactgctcactgcagccttgaactcctgggctcaagtgatcctcctgccttggcctcccaggtagctgggactacaggcatgtgtcaccactcatggataatttttaaagtttttgtagagacagggtcctgctatgttgtccaggctagtttcaaactcctgggctcaagcagtcctcccaccttagcctctgaaagtgctggaattataggtgtgtgccactgcacccagccccaaattctatttttaagtgtgttatagctatgttttctagtgaggataaaattttaaaacacctaactgt

SEQ ID NO: 114526 - DNA, 1334 bp, Homo sapiens
ttaattgtattgtagttacagataccattcattttcatttttaaaagaaggaaaagtatcaaaaagaaaataagaatatcttatgcaagcccaccacctagaaatctgtatcttattttagtgcataatcttcttatctcttttctgtgcatatattttattttattttatttatttatttatttatttatttatttatttatttatttattgagatggattctcactctgttgcccaggctggagtgcagtggcccgatctcggctcactgcaacccccgcctcctgtgtttaagcgattttcctgcctcagcctcccgagtagctgggactacaggcattacccaccatgcctggctaatttttgtatttttagtagagacggggtttcgccatgctggccaggcttatctcaaactcctgaccttgtgatccgcacccccttggcctcccaaagtgttaggattacaggcgagagccaccacatctggcactatgcgtatattttaaaacaatattgtaacctttccctactttttatcgtaggcaatttttcttgattttaaatattcatctaaaatttgatgaattgggagctacgctgtaaggatataaagacataagaatgatacaaaggactttgggggctctgggggaagggtgggaggcgggtgagggataaaagactacacattgggtacagtgtacactgcttaggtgacaggtgcaccaaaccatgtaagcaaaaaccacctgtactccaaaaattattgaaataaaaattaaaattagaaaaaagtgaaataaaatgtgatgattaatgctcctagcttccatcacatggctattccatcatttatttaaccaattatctgtagttaatgttcaaactattttattcctattgtaaataatgctatgcaacatattgtacagaaatctttgtacacatctgattatttctttggattaatattaccggtcacaatgtgccccttttccaggcttctgcagagcggccccacacccctgtatagacagttgttccagctttccttagagatgctgggtctggatatgcctgtgttcctgatcctggcacatggtgggtgttccctcccttgaagctattttattgccctgtgactttgagaatctgcattttagttctctccagccacaccatgttgaactccttcacattatttgttttattaaaagtattgtttaatgctgagagatctattaagtttttttttctttttcttttttttgagatggagtctctgttgcccaggctggagtgcagtggcgcgatctccactcactgcaac

SEQ ID NO: 114527 - DNA, 1066 bp, Homo sapiens
cctgacctcaagtgatccacctgccttggcctcccaaagtgctgggattacaggtgtgagctaccatgctcagccccaaaagtactcttaaagtccatccagggaaggaaagtaacttggttatttgtcagggcaaaggttggggacaatatttattcctctagataaaatgttatcaaaagacagtctacatctggttcagggtccctagggacagactgaccagctttgtccctagttcgggggaggatgttttggtttaagttagtttgcaggtcctagctggtttttagatcagtaatgacatttttcagaggcactgaaaggtgggctgtcgataagaatctacagtctcctcaataagatgggctgacatcactgtccccagcctgggggacagaggaggggctgtacgtgtgtggctgtgtactctggagcatgaggaggtgacaggcactgccacacaccacacccactaggctatctcacccaggcagaaatatgccagtgaggacctctggctccaggctggggagaaatccaaaaacagagcagagtcctcagatagggagtttcaaagatggcttcaaaagtgaggttgaggcttcttaggacattttgtcatcctgattaaatggctggaaagcagaatgtctgctgacaggttaatgaggattttcctagtgagccagatgaaccaggaaccaggaggggcagaggtcagctttgtggttatcagcttctgaggacgtgagaaggaaaggtggcttattctgtgcatgtcccaaagaggaatattatgtgcttggagtcttggaggttcagtcatcctgtgcgagcatttatgttgtgagaactagttacttcaggttactgcctttcattcaaattatagtgagtccacattagtaagcttttcagaacccttgcttcacttaaaaaatatatgtaggccgggcacggtggctcatgcctgccagcactttgggaggcctaggtgggcagatcacttgagctcaggagttcaaggccagcctgaccaacatggtgaaactccatctccact

SEQ ID NO: 114528 - DNA, 1078 bp, Homo sapiens
ggtgtgcagcttgtcaagggtgacttttccagcaccccattccctccctccctcccctcaattattcagcagacttttccagccctctctggaaaatgttaaaaagactggatggtgtgaagcttcacctatggaagggtttttagtgcacggcagtattatgtaatttgcgattatgtaaacctcagctctaattaaaatgtagtttctagtagcttaagtgctgggtttttatttacccatggctggtggtaatggtgacggtggggagattctgttttataatgcgtccaagttgatttcccaggtacttccatttttaaacatttgtttcgtagtccaggtaaggattaggggtatcccgaatgtgtcctgataagccggtcttgaccatttatttctagtttgggatttcttttttttccttttccttttctttttttttctttctttctttctttcttttttttttttcatggaccactaaagaaggggagcacatttttgtttggggtcgccttctcgtccttgtttcttttcacgttttctccatgtggcgtcattgaaaatctagcgctgcaagctctccagcgatggggcattggcaccctgcactttgcatgtggggaccgttttggcagggccaccagcgggatgcagctgcgttctaaggccggggagaggatttggtgatggggaggcagtgacatgccaccctgatgggcaggtgtcccaagtggccagagcgtgtgacgagcggcactcctgtattgtggtactgtctttcttctttccttttaagtcaagagacttaaacggatatttatctagaatatgcacctattttgatgcagtactcattgtaaaagtaaaacagctttcaggaggcagttacaaatcggagatttgtgtgactccttcgtttgacgaatatctgtttggatttgtctttctgtgctcaaaacttttgaataattgcaactctgtaagctctctaatatgtagcccacattgtaagctactttttactttgaattttgttggtgataggtgttcacaatatggcatattctctaga

SEQ ID NO: 114529 - DNA, 1034 bp, Homo sapiens
aatgtggtgtgagagcaagagaagagtcagggaagtcatctaagtttttggctggagctcaaactaggggtaccatttcctaacatgagtgcccgagggaggagctggtctggaaatggaaatcaagcatttggagtggatgtactgcctttgtgctgctctgtagacatcaggtagagatgtcatagacagagctgagtgcctaaactagtctggagctcagaggggaggctcgagattgagatttaggagccatcagcagaaatgtggtccctgaggtcagaggcctggatgaccaacaaaggagggagaagatgtgaggtccaagaaccaacttctcagtactccaagcttcacacataggaaagggacagatgctgaggggagttgaaggagggaaggaaaccagaagagagtgcttattttgacagcaaatggagcaagtgcactaataaactcagtatcatgagtactgagaattgaccacagggtttagcaatgtggatttcattagtctcaaaaccttatgtggtagacattgttattttcctcatttttctttctttctttttctttctcttttttttttttttttttgagatggagtctctctctgttgcccaggctggagtatagtggcgtgatctcagctccctgcaacctccacctcctgggttcaaattctcctgcctcaggctcccaagtagctgggattacaagtgcctaccagcacgcctggctatttttttttttttgtatttttagtagagacggggtttcaccgtgttggctaggctggtttcgaactcctgacctcaagtgatctgcccgcctcgccctcccaaagtgctaggattacaggcatgagccaccgcacccggccattttcctcatttttcagagtagaaagccaagactcagagagacttaagtaacttgcctggatggaaaacagtatggaggcgcctcaaaaaattaaaaatagaactaccatatgatccagcatccccactaccgggtatctatccagagga

SEQ ID NO: 114530 - DNA, 1076 bp, Homo sapiens
ttttcccttgaaggaggcttggaaaactcatttatatcactaagctgttgggagatagctggtggctggaatgaaaatcatgtcacaaatggcttctgggacatatttaacaggctcaggtagctgagatggtgtgattggtagctgagatggtgtgatgggtgacaaggaaccatggagattttgattgttgccaaataaaaataggccaaaggatagacttctggaaggcgctgttgggaaggtgctattgaggcacccaaaacttaggcctgaaaagagccaaggagaactgcaggctgtgtcatcttcttttcttccacagatgcaaagatggggactctgagaactcgggtcatctcttgccaagctgctgaatagccagaggtagacccaggttctttgcaaacttccttatttacatagccatcaaactgctttaaacctttgtatttctaaaactgacttaacaagttaaaacaagttcagatctctttgtggcaacccaagttctcccaaactcttggctgaaaatgccttgctcattccgggactgcccaaaggtaatgagacctctgtcatctcatccctcacttgatcctgactccagtgtgagtcctgactccactgggccatgggcctgcccactcgccttatttctgacctcccctttggagcagctgaaacagttcaagacttgacttaaacagtagcatatgaacaaatgttgaaatctaaatctgggcttttggccatgcaaaacagggtgggagttattattttttgccaatttgaagtaaatgaaaatccactttttttggattgggcgaatgaggcaaaaaacctcctattaggaagatccttccttttgcccctcattgtttgtgttgtactcagccctgccacagaattgtcatgttacaacatgacaagggctttattagagaaatcactgcctgtgtaggcccctgttggtttgtgcccatgggtttgtgttctttacatgtcccttgctttctcagaacgtgtacttgacccggagcatctacgttgccatggaactcctttactttagc

SEQ ID NO: 114531 - DNA, 1083 bp, Homo sapiens
tctgctgtcatccatgaaagatgtgacttgctcctccttgccttctgccatgatcatgaggcctccccagccacgtggaactgtgagtctgttaaccctattcttcttcccagtctcgggtgtgtctttattagcagtgtgaaaacagactaatacagacatatacaaaactcaagtttctcatttgagaaaatggagataaaatgcttctcttgcaagttattgcaaggatttgaatataatacatgtaagggctactagattactgccagacacatggaaaatgctcaatgaacattattcttaataagttacaaatttaagtttgttgaagtactttaggtcagcaggtagaaggatctggaagctggggccgagggaacacagacaatgctgggttgctgagttctattgttcttgcttccttggccagctctgtgctgcttgttcttttcacccagctgtagactgtagaaaggtcttttccgtaattgaggcaggggcagttatcctaggatatttagaaaaaggcttatttttccttggattgcatttcacaatgtcttaaggaacctctgtgcatgtgcttgtctggagtggtaaagattgttgtattagtctatattcatttcctagcactgccataacaaagtataataccacacgttgggtagcttaagacaatagcaacttattgttttgtggcaatagagtctagaaatcagaaatcaaggtggcagcagccgtcttccctttgaggatctgtagggaagggtcctttcttgcgtttctcagcctcttttggttcccgacagtccttggcattctttggcttgcagctgcgtcactccagtccctgtgtccttcatcacatggcattctccctgcatgtctgtgtttctgcaactcttcttctcttttaaggacagcagttatagaattgagggtccactctgctgcaggataatctcatcttaactaatgacatctgcaatgaccctgtctccaaataaggtcacattctgaggtactgggggttagggctttgtttttttttgtttttttttttgagggagtcttgct

SEQ ID NO: 114532 - DNA, 1092 bp, Homo sapiens
tgacttatgtaaattgtagcctgtatagtagaatcaaatgcagttaggaaagttggctaaattgatacaataaaaatggaaatgagaaagatctcattcataataatattggaaaaaaagtcatgaaatacctaggaatgaatttgctgagaaagactctctgaagagaactataaaattatattgaaggacataaaacaaaacccaaatagatggagagacagaccacgttcctggataggaaaacttaatgttataaaaatgtcacttattttgaaattaacatataaatttaatgcagttccaatcagaatttaagtctttttttcttttggaatacatgaagtgattataaagtatatatggaagaataaacacatgaaaattgcccagaaaatgttgccctactttagtaggcaactttagtaggctgtttgccctactttagtaggctgtttgccctacttgatgttaaaatcttatataaaactactttaaacaagaaaacatagtaccggcctgcagtaaacaaataattctatagaacaaatcgagataatttagcatataattaatgaggccattataagtcagtgaataaattattcattattcagttaatgaaattgagagaactggctgtacttttggaagagattaaaattttatttccagcctggcacagtggctcactcctgtaatcccagcactttgggaggccaagacaggtggatcacctgagctcatgagttcgagaccagcctggccaacatggtgaaaccaacactgtctctactaaaaatacaaaaattatctggctgtggtggttggtgcctataatcccaggtgttggggaggctgaggcaggagaattgcttgaacccagaaggcgaagtttgtagtgagccgagatcacggcattgcactccagcttgggcgacaagagtgaaactttgtctaaattaaaaaaaaaaaaatgtaatggacatttaaaatatttgctgactagggagcaacttttgaatcccttcatatgcttggagaattctccactttataaattctgcctaaggtggaagccggaaatccact

SEQ ID NO: 114533 - DNA, 1077 bp, Homo sapiens
taagacaatatgaggggtggtttcctcccctaccttcactgggacttcttgccactgccatgtgaaggaaatgtttgcttccccgtccatcctgacttttaagtttcctgaggcttcccaagtcatgctgaagtgtgaatcagttaaacctctttcctttataaattacacagtctcggatatgtgtttattagcagtgggagaacggactgatacactgagttacccttataaaaagttaaatggcaaattattaactgggagaagataattataatccaaataacaaacagtgaaaacaactaaagaagaaaaaatatgcaaatgatctaaacaggcaatgcagtgaaggaaaaaaaaatgcaagtagaaagctacataacctcccagataattagaaaaacaataattaaaaaaaagttttaacaaagttgctgaaactaaaaatatcattagtttcagggcttgtgtgaaggtaggaaaataactggtcttacagtgtgttggtggacatgtacaggcttagggccctgtgacctgataatactctacaattaaaacgtgactattcattgatttattagtttcattcataaggacttatctaaaaaataaaaacaaaaacatggggatttaaagatacacaaatgcatccacacataaatacaaacaaggatatttatcacagccctctctggaatagaaaacatctggaaacaactcaagtgaccatcagaaggagaatgatggtgtaaggagtataatgcccacggttgaattctaaagcactgttaaaatagggctgtctgtatcagctttaaagtattttctagatatattattaaaggaaaacatccaatgacaatgtcgtcaccatataaaagattatatgtataatctaagcaaagttaatattatagaagatatacaccaaattgctaatagtgcttatattgtggaggagagattgaatgtgggagggagaaactataaactttatttcagatatttctttatcgtttacatttggcacttttacttttgtaaaccaaatgactatgaaaaatgcatgatagt

SEQ ID NO: 114534 - DNA, 1307 bp, Homo sapiens
agaacagccgagtaaggttttgatttacaggaacagctcagcaagggccttgtagagagcttcatgcctgctataaaaatgtgattagctataaaacagagagctttaacaagagcatttaagcataggcaacagacctgctcaaaaataaacaaaaacagatattgctgcctgagtgtctaacccaacttcataaagatcaggattaggagaatttttttaggcttgtgatataattaataactttttacttttagagtcaaaagaaaggaaaaggaaagatgaccttgaactttgcaaatgacttcagtctgcctctcctctaagcctctctcttcagcttgtgcagttctaaagcatgaataggaatcctcccccaaaacagctccctgtgtcagaccctccctggacaccaaggatggaaggaaatagaagccagcaggcgtccagggcctcaggaggggaaagtgtttaaagctccaagtctcccagccccctgccctgggcagtccctcactgcttgctctgtgacaagtctgcactaataaccctgcactgggaaggtctgtggccagagcctcacccagttcccatcgacagtccttttgaaaacaagtgccccttctaagttagtctgaagaggtccattggctggatatggaaaaaggaactaaaatgctgcacatctgttaatcactggggtaatttcttagtgattagtcacaacagccgtgatctatggatttctccctgtgtgtcagtcaccatgcagaggactttatacggattatctctgtatcttccaacaaactctctgaagtaggctttattatctccattttatagtggggagagagcatacccagaaagattatcatacaacacatgaaagttagagttgggattcaaccctggcctgtctgaatccagagatcaagcttttaacccctatgccaagaaagtggttgtactgaaaaaacactcaggttcgagagctgagttctcctgtttctagctgcagttgctttctctgttctgtgaaataccaggtgtacgttcctcctttgcttaggcctgatgcagttacagtgaagaattttcaaaaaattcgtatcttcgcaaaagaggcatgtccactgagtctgcaggccaaacatgaggttccctttgctactttttgttacttcttttcctttgtgtctttcttgcttatccttgtcctgctgaatacatctggccgaaagctcttcctttctgggagtgaaacagtgctttactggaatacgtatggcatggtgtggttaact

SEQ ID NO: 114535 - DNA, 1083 bp, Homo sapiens
ctaacttccctatcatcaaaacacatacaacaactttacccttacctttttgttggcattcatgataccctgtcttataggtttatattggtgaaggtcttgtctgctataaattagagagataaacatgtcagtagcatgattttttgttagtaaaacttttagatgattgtagatttaaatcttaataaaatctttggatttctgagtcaaagaatgtgtaatttcaaatacaagaaattaacatttcttaattgtcttctgagacagcagtgcacaataatgaaaacaggttaagattcagagggtagggttggagaaagaagaattaggaaatgtggagaaagtttggtggatgataaaaagtctctattatgttacacttagctgtacttgattttgttctttaaatacctacactgtccttgggaaacaaattatttaacatattgtgataggctgaataatgtgctgcccaaagtaactctgtcctaattcctagaatctgtgactatgttgttacatggcaaaaggggctttgcagatttgattatgttatggaccttgagatggggagaatattctggattgtttgggtggacccaatgtgatatggtttggaagtgtgtcctggcctaaatctcctgttgaattgtaatccccagtgttagaggaggggtttggtgggagttgagtggatcatgggggcaaattttcttcttgctgttctcctaatagtgagcgagctctcatgaaacctggttgtttaaaactgtgtggcaccttccccttctctctcttcctccttctctggccatgtaagatgtgcctgcttcccctttgccttcttccatgactgtgagattcctgaggcctccacaggcatgcttccagtacagcctgtagcactgtgatccaatgaaacctcttttctttataaattacccagtctcaggtagttctttatagcactatgagaacagactacacaaggtaatgtggagtgtacaatgtggaatacacaatgtacaatatggaatacacaaggtaatcacaagggtccttgtaagagagaggcagggc

SEQ ID NO: 114536 - DNA, 1081 bp, Homo sapiens
gatgctgtacgccgtctcttctctatgggacctcagtgaggcacatactgctcctctggggctggcgatcacaagtcatgggtttaatccctgctctaaatgttactagctgattagactttgggcaagacatttaatttctctgatctgtgccctcttctgaacaatgtggattattgtaagacatataggagtggttgttgtaagtatcaagtggggtaacaaatgggaaagattctcccaaggcctgtctcaggcaaaccatcagttatgtccattaacccttccctctctctttttctgcctccctcctcttccatccttccttcctttctctgtttcttgcttgcctttttctttaaaattctttaatctcctctttctcttttctgtgatataataatcacaaaagaaggacttatgatacatatgttcaggtagttcagaaaaggaaagagcgtttcacaattgaaagcatgagagaagtattcaaggagcactcatgtaggtcttgaagtgaaagtagaccttacatatatagaaaagagagaaagcatgtccagatgggtggatgtaaagttagcgccatcatggagggccttgcctcctttgtactctattagacaacatggaggctctgaagtttatttatttatttttttgagacagagttttgctcttgttgcccccgctggagtacaagggcatgatcttggctcactgcaacctccgtctcctgggttcaagcgattctcctgcctcagcctcacaattaggtgggattacaggcacgtgccaccatgcccggctaattttttgtatttttagtagaaacagagtttcaccatgttagccaggctggtcttgaactcctgacctcaggtgatccgcctgccttggcctcccaaagtgctgggagtataggcatgagccgctgtgaagtttattttttaaaatcatttctaggtattctataaaggattgcttctgaaaacagagttcatgattaatagactaggtagagaagagaagtggagagaccatttcagaggatgtgaatcaaagtaataacaaatgaaat

SEQ ID NO: 114537 - DNA, 1036 bp, Homo sapiens
aatctgtttctttgatttttttttcagcttccagaggctacctgtattcctttcctatgatccttttctcaccttgtcattcaaacttctactactgactgaccctcttcctcccctctaacaaatacttttgtgattacattgggtctaccgggataatccaaaataactttctcctctcaatactcttaacttgatctacacgttccattttaccaggggaagaagcatattcccaagtttcaggaattcagacatagacatctttggtggagggtgggggggctaccatatatattgatgtagatatggttttatgttttagattgtactgcctccctatgagtttctgttttcctggctatggccttggtcctcagaatctgttcccatctttgagaatcccacctttgagagtggcatattcccaccataatatggactccagatttctgtcctgtcctgataaattggtcagtccattgttttgctaagggtgtgccactttaatgaaaccatattaacctgattgaagaagaatcttgatataagcttaaaattaaaacaataatagtttaataatggcacaaactaatttcaaagtagttagagcgacagtttttccttgccttttctgattctcactcttgaatttggaggtgaaagtgggtgcatctttggttgttgtccgtggtcctgaactatcccagatactaaggttgtttctcttgacccctgagacaccaggaactgctgttcagtttctctgtcttgtttagaaattccaaagtaggtgagaaaagtagataagtctgtgaacagagcttagtgcctgagcattaaatggatacagactgttggaaaggcatagcccttgacagatcaccaggtagaaaacagaaaacatttctgacatgatttttaaataattgaaactgtaaaaacatttcacagtttaccatgttgtaaacatcaaacagctaagcagcataggaaatgtgtgcattgaacagtgcaaaggatgtgcaaccaaaac

SEQ ID NO: 114538 - DNA, 1068 bp, Homo sapiens
taatgaggtaaacttgcaaatttatgtcttatagcatgactaattggagagaaaaaagccttctttaaggactcagtcacagagttatctgccaactaatgatgtgtctgatcattaaaatcagcttatggattttgttcatgggtttttcaggaagcaagtatggatgccacattgttctttagatggggaggtgggacaaaataggggagaaggtaatatgtttatttcaatttggaaggaaataagcacacaccttacatatgtttgcctattcagagatccactatacctgagcatctcattgatttcagaggcacactcatccgattgccactataaatataacagatcaagagaaaagggagctacatcttaaaactgggaataatagtggtccaaaaactgtcaaatttcttattcttaaatgttttcctaataacccataatctattttgtcctatatatttcagtgctatatattctcccttgaattgattgcctgcagagtaaattgttaaattgtgaataaatcttgagatgtaataggattctcagaatcaactttgaaaatttcagaatggttttctgccatagaaaccaacaatgccttgttagctaaggaaaaataaaccagatctttttctatgaattataacgatgataagagcacaatttccaataaatagccaacaggaaagacccattggactcagcccaaagggcaggtgagtcctctaacattagagggtggaaaactgcagccctcgggccaaatctgtcctttccctacttttataaataaaatgttattggaacatagccatgccatttgtttatacatcatctatggctgcttctgcactatgatggcagagttgaatagttgcaacagagaccatttggcctgcaaagcctaaaatatttaccacccatcttgttacagaaaaaaaaaaaattgccaagccttgttcaacaattttatctctgtttagaattggcatcagttcctgatccaaacttccaaaatgaaagtaaaatcctgggtacagacacaggtaattgcag

SEQ ID NO: 114539 - DNA, 1045 bp, Homo sapiens
ggcaacattctaagcattttacctcgattttcccacttaattttcataaccaccttaggaggcacagatactgttattctcatctgagagatgagaaaacaaaggcacagatgaagcaatttccccaagatcaaacagatggtgagcaggacccaaaataagaacccagaccctgtcactccacagcctgtgtaatgagtaagatgacccacgtacttccatttattgtttggtaaaaacccctctttatatgctgagcttgaataacttgaagaacttacgaaatgttttctatataaacaataaagtgaagctatttaaatttctgtctcaaacacttaagacatggtatagggagtaaatacctttttaaataatagatgaactgattttagatcagaaatggagaaaacattttccttgaaagcccaaagtattcattcatttattctaaattaatagagtgcaaaagagtctaaaacaaaagggaacattattaaggggaatggaaaacacggaatacaccataccaaaagccatttctctcttcccatggttctgagtgaaacaatttcttaataagaattatctatgtaaagaatcacatcccaatcttgaattttcttactaggacatagaatagaatattaagaaaactactgtctgagcatttttatatttaggttaaaaatttcattaatagttttaattataagcatcttactgatgtcatgcagtgaaatagaagagttacaaattttaattatacttagatggtagtttctgtttggaatttttgccttcttcctgtaggatttaagagaagtgaaaaatgaagccaccaaaaatgaaatagcttattactagtcacaaagatagacaggttttaattagacatttcaatttagatctttaaaaatattattttcgctcccccaaaacagagcaacaaatacatgtatggtttactgtgaaaattattaaaatcgtttttttttgtgagtttgcagtagacagtttatccgttggagaaaaacagaaaatt

SEQ ID NO: 114540 - DNA, 1129 bp, Homo sapiens
tcacagttccacatggcaggggaggctgcataatcattggcagaaggcacagcaggagcaaaggcatatcatacttggcagcaggcaagagagcatgtgcagtggaactgccctttataaaatcatcagatgtcatgagacttattcactaccatgggaacagcatgggaaaatcctgcccttatgattgaattacctcccactgggtccctgccatgacacatggggatgatgggagctacagttcaagatgaaatttggttggggacacagccaaaccatatcagtataccgatttttcacccttggggagccaatctacgggcctttttcttctgagttttgaacataatgagggcttagttacataatagatgtgttagttttaatactgtaaccatattttatgttatttgttttattatttaatttttattacatggtctagatttgattttatattttttattgttatttagaaaggtcatgtaatgttgtaactcttttagattagataacttttgtaattaaagcttcacagatctatttagttcattatgtttctttagctgctacttatatcactttagacccatgaagaaataagcatttttgagcatatttccaccttccatcctttctttctgattttatttgattgtagtatatatatttttagctatcctgctatttacttttatatttttaataaacttaaattgcttttcctttaccagatttaaattttatgttttacattggctataaaagatgagtcaattaaggtacttcattctccacttctcttcctgtgtacctccaagttttgttagttaccccatttctacatttgtcatagcatagcccatttctattctataaccatagttctcacagttgcattacttttcattttttgtttgaatgcattctgtaatcactgctagtcattttgctattgtttctcatttgtctcctgactttctttgcctgtggacctgggatgccttctgtcatgtcctgatactgaatgttgctgcagagaagcccacagttgcttatgtgtttcccttcaagatagatttatctttctatcctgtctggatgccagaaagatctttctttgtca

SEQ ID NO: 114541 - DNA, 2764 bp, Homo sapiens
gaataattctttgttatggggggctgtcctgtgcatgtaaagatgtttaatagcatctctggcctctacccactaggtgccagtagtacccctctagctgtaacaaccaaaaatgtgttcagtcagtgcccaatgtcccttgctggataaaatccccattggagaatcactgcaatagagagtttaagcaaaggaaaggtggattgatttctattttagatcctgactgtggcttgtagtcccaaacatcagaactgctctctgtgcttaatcttcttcatatatatatatatatatatatatatatatatatatatatataatttttatttatttatatatataaaacgctaaaaatctcttatctcctaggcccctattatctgtattagtaggggtttctatgtgaatttttggggaggcatattgtatgcaagtaagtacacaatgctaagtttttcacttaacagtgacttgtcattttctttttaaaaaatctattgtttggttttctttttgttgcatgcttgctttctttcactttttatttttattttacatgctgcttcatctgtctttagtagatagaacaactgtttcttctggtacatcgattttccatctagatatactaaaagatctgatttggaaagcccttgctttatagctctgccttgaaaaaactatccaactcagtgtttcagtattgctcttttgaaaaacaggtgccagagtgggtcatcgctccttgatgagatactacaaacagcgatttggcttgtcaagagctgtggcagttgccaaaaatcggaaggccgtgggccgagtacttcagcagtacagagccctgggatggactggcagcacaggtacattgatctttacaactacagaccagtctgagaacttgtatttctagaaggggtctggggaaagttgtttccatttatgttgtccatgtggattctctctaggggaaacgtaacgtcttggctccagggacttccattaccacttgatatgtttaaggcaataagcccaaagtgctatgacttagaaatttcatattcctggcacagtgattttatataccattaactttttcagaagataatagttacaaaaagaattatttagtaatcaccaaaggttgaaattatcctggaggttatgcagaggaattagatagtatcctagtggttaatagcttgagctgtggagtcagacgtgacttatgtgatgtacttagaggttcttatatgatgaacatgagtaatttaattaatataagcttctgtttcctcatttataaaacagagatgatagtaataagacctacctcttagagttgagtgggttgaatgtcatgcatgtgtgatatagtgcatgcccatagtcgaggttagctatcagtccccttttttgtaattttcccatagaaaatttagcaaaagttagaagagtaaagcatgccactgcaattgttgagttttgaaacctcatcagtatggtactctttacatctattctgatgtgtctgctggatgaagctggttatatccttagatcttcagggaaagcatctatccaactgaggactgtggagaaaataagaggcgggctgccttctgatggcctgggaagctctaggcaactaaaatccatttgaaaaggcactgtgtttatatgtggtttccttcactgtggctgcttgtgagctgtgtggccacttgaatctggcagagacttgacttcatcttactcttatcaggaagtattgtctgactcgatatatagcttctgcctttctgattaatggggctttaccttttgggcttataaactcttccagatgatgaaaactaaagctactaatcccagataagtgtatatatacaaaagttctggtatgcaattctggagtccacagagacccctgaggcgcatggcttagagaccccaagttagcaactctgttttaaatacaagaacctagttaccccaaactaaccttttgaattctctgccaaggttggattttctctgatcacaaataacagaactttgcctaatttcttaactgccttccaatcataggagcggctcttatgcgagagcgagacatgcagtatgtccaaaggatgaaatcaaaatggatgctgaagacaggaatgaagaacaatgccaccaagcagatgcactttcgggtccaagtgagattctgagagtctgctgggattgagcaatcatctcctgcccaagtttcctccttgccctgaggaccagtgaaagacagatcataggagagacccttttgctgctacttcattcgttctgacctaataataaaagttagaaccatatgagttttcagatgtcgtttttgaatagtgttgaaaggttatgttttcacaaggtaagtcctgtgtctactggaccctgggacttgcactgctgcctgacagttgcttcatcgcctcagctttaaatgatttatgattgtcagagtaatgtgaggaatcaggaatgacttgtgtgccccaaacttagtttaactttgagagtaactcaccatgtcatggcactgggacctatgtaagggggcttgaaggcttatgtaggggcaaagttgaatgtcactcatggaatgtatcatggtacaggaggtactgaatatctctgggcgcttgcattaaatccaggctaagttaaaaagcacatcaatagcttgctgtaaaggttttatatttctaaacatgactgc

SEQ ID NO: 114542 - DNA, 1194 bp, Homo sapiens
taaaaatttaaacattcagttcttcagtcagactacctgcatttcaaagttctgtgctggaaagctcatgtgattgcagttactgtatcagacacaaagacatattgatagaacgttttctgtcatcacagagttctgttggacagcactgttctataatttgtttttatagtggttaaattgagtatagctgcatgtccagctgtacattctccttcttctctgttagacagcctttctagggaaaaacaaatagaattctgttatatgtcatttgctcatttctactacagacaaaatgctaacgagttgttttctcccaaaaccttttagctggtagttcctacagctgcttcctcccctctcccttttaggtagcttaggaagtttgccacatttgcaaatgagtttatgtcttttagttcaatttgagatattagtctatttattagtgcaatttctctgttataggagtagctatccagatcacaaggaaggggaggaccccaataaggctgaggagttgccctcagaaaagaacttggaatatgatgatgaaaccatggaattgattctgccttctggtaagtgcatttgtcaaaaataaatagcttaatgccagtgggattgagggagaagcatatctccatcaattactttccatactgagggaaatagaccataagcttaaagtatatgtttgggttctcatgtacggtgtaaaccctgaaggttgctgctcagctctaagttgcctgttttgtttaaatttgatcagtgtttctgttcatttctgggttatgattcagaatgtttgatcaggcatttcttttttttttttttttagatgtagaccttttctattctgttctttatttatttatcttttttggtcctgtctaggtttctcctgttaattgtaaccttactgttattctttgaactgattcctgtttccttttgttgctcagacttccaaatggtagtttggtgtgggtgtatctgactcatggtggaaatttagccaccatgaggtatgaaaagatgaagaataaccatgaatgtgagaagcatacatggttgtttattgtgtaggaagaaagaatcgtgattaactgataagaataggagaagctacagaagacatgtttgagaaatgaaaggggatggaaaggtagagatgataataagatc

SEQ ID NO: 114543 - DNA, 1019 bp, Homo sapiens
tagcaaatgtatgttaagtacttgtgaacaactagttgtcaaaattcctgtgagctagcacaggagataagcagatgtgtataattaccatgccaggcatgcatagaccaagtgataccatgttcagaaaagtctcagtcttttaagtcttccttttgcattttctccctgatttctcattttgcagctggagacttgcagttggtggacatgactgggtggaggtagaggggaggattagaggctgtggcagtagagaagacaatgaatgtctgctggtggtgggaagcatcctctttcagtatttatccctctcaagtttccttttagacagcagtgtttatgaccttttgactgatgttgtaatcagagtggtcaaagcaaataccatggatagttaagcagctgccatcagcagtaggcttggaatgcccagcactcagtctctcatcctgtggttatattcagaatcctacccagtctcatagatttcaatatcttctgtaggcccgtgacccccacatttatatctctagtatagccttcccctcagctgtaaactgaagatatccagctgcctccttgatatttctacttgtgtccaaaaggaatcattaacttaacctgtccaaaatcaactcctgctatgcatcctagtctgctctctgtaagtaaatggcatctctgtccttctagttacttaagccaaatgccatgcagtcttcctttattcttctattttctttcatgcttacattagaatcgatcaccaaattctgctttatctgcttttgcactatctatcttcagaggctgactgcttctcactacttctatggctactacccaggtccagggcaccatcatctttcgcctgacttcctacagtagcctcctgctgcctggtctccatatttacatccttactacccactatgttctattctcaaaactgtaactagggggatccttttaaaacattaagtgaggtcaaactctgctcagattctttcaaagac

SEQ ID NO: 114544 - DNA, 1008 bp, Homo sapiens
ccagctcgctgatgaagaatgtggctcacatgaccaaagaccacagtttctttattcctgatatagaatatctttcagatattaagggactgattaaatacttgggtaagtacaatagttttccttttaatgaggaaataatcacattattgggggactggtctcaagggaacattagttttgcatttttcatcaatctttgatataattgcttggttattttgtgaatgatttttgagttttggtgacaaatagtgagatttaatctggttgcaaaaagcttttttcatattttttccttaaattatttttctaggagagaaagttggtgttggcaagatttgcttgtggtgcaacgagaaagggaagtccttctactccacagaagctgtacaggcacatatgaatgacaaaagccactgtaagctcttcacagatggcgatgctgctttggaatttgcagacttctatgattttaggtaagcatagtttgtaatatgaagtaaagtgaggtcatatttgctttgaagtgattattaggtgtgccagtgctggatatgtttggcactgtacaacatatccttaataacacttataacacctctgtattaggtagttctttctttgtagttgagaaactcagtttaacagagtttaacacatctagtgaagagaagaccttagacccagactgaagtttgacttgtttttgtttttgttctggttaaaacatcaagagttcagttttgccagttaccccttgaacagaggtacagaaattaggtttcacatattgggttcctggagagtccttgcatcaccagctgtctcctgaaggagttgagacagttgctaaaccaggcccaaaccaggcatctgatggtgagattaccccattggtggttcacccctaactagaatctttttttttctctgagaaagatttttgctgtcacccaggctggaggacagtggcacaatcatggcctactgcagcctcagcttccc

SEQ ID NO: 114545 - DNA, 1022 bp, Homo sapiens
ccgaccattcattaatcgggggcttcccagggcccaggagcagcctcgggcgccccactcccccattctcgcgtagccgtccccttgaccgcgtcacaccgagcggcacaaccaccagggaaggtaactgggagggcgcgacctccctcaatcaacagccacctcgggctgactgagcggacccaggtccctttcagccacagcgttccctcggcttcctgggcctcacggcggcggaggcgtggccacagcctgagaggcgggtttcctgtccagttgtgaataacttccgacgtgtgccggaagtttcctcagtgacaatcaggaagtcggcgtgtcgagtggctcttcctggctgctgaggcgggttaaggtctgagggtcttgtggggccacggcgctgatcaccaggtgtttggcttggtcggttcttatttctcgcctggcaatggcgacgtacacctgcataacttgccgggtggcgttccgcgacgcggacatgcagcgggcccactataagacggactggcaccgctacaacctgcggcggaaggtggccagcatggccccagtgaccgccgagggcttccaggagcgagtgcgggcgcagcgggccgtcgcggaggaggagagcaagggctcggccacctactgcaccgtttgcagtaagaagtttgcctctttcaacgcctacgagaaccacctcaagtcccggcgtcacgttgagctggagaagaaggccgtgcaggcagtgaatcggaaagtggagatgatgaatgaaaagaacttggagaaaggactgggcgtggacagtgtggacaaggatgccatgaacgcggccatccagcaggccatcaaggcccagccgtccatgtctcccaagaaggcgcccccagcgcctgcaaaggaggccaggaatgtcgtggccgtgggtactggtggccgtgggacccacgaccgagacccgagtgagaaaccaccccggctccagtggtttgaacagcaggcgaagaagttggcaa

SEQ ID NO: 114546 - DNA, 1265 bp, Homo sapiens
cagcaataaagatataataactctgttttcttagcctgtatagaggagaggaacttgcttggctttaaaatatatttatttgccatttaagtataaatatggaatctgtttcttattgggaagatagaatatatatattttcctttaaactttttaaggtcacttttaaataaccaaatttgatttatggtttttaacaaaggactaaagagctgaaaccaacctagttttgtttttgtgatataaactttaagtgtcgagggaccatgccagcaactaccaaaaatctcttaaatcttcaggtacagctggcattttggcagatgcatagagacatctgagaccctcagaaaggaaggataatccaagaatataggaaatctgtgttctcttcctttcattttatcccttatatttctaaagactaattataagtaatctgacattttaatgtagctactcttatttattttttctttctgaggtattaaaatatctggactgagttttgccaaatgttaaagggagaagagttactgaagactttgaacacttgctttttgtgattgcttatgtcattagtgcctcatgactgtgtttgatgtcctttattgatacaaagtgagcctgtgccttcattatcttgcccattttaatacaaatggaaacctggtgtttgaaaatctctgaactgtgtgggttttggaggaatatacctgaattttattcaataacagtttctggacaggaagaaaaatacagttacatatttataaaatagtcgttatcagtatttttttatgtgtatgtttctttctttaaaacaatattcttggatataaagtagaaaagtttaaaggtcatttccatttcttcactaaggagaaaaaaagttaaataatccaagtaattaaagaatataagtcactagatgaccttacaggaagacgaactcaagggctgataatctgtggtggtatgaacaataaatctagaataaaatgttaataactacaaattaaaaggggtgtgaggatgggaggaagttggtagggtagaaaaatgtgctattaccactattgaggagacatgccagctctctagggacagcagcattataactatgtatgaattttaatattatttgtatatgactgtatgactacaaatttacacaatacaataatgggactttctcacaactattaattcaaacaaacacaaggatgttgaaagttcttgtttgtgtatatgtgtgttttggt

SEQ ID NO: 114547 - DNA, 1053 bp, Homo sapiens
cacaataacagttttgttttccttgaggagtgtttcttgactatctgatattatctgtccttcagggataaagtagaaatattttctgccctcagggacagtgattgaagcaaatcttggcattcacaaatgaaagggtgttgaatctcctgcaggtctcaagtaggtgcttgtcctatgctagtaatggaatttgcattactcatgccctgggcttatgaaagtctagttattaaaatgttaaaattaaaaacgctgaaaaatgacttatacttggcatcttgttcatagaaacttgaaactgtaataaatactatgatgggtagttgagtgtcagcctcccaaatgatctaggtggattggataattgatgatcacctggagaagtagcagtgctcagtttgagataggaggtggaaagggtcaatcgcaaaagtaagtagctgatctctgagtcgttttaaacttgatataaaaaaagggagagccccaaatagaacactaagttgctctgaggaagatggggctctccgggcagaaagcttctccaggcagaaaaagccagcactcactggcgccttctggtccctggccttgggaggagtcgctcacgtggctaattggcctgagaaagtgaacgcttcaagttgagtgcgatgtaatttcttaatcttgtgtttactctttttaatcctctagttgacaaatcttatttgcgttgtcatggttctaattcagtgagtgctcatgcagagaaatatatctgtttttattttgtttctctgcctacatacagtcatatgcaagcacctacacacagaggaacataataagtatccacaggattaaaaaaaattctaacacattacactaagaaatgttaaaatctgtaaccagatactgactgacctttctaagaaaaattcgacaggaattagcatcaacagatgtccactaccagtagagagcatgagacccttagtcactagctgagaatgaaaggtctccaagccaaagcatatttataggtgtgatggttgcagcagctgtttg

SEQ ID NO: 114548 - DNA, 1047 bp, Homo sapiens
gctgtggctccttcatttatatattcctaaggtataatagacattcaataaaagtttgtggaaggaattatttagttttcttttctttctttctttcttttttttttttttttgagatggagtcttgctctgtcgcccaggctggagtgcagtgatcttgactcactgcaaactctgcctcccgggttcaagcagttctctgcctcagcctcctgagtagctgtgattacaggcgcctgccaccacgcccagctaattttttggtatttttagtagagatggggtttcaccatcttggtcaggctggtcttgaactcctgacctcgtgatccacccgcctcgggctcccaaagtgttgggattacaggtgtgagccactgcgcttggtctatggaattatttatttttcttctactcttctaccatagtcatggaaaatgtctcttagatatggaaaatgtttaccacttttgaaatcctattttgtcccagctgggctaatatttaaaattgattaagaacatgtagaacaatgcaatctttttgatgcaagagagtttgttgagtttgttttgcgtgagatatctgaatcaccagttaataagtggtatgcttcctaaaccttttcagtgccccagtgagcttcctgtaatcacgcccctgtgaaagctgatttctgttttataaacacagagtgactaattctttgctgctgtttgtaaaatgtgatgaaggtgtctctggtttaccatgcccaaggagggctgcagctgctatggttggccatggggagggtctgtccttggtgactgacaggacaaaagcctaattgtgtgggcttacccttattcccagcctcttctctctttatggcaaatctgtgtctaaatccattagagcgtcttgctgcttctccacagtgggctaatctgggtcctgcagaaactatgtgggcatgaagtcttgcctgagggcaagtctggtacactactattcatatattttaaaaacaacgtctctttaaagaattttcccactaaaggatgt

SEQ ID NO: 114549 - DNA, 1325 bp, Homo sapiens
tttgttttttccctatctgtgcagaaagaaggggcatcccagacagggagaaagtttagagctaggctagaaataaaagattacaactggcctggtgccgtggctcacacctgtaatcccagcactttggaaggccaaggcaggaggatcccttgggtccaagggtttgagaccagccaggggtgctgaggtggatcacctgagcccgggaggtggagattgcagtgagctgtgatcagcccactgtactccaacctgggtgacagagtaagaccctgtctcaaaaaaaaaaaaaacaaaaaaacaaaaagattgcaatggaacaggaatttgactcttgctaccttcgagatgaaatgccattggacaagtctttgggtgccttgtctgaaagagaaataactgttggaagttgtttatctacttacaaagtacattcttagagcttgattgcagcaggttctagttgagtctcacactgaggctttttcatgtgacttcagttccattttggcacttggtgtcctagattgctctggaaccatcagtgagctaaatctcagttttgtttttaaaaaaatcagtggaagccaaatgctccgcagcttcataagtgtatccaggtgtagggcccaggcatccagggcagactgccatgcgtgccctggtctgatggccccgaggcaccatttgatattcaccaaatggacttggtgaaccaacggcctgagagggggcaggtccaggagagacccccctccttgtggtttatcttatgtcagccatacgtggtattagtaggagcctctggagactccatgcccttttccaaggtcaagagacgaggggagagggtgagcctgaatgccactctgaagcaggcgaggaaggcagaagcccaaacagggagcctcaggggccagagaagaaggaaagaacaatgggggcagcgactaggatagcagacagggtcaagaaataggaggaaacgtgtaccctggccagaggcctggctctgcagtggttccttggccccaccttggagccggggcctgggagggcctctgacgccttcagcaagcagcctgggctgaggggtgtggaaagggggacggtccctgttccagctgtcctgaagggagagggaccctaggcaccaagacggagctcttcatgcatcttcttgtggaagcgctttccagataacttccggataattgtgttcacatgttcattgcttcacttggtagggctttatggcgctcccaatgtcagccagctgcggtgccaggagctagggtgatgtcaggcccctgctgtcacgg

SEQ ID NO: 114550 - DNA, 1030 bp, Homo sapiens
ttttaaaaccacagttcctattgttgaaaatgtgattacttgggttccctttacagggagtacattaattgtatcactgtttatattaatatctaactctgagaagggggagatcaagagtacagaaaggaagcagacaattaattcctgctcatatgagcataattgtgcccagagtgaaagtctgcattttagccccattgctgtgaacaacttttgtatgagtcagttagatgccttcattggaattctaattggggccattgaaatttggatatgaagtagacagaacattattaaacaagaaaaggagttggacaattttcttgccaaagaaagtggaaactggtaactctctaggaacaagggcaccaaaatatatttttgtcattgtattaaagacaagcatcccctttcagccatgggtatatggggcatgtttgtgtgtgtggtaattataatcagttgtagtagagtctgtaaaagctacttttctctagttttctagtttccattttcttacaagttccttcctagtacatcaacattatgttgacatttaattgaacaatgaaacaactttctacataaaatgacacagtaaaccaagtacttgaagatgacatttacagaaatgcttagagtgggatatgggttaactagctggttaagaaaacatttccagaaaagtgtaaatgtcaggttcagttttgagatcatgggttgatttactcgtatgtatccccttcatgacattttaacatttctggaagcaggacttttattttcctcttggcacctaggcactcccaccagctctcttcatagaattttcacagaacaggcatttttaatacatacttgtagaatgaaatgtattgataagctatttgatatgtgcagtacatatttatggggcctactcattttagaggttgaaagaagggagagatttggcagaaatgtgattagggttgctttaatgaaatgcaatattttcacaattaagtagtaattattgataaatatt

SEQ ID NO: 114551 - DNA, 1077 bp, Homo sapiens
gtgaacatcaaaatcacagagcactggattaccgcccaaagtatgtgaaaacacacgagtcttcactgatggaaataaatgattggacaaataagtattaataaattggggggaggggagaggcaggtcttccttgcaagccaccaaatactgtacgttgatactcccccattcaggagttagagtcctgtcccttgtgccacactccctccctctttgagcgtggattggatttagtgacttgctttcaaagaatagaggatggaaagggaaaaataataactacagttgcaaatttggcaagctactttatccaagtgatcaagttaacgacaccagtgatatgccatttggacatcgtgagccccgaaatatgatgtgaggagaggggcgcttcacctcatggactctccccccaacccaaaatctcagcctaatgacgagaaaaacatcagacaactccaaactgacgcatctctacaaaacactcctcagatctgtcaaggtcatgataactgaggaaagtccaggccattctcatagaccacaagagaccaagctgataccaagattgaatgtggcgtggtgcctgggagggtatctgggtatcctggaagggatgaagaaaaaaacaaaacaaaacaaaaacctagcaaagtacaagccaagtccggaatttagttcatagtgtcgtaccgatgggttgtagtttctacaaatgcgccatggtaatgtaaaatattaacagggggaaaactgggtgagagagatcaggagctctctttgtaactcttctgtaaatccactgttgtttctttctttccctcccttcttccctctctctctctctctatctctttctttcttttctttcttcttcttttttcttttggagacagcattgcccaggctggagtgtagtggcgcagtcacagctcactgtaacctcaacttcctgagtgcaggtgatcctcccccatcagcctcctgaatagctgggactacaggcttgtgctaccatgctcagctaactttttaaaatttttgaagagataaggtcccactatgttgcccagg

SEQ ID NO: 114552 - DNA, 1030 bp, Homo sapiens
tcatatttcctttaacgcttttttttttttaaattttaaagaggagggactatgcagaaggaaggaagtcgacattattatttagaggtatttggcaaaaagaggaaaagatacatggtgtagtatcctcactggggtgtcatggtgtagtatcctcactggggtgtattgcattattactcacgtgctgtttattagttctgttgaaggttattcttacttgtgcctgtttttaatacctgaacaactgggagagaggacttataatcctgcagtcatttggcttgtattcttggagagtatttttaaactataacattcagagccatctcatgtcactttaacgcccgagcagtactttcactatttacttctcctggactacagacctcagattttgcatcatattttcacgaacacagaaaatacatgttctagattgtttttgatgttttccttattttggggggccagttattacaatctttattaaaatgagtgatattttcaatcatgactcaggagtcatctgctgtggcacgaaaactgaattccatagcttattaagctgaacatcctcaagtcagaactgctgtttatgttgaataaattgcacatttaaatacttttgttcccctggggctaagtttggatgaaataatcttgcttccaagggattttaatggatgtatcatgcttggaatatataatgaagactcagtaattgagagaatgtctaaatggaacagaaactttatttttaaattgagaaataggcctgaaactgatctagggggtcaaagtaggactatcccaagtttttattaaacaggaatagaaaagcccacctttctccacagttttacttatattaatatatgagcggttcaataaatacataggtgattgagatggaccatttctacttccctagtggaaatagggggggaagtgatcccagtttgaggagtttgtttgtgctctctgtgtagagcacttagaaagttagctacacattgcttataaattc

SEQ ID NO: 114553 - DNA, 1001 bp, Homo sapiens
attgggattatttttaaaagactggctcgaccgagggcatttctttgttattattttacctctgtattcacttctcatctgattgaaatataagcttaggattgtgttgtagactctattctagtccagattcacagtgctgattatgaactggtgtcatgtggttgaagtgaggcattttcttttcttgttgctgtttcatgtcaaatgttacaaacacagacgctgtggcactcctttggagagcttgctgaggagctgccaccttcccttattatctattcttttattcttgttccctgcattgtttttcatgggctttgtctttcttgtttggagagtaaatatggcgctggaagtcacaggtggaattatcaggagagacagatgttttccgttggacttggttagggcctgtgctaagggagggcttcgtcccccttgtttaattagagaaagttgttagggttgtttgcacccctgtgtactgctcatgtgtgcacacaaagggagcagagatctgcggacctgctgggtaaagggagcactttctagcaaagccatgtgaattggtaaatggcgtgggagggggtggtaacacttctcatcaccttttcttttgttcctcctgttatagctcctttttgacaaacagggaaaagcattaaaaacaaacatccccagcgactcacttttaacaaatcagggtggtactgctgttcaagtcctcattctggctctcgggctctcagagtcagcatggggtggttacctgtggcatttgcttattttataggcttgttatgttttagtgattgattctttccatattaagaagatatggaacgtttcactgtgttagtttgtattcttctcctattgagttacaaaagggtttcactaatgatgaagtatcaagttcttaaccctaaagaggtcatctcagaaccagatttgtggctgtcttcctgcatctcaactatggcttgaattcttttggg

SEQ ID NO: 114554 - DNA, 1027 bp, Homo sapiens
actcctggactccccaagggtactcagagtccagcagagaaaggcaatgtgctttttgtggcaccaaggttaggggttaagatttatgatgcttttggatttaatgatgaaggtacagtgacaaatcagtgaataaggataatgttacaattcagaactaatgggtgtggagcacttatcccgtgtcagatattttaggccgttcacctgtagtgtctcttactccatatacataacaactgttggaggaggtaggtgtcgttactaatattcacaatgacactgaggcacagagaagtcaggtgacttgccaggggcacacagccacacttgtgtggttgcaactgttttacacctgggtggcctaattgtagtttatcctctacttgctgggttattttgcccattatatgcatttgccagcctacttcttcaggattctttccacgtcctttggtgtagatgcatttttctgttgtctgacaaatgtcagtagtctaactattgactgatgacttctagtacataggtaagcagagaatcagccagactcctgtcctattgtttctcatgctttagatcttcagggcaagcttaaagcatttctttttgccttttgtacttccaaggcccaacatctgcttgcgtatagaagctgcataagatttttgtggtccattctctagttggaccattctttaggtgtgacacagggcttctttgtcacgtgtctccaggcactcacacagaaaacagcgtgagtggcattccctggagttgcagtgaggttgcctggctggatgttgtgggctttgctgagttttgccctggagggtgcgtgtcaggccaggtaattggcctggctttgtgggaactgccggatcctagaataggctgtgcttaactgaatgaaaagagaattcatactttggtctcagcaggacaactttcaaaacaaatattctagtctgtgattgaccaggatgcattgagttgagagcgtcactactgcttacattttaggttt

SEQ ID NO: 114555 - DNA, 1045 bp, Homo sapiens
atatatatcatttagtgctttgtcaaagtatggctatatgtatagttatatacagttacagttatatacagttacagacttcagtaaagtcaaactttactaaagttatgataaagggtgttcacatgtagcatcgtatttaaaccttgcaggaacccagtgaggcatgtgttgttcccattttacacaggaggaaacaggaggcccagaaaaaagttaactgaacaccaaagatgacgttgaccggtactgttcaatagaatgtttgtagtgatggacatagtctgcctttgcactgcctgttatggtagcttcctgtggctgttgagcatgtgaagtgtggctagtgggactcggaatgccatttgacttttatttaagtgtaagtttaaatagccacacaaggctagtagctgctgtgttagcatagtcttagataagtgctgaagctgggtaatgaagcagcgtccattttccctaaattcaatgatttttctaccccatctctctaaagaaaaataggagactattagggcttacttttttcaatattacagaatcatacttaatgatttcagcacagagtgaaaaaattatattgggagagggttgcttctgcatgaatgggaaggatctttttagactgtcagccagcctggtccaagttcctcgccttatctttgttccgtctgagtagtcggtacctgtgaatgagtgtctgctccctacccagtgtggtcaagggggtatacctgggcccagggggtataccagaagcccagtgcctgaactcagagagcctacccactggtttaggagacacagctgatttggtgaatcgattgagagagtatgtcacagttccaaattgcatgtcatggtctccagggctttacagttgaggacaaagtggggatgagggaggtttggaatagctgatgaaagtcttgtgagatttattgtataagcccagaagaaaaggtatagttttaaaagtgaggttaatggtgagcgatttccatgtaggacaaactcaggaagaaat

SEQ ID NO: 114556 - DNA, 1033 bp, Homo sapiens
tggggaacgtggtattgtggatggaagagattgtggggttcttaataaggagatcatgcttaaacctcagtggataagaatgatttgggagatctagtagatgatcaagagcattctaaccctgaggaatacaatgaacacaatagcatcttgaaggtgtacctaatatttcaaccactacacagtaaacagatgcaatggcagcatgggctggtagaaaatgtagtgggagataaggttggctaggtggtttgtgggggcagtagttgcctcagatgctatgttgtgtgtttggatttgttttttctgtaggcaacagggaccaaaaaaaaaaatactttgtagaagtatccacaaataatttaatggataagtacactgtggttcatttatttattataaattgtgataccatataacaatgaaaatacagctttagcaacaacagggatgaattttacaaatgtaattttggtcaaaagatgcacaaagtaatatatgctgaatgattcaattaagttttaaatggtgcaggaactgaacaggattggttagggatacacacataggggataaaactacaaagaaaataaaagacattctcgaatccgagacgtgcaggcacacacacacacatatgcattcttatctatggtatattttatgaaaaatactgaaatatgaaaaaatgctaaaaaatgatattcatgagaactcagaggagtttggtaaaatagaggccacatagagtgcctgtctcaaaaagcagggtttccacaactgaagtagattgggtaacagtcccatagttttgtggtgatgaggggcctcagataatactatctcactcatttcaccaatgaagaacatgtttttagaattttttccttcatttaaaattttatttatttaaaaattaactaacatagccttacagttcagatgtttaaatgtacagaagggtaaacattttgatgtcttcccacgcctgtccctgtctacgcagtttcctctcagaagcaacccatgttgt

SEQ ID NO: 114557 - DNA, 1061 bp, Homo sapiens
cccgagtagctgggactacaggcgcccgccaccacgcctggccagttttttgtattttttttagtagagacggggtttcaccgtgttagccaggatggtctcgatctcctgacctcgtgatccgtccgcctcggcctcccaaagtgctgggattacaagcgtgagctactgcgcccggccttaacattttatttcttaattttaaattttatttctttaaaaaactaatacagtctcacagtgcaaaagtttaaaggtacaaaagggtaagcattttgaaaatctctttctcatcccagtccctggccgcccagtttcctcacggaggccagcaatgttgctagtttcctgtgtctctttccagatagtgcacatttcagcaaatacaccatattctatgcaaattgtggaataacatatgagctcttccttttcctagtatttcttggtgattgcttccttgttctttttcagctgcttcagaattctattgtaaggatgtctcaaattacttaacctgtctcctactgaggcagtaatgtttccaagcttttgctatttcagcattatagctaatgaccctgtacatgcatcattttgcatatatgcaagtattttagagaacttcccagaagtggaattgctgggtcagagggcatgtgcacttgtaattttgatggctgtcaccatattgcatgcagctccttagggttctaacaatttatactcccaccagcaatgtgtatgactgcctgctttgccacactcttgcgaagaatattttatgaaactttttgatcctgcaaatctgataggtgaaaaagactatcccaaaatgattttattttgcagttctctgtgattgagcattttatcttatgtttaagaactaccacatttaccatttatcagcattgtttgtttataaataacctttgtctattttttcaagtaggccagtgttcttttccttattgatttataggagctgtttttatattaaagactttagcctaatttctgtaacatgagttgcaaacttttttctatgatgttttctt

SEQ ID NO: 114558 - DNA, 2328 bp, Homo sapiens
ggcattgaggagggcgttccagctgcttggaggatgtggcattgtaggttccctaggctgatggggagtcgtgcagtgagagggaagagggtggagagcccttgactcaagggtcccaggtgccaggctgcaggatttggtgagatccagtagacaacaaggaaccactgtgggatctttgattgtgcatggcataacagtgaatttacagacagtgatctctggggtgggactggaagggaagagagcaaacagggatatggaagccggttatgatgcctgcacagggatccaggccagctgtgagaaggggtggcaatgacggggacatcatgggagggagctaatggagatcccagctggaggaggtggctggtgtggagcagaagctggcctggcgtctggggagctggccgctctcccagcccctggggcctcagttatcttgtttcttcagctgcttcctaaggagttgactagaattagatgatccagtctttaaaggctgtaattgtggactctgtcatttcacatttattttaagcggggatagtaatcccagcactgttgacaccgagtaacttcagcgtcctcggttagttctggattttaatgtgcaaagtctgacagtttccatcaagccaagttggcacgtttgtgccaccaggtggtgcacattgtatttggaaaagctgagattccacctttccctgatgaggaaggtgaaagtggttaaacttctggcttcctgcaaaatgggatccgtcgattagcatggaaggctacgggagggtgcccagggaatgtctggattattaggcagggccctttgcctgggggagacttgtgacgctgtgtcggttctgcttccccctgggcaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaact

SEQ ID NO: 114559 - DNA, 2510 bp, Homo sapiens
cttctacccttccttagggaagctatagatctaattttttaaacactgataaaaatctacatttaaaaaaatgttatagctgtatatacaaattagaaactttggatatacttgcattttactttgttttttctttacagccatctgtttgaaaggaagaatgtctatctcgtaatggaatttagccattggcatcaacccagtactgatttttgttttgttttaagtagaccgcttattgaaaagaaatcttactaattgtctagatgagagtttggcaaactggtctgtgggtcagatcttgcctgcctccttttttctaaacaaagttttattggaacacagccaagctcattcctttagatatattccctggctgtttttgtacagagttgagtagttgtgacagagaccatgtgatccacaaagtctaaaaatctttactatgcagcccttaacagataagtgtgccagctcatcgtctagattagcttccattttttatgatcacagtaattcagcgtatatctgatgactttatattgaggctgtataaaattctaaatattataaattctagaatccgtgggtggcttttcattaggtgatgtttttgattggtttggttggttcaattatgcctgtttttaagtataaaaaaatcaggtgctttgtacaaagccataattccatttctccctgacaaggaatagataatagcagttaaactcttggcttcctgcaaaacgtgagctgtgaattagcatagaaagctactggcttggccgggcgcggtggctcatgcctgtaatcccagcgctttgggaggccaaggcgggcggatcatgaggtcaggagatcgagaccatcctggctaacacggtgaaaccccatctctgcaaaaaattagctgggcgtggtggcatgcacctgtaatcccagctactcgagaggctgagacaggagaatcgcttgaactcaggaggtggaggttgcagtgagccaggatcacgccactgcactccagcctgggcgacagagtgagactccgtcaaaaaaaaaaagaaaaaagaaagctactggcttttgcatggaggatgcagagaatgtctggttattagggatataaactagagactcttttcagcgtctccaatttatagccctcctgcttgtccaggtttggatcagccctgtgttgttagccccttcatatggggtcttattttcttccaccaatctgtacaggaaagtctacagttaaactggtaaagtccctgttcccactctgcatatggaaggccattgctgctccttgtgaagaggagccagaactgctcagcatgcgtgatttggagaattttcctctgtgatcctagattttgtatttgaagactaaccatccgcaaagaggattggaggcagaactggagatattaatacaagagtagacttggcttgggttgcagggaagcttccttaagtcccccggccaagcatgtacgtttccaggccacttccacgtagctaatccaaacagctagtagaataatgctgagaagtggagagtcaaagcaagatgttagactctgccagttagtgaggttttcccaaaagcgtgagattaactagttagaaatcaagatagccagagaggtgccatttttcatatttcaggcccctccatgcatgcatgcacatcgaatatatttaatcttctgcacagaggacttcactcaaagcctgtcttatggtttagatgctttctgttgccaaccacttcatgacttaactcttctgttgactcttgcccaccagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtaagaggcaaagcaagttcatctttttattcatggtcttgacaaaacagaaaaacaggaccccatttcctcatgcctttgaccaggtcattttctttgaatatttttcttcaaaacacgaaaatacagtgtggtggtccctttccagctgccggttccctgcaggccaaaatctgagatcaccatattttttttgtatacttttgcaacagaggaatctggttccattttgccaaggagtcttacccttggaggaaaggcagagaaagggaagtgacatagatgtccctgaaaaagtatattatttgcaacaaaaccttatgaaaattagttagcaattatagcggtgtcacagctgtgagactcggctctggtggcctcttgagaccaggagggagccgggagcatgaccatcctgggtgcagctcattctggattgtgaaaccacacacactaaaaggcctctaaatatatgtgctaccagcctccaagtttaaaaa

SEQ ID NO: 114560 - DNA, 1069 bp, Homo sapiens
tcaggtgatccgcccacctgggcctcccaaagtgctgggattacaggcgtgagccactgcacctggcctgtagacctacgctatttgatctgtgacttcatatcctcgaagtagcgcgaaggtattcctgcttagtataaacacagccctcatacaagagtattcacatcaatttttataaatgttatcataatgtatctgaggcttggtaaaggtaataaagaaacaggcttttgtttcttttcttcccgtggactcagcataatgcttagctggtactaattcgaatgcggctctctgaaaacacttgttagctggttaaactaggggctgcctgtttgttttcttaaagcaaaatcaggatgaaagtacgttttttcactctgtttattcctctatccccatctctatccactgttttctgggcccggacagaatgtctgtgtccttagaatacaccatgtaaagtcaggtccctgcgggtcactgaaggcccttctcgttcatattctgagcctctcttgactcctctctgtaggctggctgccacatccgaggttggggacctgccatggaaattctacttcaaactttactgcttcctggacacagacaacgtgccaaaagacagtgtggagtttgcatttatgtttgaacaggtaaaaggaatagttagaaacagatttctttgccggcaagcaagggtgaaacctgttaatacttagccttgtaagttaactggtacttagaaatgaggcacacctgtggatttcccagcaaagacaagaccagctgctctttcattcgtttgtagaatgaaacctgctacacattttatttgaacctccgttccagggactgttctagttgacaggagagagagcacaaggaataaaatatgtgacgtgtgttagatggtatctgtgctagggagaaaattaaatttaaagcagtgagccaggggtgagggtacagttttagccagggcagtcagggaaggtgagtttgagagaaaccctcatgaagtgagggagcaagcgacgtgggcatcccatggcatggcagtgcg

SEQ ID NO: 114561 - DNA, 1170 bp, Homo sapiens
gcctcctgagtagctgagattacaggcgcccgccacaacgcctggctaattttttgtacttttagtagagatggggtttcaccgtgttggccaggctggtctcgaacttctgacctcaggtgatccacccgcctcggcctcccaaagtgctgggattacaggcgttagccacggcgcccggccaagaattttcatatgataggatgaggcatgactctttcaagtattaacaacgctgcagaggtgagttggcagcacagttgctcccagtgagacattggctctttaggggttttttgtatttaaattgaactgcacaaaatgaagcgggcccttgccaagaagtcactggtgcttgctccattcaccagtgggggaccattcactgctttggtctacagaaccttggcacagcctagttcctcccagcagccagcccccatcagtctaaaaattaacagttagtgtttgcctcctaggatacgggaacagtttccaggaagcgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccaccgctggggaggtgaggagaggcagctgctgcttgttctgttagatgcctttgctgcagatacacctgcgtcaggaacattgtgcagcattagagtggctgtcctgcacagttgcagtttgcttagtacagctctcaatactaaggaaatgcatgtaacccagaagcaaccacacgaatatagagataaaaatatatatattgagtggaaacacagagataaagtacctgagacataatcttgctaatctgagaagcagctgagtgtctagcagagctgcagacctggctcaggtccagccactttgatgagggtttattgcagtgcttctgcaacaaagtgtttgtttgcacgtgactagctagatgaatatcagatgaacacattttctttttaaaatttgaacttactattataaaaccagttggccaaaagggtggtaatccaataaccaccaccccgacccccaccccccaaggcttcttatggaaaaa

SEQ ID NO: 114562 - DNA, 1872 bp, Homo sapiens
cctccgcctcccgggttcaagcaattatcctgcctcagcctcatgagtagctgagattacagctactcagccaccacacccggctaattttcatatttttagtggagacagggtttcaccatgttggtcaggctggtctcgaactgctgacctcacgatccacctgcgtcagcctcccaaaatgcggggattacaggtgtgagccaccgtgctctgctgagatgaaattttttaaatgtatgtaatctccaggggagaaaatttaaaatcacatggggaagtacacgcacgagaaaataagaaatgagctgtaagaatgtatttttgtgatttgtcttcaaacacagattatgggtatcttcgtccatgaaaccacctaacactggatttccaccatctttgccccactaggtttatggatatttgagagtcttgaaaaatatttatatgtaggaaaatacaggtttcttacaataagcttgcttgctttatttttaggagaactgcctgaactcggatgtggtggaacagatttacaagcggaacccgatccttcgatacacccatcaccccttgcactccccgctcctgccccttccgtatggggacataaatctcaactgtaagtccagagctccaccccgactcctcagagaccatgattccacttgccctgctaactctttagcttaacacagaagcatttgtttttatctcaaagactctcttattcgtcgtgaattggaaggaaaagatgaaatatacttagattcattattaaagcaagacttctagagtgtggttgtagtaatgctaagattgattgctgtagtaaaagaagagatttaaaggagtcagaaaatgccagctctccccatgaactgagagtagccttttgttttgtttttgttttttgagacagagtcttactctgtcactcaggctggggtgcagtggtgcaatcttggttcactgcaacatctgcctcccaggttaaggtcgttctcatgcctcagcctcctaagtagccgggattacaagcacccgccaccacatccagctaatttttgaatttttaatagagacagggtttcgccatattgcccaggctggtcttgaactcctggcctgaagtgacccacctgcctcggcctcccaaagtgctgagattacaggtgtgagccattgcacctggccgagtagccagacaaccagatcctaagtaattttgcattccaaaaaaggattttgttcagcaacagattaccttttaagtaagcattttatgtggtaagaagttcaattagataacaaaacagtgtcaacttacccacctctgtgcttttagatctgtgttcaactgattgagatgtatagggagtgtggtgggcattgcatccgtcctcctcatttattcctttgtcttgactactgctccgattatgctcatgccctattctgaacccctcagatgagttccgtgtttgttttgcttgtcctagtgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggtaaagcatgggggcacgggagatgagctgggcagagctgcttacacaggtggggcactgggtcctcgttca

SEQ ID NO: 114563 - DNA, 1096 bp, Homo sapiens
gtgacggttcggacagcttgcctctgaactcacacactgccaggccaagtgctgtcttctgaagggagaggctaaagaaaggaaaggaagaaataggaagtaagaaggaaagtcagaaatcagagagagttttcactcctgttccagagcccaaaaagagacattaacttacccttttcccttccagagccagttatcatttatctttatatatttaatgatgggtttattgttctaatactcatctccccatctcagctgtaaatgtcacagtgcaagagacactttttttcttcatcactagatacctagtgcagggcaggacaggacacatgtaggaattaagccagtgtctattgaattgaataattaaagggactgaggtcagagaggacacaggcattgcctcagtccccgaggttggcgttgacgtgcgtgtgctgggcacccctgccattgcaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggtaagccaagacaagcccatcaaggtgggtgattacagctcagagattctacccttagagcaccaagacctcagcattagtgaagctcagttttttttctgtaatcaaaactagtgcttggttggccggcacggtggctcacgcctgtaattccagcactttggaaggctgaggcaggtggatcacttgaggtcaggagttcaagaccaacctggccaacatgatgaaaccgtatctctactaaaaatacaaaaattagccgggtgtagtgacgcattcctgtaatcccagctacacaggaggctgaggcagaagacttgcttgaacctccgaggcagaggttgcagtgagcagagatcattccactgcaccccagcctaggtgacagagtgagacttcgtctcaaaaaaaaaaaaaaaaaacacccaaaaaactagcgcttggttaaatttgtgtttgagtaccctgctttcggg

SEQ ID NO: 114564 - DNA, 1002 bp, Homo sapiens
gggacaccagagtggagggccaggaattcatcgtgagaggtgactgcctgccctgcttcctcggtctgcttaacagactcccctttccatttgcatatagacatctgcagcattttcatttcgagctgcttttcccagtcattttaactgttggagattttgtaagtgatttttaatttgtgatattataaagtgtttctagagggtcatgttttttgttgctagttgtgattttgggcttttctttcatgtagtcgttccatttacatcgggttggggtgttcgtggtctttttctggcaaacagctagaaaccccacccatgtgttagcattatgcagatgattgtgtggtctttggggtttctcctcacagattttaatttacactttaatctttttttccaggatggttgcacaaagaggtgaagaacagtccaaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggtaaccaggctggctgcccgaaccctgagcatcaaatcttaaagtctgggcttgctccgggcaaaggaataagattccttcctagtgtgtactttatttccccccaaagaagttgtcctcttggtttatcttctaagcctgtctggggttagctatgtgaccacttagtgtttaagccgtactagaggtcgattcatggagtggtaggaagattctcgcaaggacaagaaaatgtcaacagatgcagggcatcgtacgggaagcttggttttcatatactgttttcatccttttaattttcattcttctcatttttgagacagggtctcacactgttgcccaggccggagtgcaatggtgcaatcttggttcactacagccttccagggctcaagcaatcc

SEQ ID NO: 114565 - DNA, 1067 bp, Homo sapiens
gtaatcccaatactttgggaggccaaggcggatggatcacttgaggccgccaggaatttgagaccagcctggccaacatggcgagaccccatctctactaaaacacaaaattatccaggtgtggtggcccacacctgtagtcctagctacttaggaggctgaggcacgagaatcacttgaacctggaaggcagaggttgcgttgagctgagatcacaccattgcgcagcctgggcaacagagtgaaactctgtttcaaaaacaaacaaattaaattaaaatagaggtacttgtagaaaacttagttaaaatatttttaaaaacaaagaaataaattattgaaaggttaagaggtaatgattaacttgtaattttaaaaaataaatggcctatagattctgctccgtgtagaggctatttgtactcacacaacagaggagtcgtctcatagataactattattttgaagttaaaaagaaaagagccttttctgtctgattgggagttgtgggctagaggtattactgtagtgtgcaccctactttagtgcttctctcattctgtttactttttgttcttttccagggcaccttggatgtggggctgattgattctgtgtgtgcctctgacagccctgataggtaagctcagatgtggctcttaacaaaaacagctcatcacctgtgtgtgtccacaggtgtctgtgctgctgggtcacgaccctcttcacagggctgtgaaatcacgcaaggctgtgtgttcccaccttgtcaaccccagcaatccagtcttccttcttggtacccaattttacatcacctggaagtctccttctctgggtatctttggagtcctggggaaaaccgtgggaacctggacaattttaaaaagcatgaggaatatttttaatgtgtatacagggacaaacttgggatttatacaggaagaaaatgcctgtttaggaaaatgatattccagcaaaggggaagggagtcattctcctttctgaacttaacgataaacttgaaaaggattttgatgataatgtatatgtagagtattaataaa

SEQ ID NO: 114566 - DNA, 1067 bp, Homo sapiens
ctaatggctgtttaagtaactgatagtgctatggcactggggggttttaaagatcttaatattgaagaattcaacggaagaggtactaacttacacagaacttactattagcttggtgcaaaagtaatcacaattatatttcaggctaatattctaaatgtttcatacctaagtatttcaggaagtattctaaatgcttcataaatattaactcttttgattctcttggatcctgcaaggtagacattaattattaccatcatccatactttgcagaataagagactagggtacagagaacggttagtatcatttgtaatgcagtgcaacctcaattctgttgaatggagacattgaacttcttaaaaacatttgctcctaaggagctttaacttttgactgagattagaagagggtggaggccttcattggctggggcaagttgtctgtagcttcctggacttcaggtttccatgctggagtgctgaggagacatagcacaaaattaaggagacttagcatttgctcttcagtgtgatggatcacagggtcaccttgtggatctgacaccgtggaacgtctgtcctgtctattcctgcagcttgtgagtttgtgagtctgcagggttatgctggaggtgtctgagcaatgccagagaacatcttttttttttttttctttttttttgagacagagtttctctcttgttgcccaggctggagtgcactggtgcaatcttggctcaccgcagcctccaccttccaggttcaagcaattctcctgcctcagcctcccaagtggctgggattacaggcatgcaccaccacgcctggcaaatgttgtattttttatagagatggggtttctccatgttggtcaggctggtctcgaactcccgatctcagatgatctgcccatctcagcctcccaaagtgctgggattacaggcgtgagcctcttcctggctgagaacgtcttttaatttacgagggtaacatccaatagccgaattcttcaattctcagccccaagatcattaggaccttctagtatgttctcaggacccc

SEQ ID NO: 114567 - DNA, 1920 bp, Homo sapiens
gctcctggcccaaaaaacgggtaaagaaactggtaaactttgacaccatgttaaaataattttccctctctggtgcattttgggataagcctgatccatacatagggacatggttctcacccttggcttttgactcattcctgggttagagtgtcagttcattacttgcttttctattggctcctttcaaagctttctcagctaagtgagcaggaactcctttggatagaaggattcttgtataatccagcctggctggtgtgacatctgtgtggtgcccccagacatgagctagcagtgccactcctcactgaggggtctctgcggtgctgcggctggggcagagtctaagctcggctagaccttaacacctgctatgcatgttgttgtcatccaacttgactgacttttctttcacccctctctacccaatctcacggggaacaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaagtaggttgctaagcctggctgtggcccgatgggttgctcatggtttatgctggtggtcatagagccatgctgtgcaagttccttgcagcggcagtagcctgtagcaggtgtcctgatagttcagttcagtaggttaaattactaggaaactgggaagcaagacttaatccatgagtactttgctttttgtgattacactcagacatgtggctgtcatttggaagatggccagccaattggatctggaagttgcctggtggaaacggaattgaatgtgtggaggaagaatggtgtgaatttggaacaagtggctgagtctttttatgggttaatgtatcactttcaattccttactccagctgttgccagcagataaattagctaaattaaaagcagacagactggaggagttttccgaaataaatcacttctcttctgttataccagtgttggttatactagccatccccattcccagcagtgagaggaacagggctggtcttcaaatccaacatgcccccttttctgccacacccttatagaaccaaagctttggactattgagggcctattatttttgttaaaagactaagtaatgtttccagaaaattgttgggagttacaagcagctggttttctggggtaactagatactaagcctgaaaacatgtttggggataacctgtagccgtactccactcaaaactgagtgacctcaaatatttagaaaagtagtaaaataatctttgagggatcaaattaatgcctgaagtcaggagccttaaaagtaaaatgtttctaatcagccagcatccgcaacttcagaaaagtattcattgtaaagtggaaagttaaatgaggagaagaaagtcttttatgtatttgattgtaagggaaaactcatgtctctgcagacggcagaatattggacatttccaggctgtccctttggagttcatgaggtgcgggagtgcgcttgtgagaatcctgggtctgaatcctgcaagggttcacagcaaggcatggctctgttgcctctgccatcttctctcagcctcacataccgtgatgttcctcatctgtctatagatcaattgattgactgacagggtctcactcccattgcccaggctggagtgcagtgacacgatctcggctcactgcagcctcaacttcctgggctcaggtgatcctcccacctcagcctcccgagttgttgggactatagg

SEQ ID NO: 114568 - DNA, 1215 bp, Homo sapiens
tgatgagcatttgcattgtatgctttgattgttactaacatttgagtatactttgctgaaccttaacacttaggggccttgaggcacactccttttggaaaattatttactatttatttatctatttatttaggtatttatttaagacagggtcttgctctgttacccaagctagagggcagtggtgtggtcatggctcactgcagccttgaactcaggttcaagccatcttcctgccgcagccttcataggagctaggactgcaggcgcacaccatcatgccaggctaattttttatagagatggaatctcactatgttgcccaggctggtctccaactcttggcctcaagcagtcctcccaccttggcctcccaaagtgcaggaattgcaggcatgagccaccatgcctagccagaaaattatttaattatttaattgggacctcatatttatgctttgttcctgttcttgactctgactcgtaactcagtgacagggataataagaaaccataatcatcaccaattttgggcaggagttttacgtggatggttaaaaagaagggaccgtcctgtttctcgcatggacctagactggagaggggagagagtcgagaaggtggagatgggcagggatatgagaaccttcctccccaggtctcctcttcctgctttctcccatatttgatttttaaatttgtcttcttcctttttcttcactttcctttttattgccgtctttcttcatttacatttacattttcttttttttgtcttcaccaccatgaaaaccttttttttttttgagacaggatcttgctctgttgcccaggctggagtgcaatggcacagtcgtggctcactgcagcctccacccccggggttcaagtgattctcctgccttagcctcctgagtagctgggattacaggcacacgccaatgcccagctaatttttgtatttttagtagagacagggtttcaccatgtcggccaggctggtctcgaactcctaaccttgtgatctgccctccttggcctcccaaagtgctgggattacaggagtgagccaccgcgcccagccatgaaaacccttttattccattttcccttctttctttctgtgcttctcttttctgttagcttctttacgtttttttccacgtcttttcttttgttatcttcaatattttttttctgttttcttcacttgtg

SEQ ID NO: 114569 - DNA, 1034 bp, Homo sapiens
gggggtgaactcttgcatggtttgattaaaattatagccttaaaaagcattgttagttttagggcagatagcctttggattcaagtatatcttgtctttcatgtatcaattcaactgaccatttgaccttaaaagttggtatttttaattccgaattatttgtgtgctaccgtaaatcaggcgtattgcttgtcagttgttttttttctttttccttttccctttttttttttttttttttttgagactgaggcttgctctgttgcccaggctggagtgcagtggcacgatctctgctcagtgcagtcactgcctcctgggttcgagtgattctgctgcctcagcctcttgagtagctgtatttttgtattttttcaatgatgatacatgctgggtatcttcgtggcttgctttgtggccttttccctcaccgttggcttctctctctcggtccagtttgaagatagtgaagaggactttgattccaggtttgatacagatgatgagctttcataccggcgtgactctgtgtacagctgtgtcactctgccgtatttccacagctttctgtacatgaaaggtatgactgcagccgccatggagtctgggttagggggagagcgaggcgttattttatccgggctgatggatggcggtgggaaataacggaggtgttattgtatctgggctgatggatggggactgggaaagtcgttctacctacccttacctcagtgttgggccacttagatgaatgaagggacaccttgtcatgttggtgtgacatgggtgctgtggtcctaccagcatgaacacagtcgtgactcccctggtttggtgcagagtggcaggacgaagcatttgcaaccactgcctccagtatcagtccttctcccctgtctctccctgtctcgttttcctttcttagctctttcttcatccttctattttctctccctctctctcccactttctctttcactgtctccctctctgtctcagtctcattgctctctctcatatatacagacata

SEQ ID NO: 114570 - DNA, 1117 bp, Homo sapiens
gcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcggtaagtacctgcctggcgtgtcccagtgaaatgggtggccggtcacacccacccctgttgcatcctcaagttgaatgaagatacccgtaggatatctgtgcaaagattgcagagtcgtggtcttagagatcatcttaaaccttttgcttattccataagccaattgcattcataagtagaactttgatgtgcctgtttcagttttagcacaaagcctagagctgagctgtgcccaagacttcagaaaactggctatttatttatttattgttgttgttgttgtttttgaggtggagtcttctctgtcatccaggctggagtgcattggcaggattttgcctcactgcagtccccacctctcgggtccaagctatcctgctgcctcagcttcctgaatagctgggattacagatgcccgccagcacaccggtc

SEQ ID NO: 114571 - DNA, 1051 bp, Homo sapiens
ccaagactacttaaagccaacatgaggggttatgtgtttatttagccaagatagtgataggcttcttactttagttttgtttgttattatttctttgtttttctcctgttttgttttgaccaaaggggcctccttgttctctccagtttccataatgagagtctcattctaaaactgggtcctcttttgtcttgtagccttgatgtgagctcatttgaatagctcaaagcctcattacttcaatgccgattctcttgttttctttcattttcagaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaaggtacagtacctttcttgctgggatgaaacaaatggatacattttgagtgctgtgctcggtatctgtctgtgcagccagaaatcccagcagatgccccagaacctacaatttgaaacagtaactctaggtggctagaatataaaattccttggcagcattaaagacccagttctgtgaatatttttattcatacagaataaatccatggccagaggaaggggctctgtctttcatgctttctgtctttggcaaagctgttttaaaaacgtagatctctctgaaaagtggttccagggttattgttgttgattttcacttttcctttactatttttagagaaagagagagagagcgaagagaagccgagctccgcgcccagcaggtaatgagtgcagtgacaacttagcctcttgtgtttctacttccttcccacttctaatgcttggactctaggattcaaaactgaattaaagtagaaagataacaggaagaacaatttaagaggatgtgtttatgatccaatttctgacctattacaattgg

SEQ ID NO: 114572 - DNA, 1035 bp, Homo sapiens
taagtttagaaggcttctctggtagtataaatttaacaaagttaagtaagtctgatactttattcagtgttccttttatatttgctctatacagtgctgcttagattatattcccaaataaatctcacagaagcattgtaaccaaatgccttcagaacagtcagccaccccccaacccgcatttttaaatccagagatacggcataagagtcaccaaggctaattttgttttcatatttttatgcttttcttacttttctgaggataatttaatcaagactaaaaacagagaaccacagttctttggatgtttgccctaatttgctggctgcacttgtttggaatactgctaaataaagacaatttgaccacagtgtttgtagaagaaattaaatatgagagaagtcagcccactagggctgatggcagctattccatcaaaagctgtgagggacagttgcaaagcattctttaaatttatttttttgccaattttgaaagcttgcagaataacacggctttatgcctaattctgtgttaatgactgcatttttaagggtcacaaattaagccactttgcattcttgtatttttttaacagttaggtcctatggcactatttttttgtcattgtattcacagttgtgtgggataacaacatgcagcttaattaaagggaacacgggtgggtggactgaaaaaacaaaccactgtccccagagttcctaaatggcccacttttttgctttcctctgaaaacctattgtcctggccccagtgccagtttgtttggcagctgaacaaataaaagaacacatttcagagcattaagtcttggttctgatttcctctgtctttaatttgtgtgttctcaggcttatttagtgatcagagtatggagctctcaataaataagtatttgactagaatttgagcaaagtcaaactctttttcgcctctatgtcttccaaaccggctagcgtggtcatctccccttccccatccccacccccacccccacctcacctgccacag

SEQ ID NO: 114573 - DNA, 1048 bp, Homo sapiens
cagtgttgaaaattaaaaagctctagttttggcgatccaggggttccctttttgcagcaaaaggcagttctgctttctatcttcccaaagagctggaggggtgggagccaaaagaaagtccccaggtacctcatccccaaggagttggtgtgcaagctggtgtgtggcctgaagtttgggatctgcctacagggtttccccagagggcagcccgcagaaggaggcagagttgagaaatctgtccagtgtgcaggagaggagacaagcgaccctggccgtgtgcagtagtccatgcacacgcagggccattgagagagaggaagttggagcggcaggtgcagggctgtgaaaggcaggaagccaggaggcagaaaccagaatggaaggaagaagccatggcggagggcggcctatgttcctagagctcaaggaagcattcaatcacacgctcaacacgtgattttcaggccacttgtgtgttttggaaacaagtatgtgaccaggcacagaggcagccaagattcaaatgagtgaatgtcccatggacataattaaagagaaagggcttgtactaaacactggagagctgttaggcatagcttttccaggcatttctttgctagtttttttttttttttttttgggctggggggaaggatcggagtgtatgtgccccagttttatcttgtttaatccagctttattacagctctgtcctcagcgctggctctgtttcagcatccccataggcaaggaagatgctggcttcaacagtttgttttaaaaaacaaaaatcaaagttaatgtcctaggaatcttttgggggatccctgaaaactaaatataaatttgttagggaaagtagttagttatatgttgtttgagaatcattgtcttgatcttgaaagattatttgacactttatttgatgttaatggaaattcttcgtgtttgatttatttgttcagagtcattagcctcgtgagaacccttcatggggcctttatttcacagtatttgcatgagcattgttttttatctttgaaaa

SEQ ID NO: 114574 - DNA, 1023 bp, Homo sapiens
acaacattcaccaccgtggcctggtcccacggttttctcgtgtaaatcacagcatttagactctgccctacagctctctccattagcctgatgactctatagcaattcattaacctgggcgtttttctacctattccagggctaacagcataaggttttcctctcaaggaacaagttgatttgttgctgtttgctcagtgaataaaagcaacctctcctttagacaatttatggcgaacaagatgataaagcaagttactctttcaacatttctggagtaaaatgatggatgaggctgtcctgggaggccacacatcatggtggaccaaatgaggttttaacactgatccggcctgccttttaccagccacaggtcattggtttgtcactttagttttctgttctcccatcagggaagggagtacagaagccaccctttgtagggtaggtacaaagaggaactgtgagcaagtctgtaaaactcctggctcagactctggcacggacggagacaccactgatggccgtggtggctgataaacagcagtcatagtcatcattatggaaagaagtggcattggagtcttttttttttttttgagacagagtttcgtgcttgtcacccaggctggagtgcaatggcgcagtctcagcttactgcaacctccgcctcccgggttcaagtgattctcctgccttagcctcccaagtagctgggattacaggtgtgcgccaccacgtccggctaatttttgtatttttagtagagacggggtttcaccatgttggccaggctggtctcgaactcctgacctcagttgatccgcccaccttggcctcccaaagtgctgaatttataggcatgagccaccatgcccggcctgacatcgggagtcttggtagagaactctggtgttcactgtgtggctctcccagcaaaaaacaggtgtgttcgtttcttctcgtgatctgtcatttgaacgtgggcaccgttgactgaactcagcagcacattgccaggta

SEQ ID NO: 114575 - DNA, 1072 bp, Homo sapiens
gcatggcattgctttcagtaaagcttgagctagtcagtttacattggactacaagtgtacagagttgcagctcttagaggcttttaatcagaggtaccttgcgaattagggaaataaggtcctgtgcagaagtggaagggcaggttggacctggtcgtgacatcatttgactgggatttccaggcttctaacacagcctgtgagcatgcaggaacaaagaggtgtacaacctctgaaaactctgtggaactgaccctctctcagagcagccattgtttgcagcgctgttgcatcagcagatgggccacttctattcagttgctcctgctatctggggcgtgctagaggcatttcctggtttacataaactctggggctctgccaacgtccttagagttcaagcctttcccttctcatgctcaattaaaataattaactacagtacaatcgccgcttgttctccacttctcaccttgcctgctcacagcacatccattcttcttgttccagcctgtcgctacaaagtagttagatgatagagaaggcaggttgggaatattcaaagactctatagcaactggcctggatgcaaaggctttttttgttctttgtcctggtcgttttggtaaatgtgtagtcgcgtatctgagacatagattgtgctttattcggtgctgtggagagtagaaactagcagcagtacctggaaaggggccctgatctgcgggtgtggatgagtagagactcttcagttgagatttagctctagtgagggttgggtgcaaaaatgtaggaaagagtgaagagatgagcagctcatgtctgagttttttctgtttctgttactgtgtcacagaccagcctcagatcatagttcatgatgccaagatattgttggagttgaatgcggagacagacagggaggattttttagagtgtctgccagtgtgtaatgtgtcataatagcattttctgggtttgggttttttttttttttttttcccgaggctctgtcgcctaggctagagtgtggcggtgggatctcggctcactgcagccttgacctcctggg

SEQ ID NO: 114576 - DNA, 1076 bp, Homo sapiens
acatacacatacacctgctgagaagggagaagtgagggcgaataggaacttgactgggctccctcaccttgagcaatcttctcctcactgctaaacatttccaaaaagagtctgtgactattttcttctttctaatgccaggcaatcaaggctgcacttgctacccttctgcaggaagcttcccagccagcacagtttctctctgccctgcctcttaatccccacccctgctcccaggcctgggacactgctaaccacccctccttcctgacacctctctgaccacccctcctcctcttgactggttcctctggaggtaggcatggcctcgggttctgcccccagtttctcactcgctgggctccaaaagaaacactggcttctctccttcagctccaggctaggtgagtacctctcccctgtgtatttccacctcaaaaccctcctctaagctttggcctcatcatctcccttaattttgtaacttacttgattttcctagttttctagattttctagttccgtgctactctgcttcacctgtttagcactttgaactgaaatgtgtccataattaaacttcacatccttttccttccgcgtcagctatctcaaacagatgattcttgcttaacccttttcctatgtatcaggataagtcagggttcttggcctcggcagtactggcattttgagctggacaggttattctttgttgttgggctctagcctgagctttgaaggaggcttcaaagcagcgctggcatctacctgctagacgctagtaacactctcctctctcaacgtctccagactttcccgggtgccccccagggggcaaaaccacctcctcttgaaaaccactgggctgtcgatgctgatgatttcttggtttttattcttattttttatttgctgtcaataaaaacggcatctacatgtaagttaacttgttatatagcatttgttattgcttttaactgtgtgttttactattcaactaaaatagaaaatggtgtatcgtttcacactttctggatgtacttagtcattcagttaaatgtctattttgtttc

SEQ ID NO: 114577 - DNA, 1048 bp, Homo sapiens
tctcaagatcagggtctgaaactcccctgggtcttctctcatctgtgcagatggtccactctgcttcattagctcttcagcacttcactctgttcttcttcatcctaggggtactttccttgtttttttctccggcaagttctttctatgaccctcaaaaatatgcgacaaagaatagtgacaataataaaaacaccaccgcattagatgctggggtttgcgttcacccctcctcaatataaagacgattcttactgattataaaatattagggaaatatgtgaaatgttttaaaaattagttacccataattttaccagccagagacaaccctctttatatttgttgtgtatatacttttcttccctttaaattgggatcatagtttaccttaattttgtaacctacttttttttttaacttaataaatcttgaaacattctttcgcattttttcatgactataaaattctgtcagtggctatactttcaagtcagatttctattactggattgtttatttgttgttgcaaataatagtactgtatttttcatgtgcacaaatactttctccttaaggtaaattcttgaaagtgtatttgccaatcagaatatgcacgttgttatgactttgatgtatatatagccaaactgccctcattaaagccaacagcaaacaagatatatatatccaatgtgtataacaatggatgtatagctttaatatataaagagccttcacaaatcaataagaacatgttttagtagaaaaacgagtaaaaaacagaaacaagaaatttgcaaaaggtgaaatataaaattacttgaagttctcaatagtgtaatcaaataaatgaagtttaaaatgagatacttttgctagtgtgaggattgaatggtttaatggttttatgctttttttttttttttttgggacatgattatgttgcccaggctggagtgcaggggctatttacaagcacaatcatagcacactacagtctcaaactcctggctgcaagagatcctcctgcctcggcactggagta

SEQ ID NO: 114578 - DNA, 1047 bp, Homo sapiens
ccacccacctaggcctcccgaagtgctgggattataggcgtgagccaccatgcgggcccttctggtttttgattgccactcatgtcccctgttgttttgactgtctcctgcacctggagcacccattgccagcatctttgacttttgaaaacatttcatatagaagacctgtaaaaagctgcctttttacctttggaggaaattttagtaaaggaagcatttaaagcaaccattcttctccctaaacaaaacaatcccagtaaagccctcagtggtcacttccatcctgtttaccaagttgtcatggaaactattcatcagagctctgtagagatcaggataaattgcagcgagtgaagctcagcaccagcaaagagtgctgttcttgttctctgggtggattttccaagatcacaactaaactgcttgattttgtcctgggactttttttaaaaaaaaattattgattggcttttaaaatcaagaatctttgggccctgaaatgtaattacacatttgttgatgcgtgcatgatggttagtttgcccctgcagtcaaaagtgtcttcagcagttcctatcacgtcagcctcgccaggctggacttcctttgagtagaatcaggaatgaattaagcagcacagcccgagacgcaccacataaaaggctgggaacaccagccagccgaagaaagcccatttttgtgtctgtcagcttagatgcccttgcccggactgctaaagatgcagctatttacagtggacagaaactgaaggggtgaaagaaaacccaaggtagggatttttctctttcttgttctgcttaaaagtttcatgtaacttgccatgatgatggtattgtaaaactgcagagatcatacacggggaacagattttgctgtttctccaggcacggaagtgtttacaagtgggttagtgctgattttgattgcatgtacaagtttgaactacaaatttttttttgtaaaaatgaaggacacaattcactgatcagttaaggcgttgataatgcaatatattttcatatg

SEQ ID NO: 114579 - DNA, 1047 bp, Homo sapiens
ggatcccaaacagaaagctccaattatgcaatgctgatgtgaacagagtaactgtatttatctaaattaattcaggaaacagagactttaagaatagatttctcattaaaatgtgttttagttttaatagctctcttcagcagttttttaaagtgggggttgaagctgtgggaattaagagaaaatggaatatagaaataggagttgctggacgtaggagccctgtttagatttccttgggcatgatctgccccctgctggctaaaatgtgttttactactttaaaaacattctcatgcttgagaaaataagcctgtttgaattatataggacttcatagatcaatttttctctcgctttataagtgaacatcgattggataggctcctctgctacttggtggcaatgccaggtccctgggcttctagtccaagcctcttcctttgatttcattttcaaggttgttgcctctcttaaggtctagttttaattttgccatttttgtgtacatttaaatgaatgctcatgctattacagttttgaatatatgtgtgtgtgtgtgtgtatatatatatatatataaatttaaaacttacttgaattttccatctcataaggtcagtgtttgactttggttgatctctagtacatttgacattgactctagtttttcatacaccgtataggccagacagggtttagtttattatggtgtattagtccgttttcacactgttgataaagatatgctcgagactgggcaatttacaaaagaaagaggtttaattggagttacaggtccacgtggctggggaagcctcacaatcatggtggaaggcaaggagaagcaagtcacgtcttacatggatggaagcaggcaaagagacagtgaagaagatgcaaaggcagaaacccctgataaaaccattagatctcatgaaacccactcactactgcgagaacagcatggggaaaccaccctcatgattcagtcgtctcccaccaggtccctcccacaacatggcgggaaccatgggagtacaattc

SEQ ID NO: 114580 - DNA, 1050 bp, Homo sapiens
ctgagctgtcaggttccatgggttgctggcaagtggctcatcgccaggtagagaggctgccattctttgctaaggagtaatgttagctttttctccttggggactggtctttttatctgagaactttgtcagaaaccaggaaaatatttttttattgtagcttttggcatcttctattgaaatggggtagaaagtgataaaaaaaaaaaaaaaataaaagcacccagaatagtcaagttagagttgatcttcccttttcttcactaacctcctctttggctccgtattgataattgaatctttctgaacaccagtttttaaaataaacgtgttttcaaaggtcagatatcataatccctcttaacagggatgttttaaagtaaaagaagtgaaagctctgggaactttaacctttgtacctttgtctccatcttagccatctcatagcaacaagtgtttatttagaaagttcctgcctcgaacttggctccattttaagggggatttggaagaagtttacagcatcatccctagcctcaaagcttgcaatttagtggggagataacaccaaggccagctcacagcacatggccttggatagctgaagtcctgtcattgagggttatgtgatgatgacacaggcttgggtttgagtgtgcttatgaagcccctgaaccttaccgctgggccctttagctattcctgtgggtgcattcctgtcccaggcttgtcgctgaggggacagaggccgtaccgagtttgatgccagtgtccataggtctggactgcgtggtttaagctgcagtgcctgggttagagcccctctgcgctggctgtaactgcctgtgcagaagcccggccttctatgcccctgttagattctcttcctggaaccccaggctcttcctgcctgagacttcccctcatcaatcttatccttcctctggccacttcaagactagagccctgctctgctcccagttcccagccaggggccccaggtttccaccctgaacctcttggctatgggtttgctgccttgaggagagg

SEQ ID NO: 114581 - DNA, 1052 bp, Homo sapiens
ggttcttccaatttatctacccttagactgagaaaggagctgggaaagagaaagaattatatatttatgggtttaaactgctaaattttcctcagttaaaaaaaaaaagagtgtatttgccttttttttttttttttgagacagagtctcactctgtcaccaggctggagtgcactggcactatcttggctcactgcaggctccgcctcctgggttcaagtgattctcctgcctcagcctcccgagtagctgggactacaggcgtgtgctaccacgcccagctaatttttgtattttcagtagagacaaggtcaccatgttggtcaggatggtctcgatctcctgaccttgtgatccgcccgcctcggcctcccaaagtgctgggattacaggcatgagccactgtgccccgccctttttttttttttttttttacactgtgaaagtgtcatttttgtcaaatcgacctaatgtttgccaaatgttttcaaacagccctgtccagagaaattcaatcatgctgtcttcctctgacttgctgagctagcttgtcctgtctttagattaaaatattttccatatgttcagaaaaggtaatgtttatacctgttggtgtgaaagtggcgatgcattctgtgttttgcatgagctggcataatgtgcatttatttctctgttctcatctcaaagatccccttgtagatgaccagtgaaccacctctttcccatagaataccactgcataggtatccacatgaccgctgcactgtgcgtgtgttgttattattaaatatttgacactgtcgtgtaactatttgtttacatagcagtttctttgctaggtttgtcaaggacttattttgtcttcctggaaccaaggacactgccaggcacctggtagttgtgcaataaatgtttataaaataaatgccattcatattacaaagtcttgtagttgataaaatgtgaacctggattttaaaattttttattggtgtatgtctcttgtaggtgcagataggttgaatatacctaatccaaaaactccaaat

SEQ ID NO: 114582 - DNA, 1171 bp, Homo sapiens
gatgaagacttgaatgcaggcgtgtgcaatctcacagaaaacaatactgttccatttgtaaattcagctcgtggcctgtgttagaagtttcaaatgcagttgcttcgtttcagacgttaaagtccgtcgttcatctggctgctgtttggatgttacagatggttctgggaatcattttgggataattaataatagcgtaggtcttccagtgagggtaacaggtagctaacccttgagaattcagtgagcatttcagtctcctggaatgatctgctgttctaaaatgcatccatctccccgccacgtcagagttcacagtgccttgttccaagcatctgcttttgctcctgcaaacagagctaatgacagatgttaactggctgagctgagagacagtcactcttatgacaatgggttggagcatatgctgtcccgagtttcaggaagcttttgtaacaaaggactcaaaagagatcaggcctccagggaatgttgccaacatgcctttgtaaagggcaaatcctgtccgattaacctaatttccttccccgagcagtgataaaccagggagattaaaatttgcagctatttcaactttagcatttatttttttctgatataagatgtatttataattaacatctgaagatagtttatttaaaacatgtatctcgctttattttttttccctccaccaaaaggtcataacttgccttggaaagtaatacatgggcctcatggatgtttggaggtagcaccagcgagtgtagacttcagcatccactccctgaattttggatgttccctgttcgggacattatctgcaatggttaagatgaagtaaataccatagagaaaaaataattcctgccatttgaggaaagccatactcttgagtattcattattggctcattgctatctttgatggagattttaaaatagtttgcagatgttacttttagctacaagaggaaaagcagctaaagccacattttagcacctaggatttgattcgttaacaacttgcattagcttgagtgatggtctgaaatacaaagcaacagtttttttggtttttttttttgagatggagtctcactgttgtcgtctgggctgagtgcaatggcgcaatctcggctcactgcaacctccgcctcccaggttctggc

SEQ ID NO: 114583 - DNA, 1003 bp, Homo sapiens
gtcttgcagtgctggtgttgggcacaaagaaaagggctcatgtttggtgctattgacccctgtggttgctttcgattttgtggttagctttgaaaatttaaattgaaggtaagtgggctactgtcttgtatttttggtccctgtgaatactgaaaataatccgctaattaatactggatgctaagctccgaccaggcagtaatttgtgactggaataaaatagaaaacggacggaatcaaacgtaattcttttatttgaatgcttaaataaatactatgcttttgttgtataataaaattatatttattttaacaaagtcatattttgtgaaaaatgcgaaggccttgtttgggaacaaaaaacagttcagaaattatccctgggaatcagacagcatcatttaatgccggtgtgatttcagaagagaaatcagaggcagtttgttcaatacaggcaattgtctgtctgtgaatgagttgcattccgtttcaaaaatgcattttttaggcctgttatttggaacaagtctttccaaatagtaatatacatggtgaattgatcatccagctggtctgcaaagacctatccaggcatccacagtgcactgagggcagggatgatgctgaagccctcttgttgcctcattccaactttaaacgtgtgtttggagttccaacccagggtgccacagttctgacattagggaatcccattcttcccgtggtcccctttctgctgagtggtgggaagaggggcacccagttctaagccatgacctcctcatagttggtgaggatgagggccttatcagggttggcatttcggatgggtaaaggggagagattgagatttgctgggtgacatctctccagcaggcaccatgctggtacatgccaatctgtttgtcctgtttaattcctgtaagtatcccatgaggaaggcaatattaaccagccatattttaatgagatggcaattgagcctaggtgtaataacacgtcc

SEQ ID NO: 114584 - DNA, 1065 bp, Homo sapiens
actttgacctaagagaatgggagccattagtttctgaagagttctcaaagagggtgaaggcttgttgagacctagttaaacttctggtttctggagcccaactgcctgtcatgcactcgctcagtctttgtgatgctgggcaagttagtttacctctaggcctctggttctccatctgtaaaatgggaatggtcatagtgcctgcttcatcatctcaaatgacgtaatccacctaaatcagttgcatggtgagaacacaggggctagctactattttcttagtccctctttgccttctatgtctgatgggactctcagtcacacttgtggatagtaaagcctgtggatgatgctttgcgaagatttgttctttgcttgagaaagacatttacttttcaagaagattttttttaaaggaatataggagttagggtaatttcgacagtacagtttcgccacaaaatgcaatccaaactcagttcagtcttgtttgttttgtttacagggaacacgggtctggctgagagaaaatggccagcattttccaagtactgtaaattcctgtgcagaaggcatcgtcgtcttccggacagactatggtcaggtgagaacaagtccctgcagcttcccaacatccatggtctgctttgtagctattcgtgcccagggcatgtgtgcttggcccccctacacatacacacgctttacatttttttcctaagtgataattcaaaatcccagtgggaatgtagaatgtaaaccatgtgtgtgtaatagatacaatacagttctctcaaatggaacacagcaaatattccaactagtgtggggacagaagggcatggcactggcctggtttccctcctgggtatcttttctgccttctttcatctttttcagctatcagaagtagaggatgcaagtaatttgagcaaaagttcaagtatatgatatttgctgactgattaacttgttactttctcttaaaattcttaaactttcgtagtgtcttagtcagtttgggctgccatgacagaataccatagactgagtgatttatgaaga

SEQ ID NO: 114585 - DNA, 1070 bp, Homo sapiens
ttaaatgcgtcagtggccacctctgctttccatgaagcatttctgattatccactcaccttctttctcagagttagcctctttaatccccacagttcctgggaggtagattgtatttgcttttcctctacattcgatgaggaaatgaaggcccgtggaggttcatttgtccaaggccacatggctaagatgtggtaaagccagggttcctgtccaggcggtttggccccctggatagagccattatcaaaaaccactatccttcggtctagccaggaaaaaaaacttcagacagcccacagaggagggatgtttcacagaatacctgaccagcatttctcaaaaccgtcaaggctatcaaagaaggagcatgacgattacatccaatgtcccagaaggggtcctgggacggaaaaaggacattaggtggaaactggagaactctgaatgaagtgtggcattgagttcatggtaaggtgccagtgtcggttccttagtgtgataaatgtccacattatgtaagatataagaacaggaaccagagtgagaggtgtacagggactccctgtattatctttgcaacttgtctggaaaatctaaaactattctaaaatgaaaagtttacttaacaacttaatgacaatgccaccactaagcccactgcactccactgcctggctggcttgtcacacactctgggtaccctcactcctcgctgcctggtgcccacccactgctggggagaggctgtgtcctcggagaagagtcccctccaatttcagcacgtaacagtgacggagggatataactagggctagtcacagggccatcagaagtgctgcccccacttatttatttatttatttatgtttttagcagtgtagtctgttccaaagtctctgttgaacccaacaggaggtgtaatatggagagaaatgaaaatgaattttgctgtaggagggaaataattttctttttttttttttttttttgagacagagtctcactccctcacccaggctggagtgtggtggcacgatctcagctcaccgcaacctctgcctcccgagt

SEQ ID NO: 114586 - DNA, 1907 bp, Homo sapiens
ggtgtgtgggaagggtctgggagcttctgtgctctccctaggtgtgccaccctccagaaacccccatgtgtccagctgtccggaagctctgtccttttgggtttttatagaagctttatgacgcaaccatgactgatttctttcactggttactggtcaaccttcagcccctttcctttccctgccttggtctttcctgtgagcagcccccatcctgaaaccacctaggggctaccagccaccagtcaactcatggcatacaagacacttacactttgaagattgcaaggatcttagagttggatgtcagaggacaatgacgctgaccaaatctgtatttcacaataccccacaacccagcctgtcattttcaaatacttcagctcatggaacgcaggtcctcactcccatctaagcccataatctccctttgtattttatgtgcacttcttatgtcattcctctctgcactttattatggccactttctgttatttacaaggtttttctctgattaaactgtttgagagcaggctggcttctattcctttttcaggctgttgagcagttctctatgccaggtgctaggctggactattttctaatatttgttcccttatttaacctcttagctgctttgtggactgatgcttattatctgcatttgtaaaatattaataggaaagtggcttatgaaagccaatcagtaaagctatttcaaaaagaggagaaaaactgaacccgtttaccacctgttagctctgggaccgtgggcaagttctttatctgctccatgcctcgtttcccatgtctgtaagatgggagcattattattattattatttttgaaatggagtcttgctctgtcgccaggctggagtgcaatggcacgatctcagctcgctgcatgcaacctccgcctcccaggttcaagtgattctcctgcctcagcctcccgagttgctaggattacaggcatgcgctaccacgcccagctaatttatgtatttttagtagagacagggtttcaccatgttggtcaggctggtcttcaactcctgacctcatgatccgcccgccttggcctcccaagtgctgggattacaggcgtgagccatcgcgcctggtagggagtgttattagttactcactcacagggtgttttaagaattaagcaagttagtgcgtgtgaagcgtttaggacagaggcctgcacatggtcaatgtgtcagctgttaggattattctccaaggttacgaggcattgggagatcagagcctggtctggattcagaagcccatgtccttgccattgaattccatgtccttctgggcctggcactgtgccttgtcagccacgagggctaaataaatatttgtagcatgaataaatgcatttgaaatttttgatggtggttgttctccaggtgaaatgaatttacttaaaagatggccctgggcacggtggcttacgcctgtaatcccggcactttgggacgccaaggcgggtggatcacctgaggtcaggagtttgagacaagcttgactgaaaccccatctccactaaaaatacaaaaaattagccgggcctctctccggtccatgcttccaagatgacaaagaaaagaaggaacaatggtcgtgccaaaaagggccgcggccacgtgcagcctattcgctgcactaactgtgcccgatgcgtgcccaaggacaaggccatcaagaaattcgtcattcgaaacatagtggaggccgcagcagtcagggacatgtctgaagcgagcgtcttcgatgcctatgtgcttcccaagctgtatgtgaagttacattactgtctgagttgtgcagttctcagcaaagtagtcaggaatcgatctcgtgaagcccgcaaggaccgaacaccccca

SEQ ID NO: 114587 - DNA, 1054 bp, Homo sapiens
aagtttgtcacaggcaggaatcatgtggaatggcagcgaaggaaggcggcatggccagctgttgggatcggcagagctggctctggcagtgggcactcagccaagccgcccgcacttcctataaaacaccctggtctctacccagcttcccgtaggtactgtaggaagaaatgccaccttgaacccttggcccagcttgcagtaccatgctggaacattaaggtctttatcatttggtcaggatcggacagacttgctcatgttcctttgcttttcctgccccaccactgaagttggtatcttcaggtgtgtttccagggaggagcccaggttagctgtgttgtattgtttcttgtcttaactgaaatcccataaaaggggctgagtgtagtatcccacgtgatccaggtcattcctcctcctggtgcctcttggctccctctccttcttgtctttttgtctcgagcaactgtatcctaacctcctccctctcttgccacatggtggtctagtctttgcctggcctgttgttcttggagctcagaattttgctggccttatttctgaacttcagctcatacttacgtatcctggttctcacttgtctctcttgttctgactcaagatgttgcaggctcctagccacacccaaaccccacattgcacacctacgcttgctttgtccactgcctggggttggctgtgtttctgtaagcaggcaggtcagtagcctgtcttccactgccagccttccctggcactctgggcactggccacctccacagtggcagatgcagttttgcaaaagtgacttcattcacaaacttgagaagaaggaaattctgcgataccagggtgaaaaccaaaattaatcattcagtcttgagctttagacagccatacacgtatatacaaggagaagcagaagattgtagtttgaaatgttcatatgcaattcataccctaaaggcttggattccttctagcattaccaactatgcatctctgtgctttattgctagaggagacttgactattactcaagatttgattt

SEQ ID NO: 114588 - DNA, 1025 bp, Homo sapiens
gcgaaggaacagacaatacggacctgatttgtatatttctgagatgaaagaaagattgaaggggctgacgttagcaatctacactatattctttggacctcttcgtgtcatctaattattttagttaattaccaacatttttgttaccaaccctgataatgcaagaggcagcctctttgaatggggtacgtgaacctttaccagtgaattcatatcttttttcttttccgtttctcccaattttgatgagtaagtgtgtggtttttcttcttaattttcatcaagcctattgttttcttgccagccacagtgatgaatcactctaaaagcttggtgagggcagttgaatcagcaggcaaaacttttttatttgctgaaaataaatggaaggctgcttataggttcacacccttgctgctctcatcaaatcttcaggcaggagggaaatgaaattggatcatcttaaacttcctggatttaatctgtgatttaggagtgagttctttccatgcttctcctctcctcttttcccttcctagcaagaggagaaaaaaagcaagtaatttaatgtaatctgatttttttttttttttttttttttacttcatggctttttgacattggaagagaaatgagccatctttctagaggagctttagtgtcatgtgtgcttttcttattgattgggaataacttaaaaagactcctcagaactccgaatgggatatttaatttgttagaacacgagtctgcaccactatctgttgacggtgaaatgaatttactaagtggataatttgctgagcattagctgaccctgacgtggcggaacgaaggtctctggagatggttcatggtggaaatctgggcttgatgggtcggtaatgagacttcagcgatgacatctttaccaaggctgaggcttaacactcgggaccaagcgattcaactggtaagcgacatgctttgaatatttactcaccagctctgttaattcagattcaggataagaaatgtatggtgag

SEQ ID NO: 114589 - DNA, 1031 bp, Homo sapiens
cagtgagcagagatcgtgccactgcactccagcctgggtgacaaagtgagactctgtctcaaaaaaaaaaaaaaaaaagtgataaagtgatagttgataccaaataactcctgccaatagaaattcaaagttaatatcactttccacccacgaccatgatttgtactttatttgaggagtttctgcatatttacttatttttttgccattttgatgtgcaggggtgtgagggtccaagagtagtctgcccattcttcctgtggctgtatcatcaattatatgacaattttaggttgtttctagaaaacagcgcatgaacgcttttgtacctaagtcattgcgtgcctatttgattatttcctgaggagtaaaatttcccgggagtggaaatgttggatcacaaagtttgcagattcttatttggattatttggcagtggaagtttcatgagaggtgtcagtgcagctggcagctgcgcagctgagagaccctgtcatgatgtatttatgaccccggggattttgtaactccttactagaagcttaaggaaatacattgattagcggaggaagttagctcatgatactagattttcatttccatttttaggtcttctgtgaaccaggagaaggccatcttttctgttaattgcaaacaaggctcttgattcacatgctccattcatctcaccccccagcgtggttgttgatgttcgtttaaggccaaagcacactcaagggactaggctgtacattgcctggggagccagtggacattcatttggagaattatttgtatggagttttactttagttttttgagacagcgtctcactccgtcatttaggctggagtgcagtggtgctatcatggctcactgcagccttgatctctttggctcaggcgatcctcccacctcagcctcctgagtagctgggaccacaggcctgtgccaccttgcctggctaatttttacattttttgtagagatgaggtctccttgttttgcccaggctggtctcgaactcctga

SEQ ID NO: 114590 - DNA, 1025 bp, Homo sapiens
ggcggggcgaggtcgctgggctgtagtcccgcgggcgagagctggctgagccgcggcgcgggactgctcacctccaagcgctcgcgcggggatcgcggctcctgctcactttgcggcccgctgtcctcctgcccgccccgagggcccccggccggagcgcagagggagggggccgcgctcgccagcaccccgccgccttcccccgcctgggggaagaatgtgccaccagctgttctccgcttgcgagcgctgcgcccagtagtgaggaacttggaggaagaagagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgaggtaagtgcgctcccagtccgacctggcctccggagcccagggagagaggcgtctgcccaccacgccgcgcgccctgggtactttttcctaagccctggaaggcgcaactttctgggagtctcctgaaatcaccccccatccccccgcggagtctctgatgagtaagcccgggcaggttttgtttcgtcctgtcccgcgctcgcattttgctccgggaggtagcgaaggtgcgtttccgtttgcgtgggtggctggctctcggggcgccctgggacacccgcgccaggtgaggcggcgcgcgccggggcgcgggcggggcgatccgcccgctcgactgcccgggtgcaggaagcccaataaaatgttcagcggggacctgcctttctccaagaaaggtcttgtctggtatttcctttgcaaaacgtgcgggcttcctgtgcaggggttcaaacacttccagaggagacggcttaatgaagtgtgagaaggagaggcaaggg

SEQ ID NO: 114591 - DNA, 1494 bp, Homo sapiens
gcagagggagtgcagggggtggggagatggagctggagggggtggaggggagacgggcggggcgccgggctggagggaggggagagaggcgggcggggagcgcgggaggagggaggctgggcgggcggacgcgcggggggagggcactgggcaggaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccggtaaggaggcgcgcccggtggccccgcgccgccgcggacccgggggcctccgtcccccaccgcgccgcgccccgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaaccgcattcttttcatgaatattcatcgaacgcttggccaggctccttatctgcgtccccagagacatttccgccttgaaacgaactcg

SEQ ID NO: 114592 - DNA, 1139 bp, Homo sapiens
gataaagtactctttatgtgttttggggtaatgtttttggagtggtttctcaggaaatcgtataaagactggatttgaagaatctaataattcctattttggggttgtaataagaactacatatgatatctaaaaatgacttaagtgtggaatggctggctctgaagggctcctcaacctctcagtctcaattagtgatatcaattacactgaaagtgttttcaacaactgaaagtgtcaatcaacactttcagtgtaattgacatcactaactaatttcagtatattcagctgtatttttgttccagcttgattaatgaagcccgggggaccccaggagtattaagttagaagtaggatgtctcaatcctaaaggggaccaaatatcatggttcctattttctgtccttgtgtttgtagatatttgaaattctgtattatatgggaattagcctgaaagtggatttcatgatatcaagatggccaccttccttgaattccccaggtctgcttatacttatacttatgtaacttaagaagtggcatttaagttctcttgagaaaatacaagggtagtcttgaaaccacagcagtgcccagcctgccaaaggaaggcttttgtgaaacgcctttccagccacagcctttgaggcagacgtctaggtaagtgtcacatgagaacagatgtctggtaaatgctctcaagagtaaaaatcaaccatacagagtccatttctcaccagaatatagttcaattgtaattttgaggagccacaagcctaagaaggaagcagtgtgattaaaacagcattctccttttccctctagaagtcagaaatgggatgaaatgggaggcagagagaatgaaatagtgtgtttttcttctgcaccctaaggatttaaataacataaaaaattatttcttaatgttttacagactttccatactcagtacatttttgaacaaaaatagggaaagctgagattttttgactcaacaaggccgtcagtgctgagaggtggtgattgagcaggcttggaagtctaggaatacattcctgaaagctttagagatttagaaatagaaaccatctgcaagcaccacaggggcccagggcataaggaaacacttcaggata

SEQ ID NO: 114593 - DNA, 1020 bp, Homo sapiens
acataagtggcttattccattcacctctacttttctattgtaactggatttatttctgccatccagacagagagcctgggctttgatttcatctgtaccaaagttttctgggtggacaggtacagggggtcatcgtaagagaactcaactgaccacaatgcagagagaggtaactatccaatggaatggtaacatggttccactacggtaagaactgtagtgttaaatgaaatgaattcttaatgggaaaggagtcctatgaatatttctaagttgttatgtttaacttaactaactcttaaatgcagggaatttaacttaaaagtgaatttaacaaagaagtgaatttaaaagccaacaagcttcatatctctccacctcaccccaaacccgtgttaattagcccttcttgcttaaatcaaatcaccttgttgaaatttaatgctgtgactagcaatgtattctttgaccatatccttgtttccagcaacaaatactgccacgttaaggggagaaggaagtgatggatagagggaccagttggcagattgggacacacgtacaaacactattcctttaacttgctttctttagatccgtagttcctacctgtgagtctcatttctgtattgatccgcattggctaagcatacgactaaagcgggattctttgtcttttcttcagtgagctagccaggaatctcagaaaaagggcaaagaagtccagaatgatgtaatgctgcaaaaaatgttactgctgtttctaaggggagtggaagaaacccaagccagttttgagttgagtgtgcttcctgttggaagggggtgagaattcagagatgtatacctattaaaaaaaaaacaaaactcttaggatatcacacagcgtggcaaaccagcaagccctgacctgttagcagttgtttgcatagtttaccaggtagagaaagcatccacagatagaatcaaatgtttgaggacactaacgtgcactgtggttagtgtgaggtttaactggct

SEQ ID NO: 114594 - DNA, 1050 bp, Homo sapiens
gggaagtgtgtgtcgggaatcatggaaatcctccatgactatagaaaccaaggctaatgaattttggggcctttccaagcaataaaacaagtagtgatacttacagggattcttttgaggggcattctcaacaagtgtgggtgtgggtaagtctacacttaacccttttgagagggtcctttttattattatttcattttattttattttttgagacaggggctcgctctgtgatgcaggctgcagtggtgtgatctcatctcactgcaacctccgcctcccgagttcaagcgattctcctgcctcagcctcccaagtaggtgggattacaggtgtgtgccaccatgcctggctaatttttgtcttttgttttaggggagatggggtttcgtcatgttggccaggctggtctccaactcctgacctcaaatgatccacccgccttggcctcccaaagtgctgggattacaggccactgcgcccagcccgagagggtctttttaaaacagtttacgacttttaggcgtaccctgtcaagtaattcagttattgctttcctggctcaaatttaaggtcacattacgttaactctggcaatacaaatattgcctcatgaatccccagtgaaattgagaattaacaatttaattttactacactagataaacaaaccactggtcttaaaaataattgaaacgatgctgtttaatgtcttttataacaactttcactgaattgttttctacataaaacataggatgtaagttattgtagaatttaaaaattttaactcttaaaatttatgcagtgtctattttcaatgcaatgtcagtgaggacctttagcactcactttcctggtagatagcaccttcttccaatcatgccagaaaactaggcttgtctcctggaattccccatatggcctccttcctgggtagtgaaactcacatatgtccatttccctctacttgaagccattaatctagtggaagcttctattctctcctggatcactgccctaatactctcctaaatccaagcatgacat

SEQ ID NO: 114595 - DNA, 1059 bp, Homo sapiens
cctggcactgggcatttttgtccctgcatttgccagaattgatgagattatgtaacgtctctgctcctctagattaaaacatccaggaggcagggatgtgtctgttttgtggacccataacagtgccctataacaatttctgatccataccaagcaccccatgtctgttcagtgttgaaggttgtctacagtacattatgttcatggagagcacgtgtcttctgaacatcgcctttggcagctgagatgacttccataaatgggccaaaatttcacctcatcagttgtgcttactatgaagatgaatagctgatgaactccaattacagtaattattctgtttccaggcaataaccttagcagtagttgttctaaagccctgagacattacaagtaatgagtactgatggctcatgcatctgagtgtcctcccaaggtagagtccgaaatgaaaaatgaagctgtgtattatttgagggagacaaatagtattacattgtgggaacctttcagaaacacaacacgatgagtgaaagctgaggatgattgtggttacactcctcgtctgtccttccaggttattgaatgcttttggtctgctttggatcaatcattattgaacaacttaactgaatgcattttagtaacagcctttgtgaagctgcgaacatcaggtccctagaaaagcaggtggcttgaaatctttacacattagtcaattataaacctaatgaagtaaaaacgaatttagctctaattctgcgctgtgactacttactctgcatcgtgagttctacgaggttaggaccttgctttgttcatctttggatgtcagtttctagcacctaaccgaacctgtggtccagtaaagggctggatacgtggaagggcatgtttcatggtcatgtgacatcatgctgtgcaaataaggcacatttcagaacgctgtcctttactttcacatccaggaaccagcttgtaacgaacctttggcaaacatcaccgtggatttttctttttcttttttttttggaggaggaggtggggcacaactaagac

SEQ ID NO: 114596 - DNA, 1036 bp, Homo sapiens
gtctcaaaaacaaacaaacaaacaaaacaaacaaaaaacaatactggaaaatacaaacaagcccaaggagtgattggtagatgtttagagtctaccatttctcgacttcaggaaatgtctgtgtgtatctcagtcttctgctattgtaggcacacatcatacttcaactgtatgaagattattctattcctgctctataaatatgttattggattggatgagcaagatatacacttacacatttgaagccgtaagtaaaaaaaaaaattatatagttaaaaggtacaaataattgcttttgtgatgaatttgttctttaaatgaaacatcagtggcatttgttcatgtagttctcagataaaacttcctaaaagtggttcaagtgatttcaaaatgccaagaatatgttgcaaacttgtttttttgtatacaaatgaacagctgacatgaggtttttctaccatgtgaatgtgacgtgggaacatacaaaccacactaaaatattgcagaattgatgtttgtttattgatggagttgggagacgcatctcctttaagtagcttacagtgggtgaaggcaaacaaggaaatcagtaattacagcgaagcaaatgttggtccgtagatacatggggtagagatataaacagcagatagtcattaagtttactactccgatcaattatattctttttcttcaatctgtccctagatccacctcttttgcctgactaagccatgtgagatattccagtgagatattcaattggctattatttaaagagttttatgtgaatatcactgtagagaatatggaagaattcagcatcgattacatttagtttaaaggtcttaatcactagatagaaaagagatttacacatcttaaatttccattaaaaagcaggcatttggggattagaaactgaaggaaaagatttccaagagtagctagttcttaaaacacagtaagaatatgctttagctcttgaacacagtgtttgtagttactgtcagactccttggggaagtgtctt

SEQ ID NO: 114597 - DNA, 1406 bp, Homo sapiens
ttaacattagtgacttcggtatggctcattttgaagaaagaaaattgcctaaatctatagttgagcttgcacacattacaggtctctggaaataagatgcttaaacaggttctataatctggttcttgctaggtgagtgtcccctgacattgcttttttttttttttttccgtgatggagtctcgctctgccactcaggctgtagtgcagtggctcactgtaacctccacctcttgggttcaagtgaatctcctgcctccacctcccgagtagctgggactacaggcatgcaccaccatgcctggctaatttttgaatttttagtagagacagtgtttcaccatgttggccaggcttgtcttgaattcctcacctcaagtgatccacccacgtcggcctcccaaagtgctgggattacaggcatgagccactgtgtccggccccctgacattgctttctaaagtaagattacctgtagttctcagtgttcgccaagcatgtatgaaacacaacgtatgttaagaggctgtttaattacataaatgcttatttgggggattcttgttctcagtggccttctctcttttggatggatatacacagtttgattggcactcctattgacactttatttggtttgtgacttgtttgtctcggtgcctttctattaatatattttttctatttaaactaccctctttttttcagtacagcactggacattttctttgaaatcttccagattcatttggttgtcttcctcatctcagctgtcttatgcaggaaaagtggtcactgttcagtcaattcattctacgtagctggctatctgagttttttttttatcgaaaccaaaataaaacttaaaagaaacagaagaagctgagtctccctcccctccctttcaactaacacctactgatgtttatcttggaaataatttgacgtctatttgatgaaacctgtagttaagtgttaatggagactaacgtcaagcttcagaacagtgaggagaaacctttagtattgtgtgtctagcatttgatgcaagtgctctgtggaaaccatggaagctgggataaaaatgctcgcctgatccccagatagtctcatctgaatgtactgaggcatcaccgcattcattccaaatctgaacctgacctacttttccccttcatctcctgccatctcttccctagtttgtcatcttcttttccagcaccacgaatggttcatgctttctgataaatatctgatgtatggcatcaattatatgactatttaaacatgactcatagtgaactgtatttaaatattgatatgactccatgcgttttcaaagaatgtgtggaatgttctttttgagtgtcagttattaatcatctgttttccgttcaactttggtt

SEQ ID NO: 114598 - DNA, 1778 bp, Homo sapiens
cctgggcgacagagccagaccctgtctctaaataaataaataaataagtagatagataaatgccatttggatttctgaaagcaaggtttgtcttttaaatgtcagttggatttccgaatgttggattcttaaagttctgaacatgtaaagtataggccactggatctcagagctttttatccaggtgcccagaggctgagaaaatgccccataggttctataaaggacatggatcctgacttcatacaggtcaacaactatgttactgtgtttttatctggtttagaggatgggaaacccatcagtgttattatgccttcattcaattatggaagaaatcggttgaataccagactgcccaatgaatgtagtttctgtatattttcaggcttttagactgatctgaagttgtgcctctatgcacgaatgctgcttcttcaaaaggtgccagtggctgggggtcaactttgatgtggcctataaagttcctggcccagcacttaggcctgcctttcaggacataacctctcagctggatttaagaaatagcatctctttcagtgtgaggcagcggcaggaatgaagtgtgttcgtgtccgtgtgctggcgcttcgtatgtacatttttgttgcgtctttaacttagaaaatcagtagactttatgagtatcagaggataaatgtactgcagaggatgagaaaatatttagcgtttttgtggtctctcttcagcagtgcctccctctttcctggaaaagggcattggtgaccagagaaattgtgattctgtttgcatcctaggccaccatggagttgacttatgtgtagactggccatagcccagggtcatccctcccctctctgtcttgttctcagttgcttgtcatcatttccattcaaacacttgaatattccagatctgggatagtgggcagatggtttcatgctattcaatattctagtaaatatcttttcaatggttacctgtagtcagtcacattgtcagaattctcacttcagctatacgtgtgacaatcccttggctcacacttaaatttaacccagtgcttgtaaactgtggaaattaaaggacctagttgataccaaatgtccgttatctggagtagcctctgtcggtagctggatgccttcatttgatgtgaaaacaattgtgtcatagttgaaaataaaagaatgtttttcagcatgtgctgttgctgtgtgctggataagacttttataattaaaaatttcccctgaatgtcaatacatatatggtattcattttatagtggactatgctgtgttactttagagaggctactgctgcagaaccatcagaaaatatctgtttcagccccaattggacatgactctcgggtatgctgttgtttaataatcattacattagacggttcaatctttatccaaagattggacattctcattgcatacatttgagggttaataaaaccaagctcaggcacttcggtattcttttaaactctgaatgatgtcccctgtagaatgtgaatgatttccagcccgtgtttaccatgtcctaaaacacgcatatttatgggtgcctacaagatggcacagaatgaatcaaaaccataatctcttaaaaaatatgtaccacactgcagttgtgcttgttgataatttaaaaagcacgtttacatgtggtgcgcctattctaggtctccttgatttccttcttccctttgtaccaccactccatgggctgtagcatcctttaagtatggaggccctgct

SEQ ID NO: 114599 - DNA, 1034 bp, Homo sapiens
ggtgccctgcttctagtgcagtgcctggatgtttgtgtcatttctcaaataaataagtgaatttgagtgctcaatagaatctagttgtgtgtatacattattactgcacgtttgtgcaaaaactaaaaattatagacataaaggatacaattctagtcatttatattacaaatgaaataaccaaccctgggaggttaacagtggcttgtttaatgtcagcagctagtttagtggctgtaacgagactgaatcccaagttgaacagaaatcgtttaaaaattcaagttttaaaaatcaagtacaatgaatgatattggctgcttttctaaggagagtgattctctaagcctataggaaaaaaatactggtggctgacttgtggccttaattgcatgctaaggttgaggaaggatctccagtaattctttgctttactttgtgtttgaatataggattttatagctgtgggtggaaaaaaaaatatttctagggaaaaggtttcctgataatttaactgaaccccaaacaagtgaactgggtgaaacagaatatggcacatggtcctttatcacaacctttctacctaacctaaagccagtaagatggaaatagtttggaaaagacactatctgctgaggttgctttaaatagagtctctcctgggacttagaacacattttgaggctcattctcccttttgatagtttcttggagacatttttctgtatatactggatgcaggcatttgtattcctggatggcattcatcttttaccagtgtgaggaggctgtttttatcattgtgagatttattaacatttacttgctcttagaatctacagattatataacagatattgcaggctataacctagaatttaaatattaaaaagagtgattaaaaaacaaaacaaaaagagtgattctttttgttataattgaatcaattcctattgtttacctgtgttgaatacagtaattggtcccaccgatcttttacttaatcttgaaattcagagttattctctattcta

SEQ ID NO: 114600 - DNA, 1010 bp, Homo sapiens
tgtgcatttccttatctcagaagctcctaaaaccatttataatgtagcaagcctgtttgctttacttttgcataccggttgtttcacacaataagacctctccaggtttagtggtcactgtggcagttcttcagcattttagttgttgaaatgtctgtccctttcccagtacttaagaaatcctaagtgttgtaatacgagagtactatgaaggtaaatgactgcagaatgaaatactgtaaggtaaaggactatttcaaagagacatgatctaacgtttactatgtggagatcttgtggagccattactctggaataattcagatttaaccatattcatgtaaaagagagcatgttgagttggaataaccatcagatttggaatttatctcattggcttctctcccccccaccgtctgcataacaaagtgttccacttcagcaaacatctggacttaactttctgaatctcccagaactttgcgctgtcaagattcctccctcaactttccactttagttttgatttttatcctttgtctcatcctatcttcccatagatattttcagttcttgcaaatccttgtaaacaaataaaagtcttgccaaaattgcacgtttctgccgttaccaacactctctggtattgaccattgtggctttctcttctggcgcctcatgtgctctgtgagccctttcaaagaggcaggtgtcttcactcctttatcgaagtgactctagggtccgttgttgacagcccatcaccggatcaatttgcgccatctcttcttatcttttgtaacctttttgtagcagcatatgcctcctccaagctgctttgtaaaattttctcttttgattttttgagacatcatcttttcctttctaactcctacaagagctgtttttctgctttctgtcatctaagtaattttccctattaggcaacctttatagatttagagtccatcttttctcactccaagtatctgagagtcctctccttcctct

SEQ ID NO: 114601 - DNA, 1073 bp, Homo sapiens
tattacaatttttgaataaaatgtggtaagataaaattaaggtaatgaacattgctcacctcagatatttatgcattttggatttttgatgagagatccccaaagaccctgtgccagtgcatctgtaggactagactgggcttcatgaagaataatggaggcgtttcttgtgattaatcttcttttgtattagggactttctgactttgtagatccaactcatctggatcacctctttgggaaaatttggttgtagaaatgtgagtgtgtgctaatctgtgtatgtgtactttgttccctcaagtttgttgcatatctttatcatacttttttacagtgaggaacatttttattgtgacaaggtaataaattgtctcgaatgttttctctaaatttttactcatgatatttcaaaggtttacctagaaacttagacatgggttggcacctcttaggacagtttcctctccccagaggacatctgcatcctctaaatgatggggatgttattagaattgctaaatatgagccttggctgaatcagacaccgacaacaataatttcaacaatggaaattgccaccaggcactgaagacttgacaagtcactgcgacagagcacatactggttggaatactaaaaatacacatgggctgcattacctttatttcattttcctcttttagaataaaaattttgacctttaaaagaaaagggccagtcacttgttgaaaatagaaattgctggacataaatattttagatttctttcttctgacagtattgaaaatactttgtatgtgttgtgcttttttattgtttgtaaattcttttctttatataaaaaagaattttttccctcttattccaacatttgcttcaggtaggtttgaccaatatcttggattctttccacttgtgtaattataaacccaacttgttggtgatggatttgcttgtagatgcaactcagttgtaactttgtgttacttaaaaaaaattgttagtggattggctggtgtataattcttgttaacctttgcagctctgaattagtagatgatagttgcttg

SEQ ID NO: 114602 - DNA, 1166 bp, Homo sapiens
agtgaaattatttgctattaagtgtgtacagaggggatcctattatagtttgtaagaattgtggttttttagtgaaattcttagctattaaaatagcgtgtacagaggggatctggacccagtgtgtcctgtggattctgtgtacaaaataaacacagcagatgatctgaagggataaggaatatcttctgtgttccctgacaggcttcctggagaaaaaggaacaagcaattggaaaactcggtagaggagattgtctctattacagagtgtcttcattataacatcagatttcaaattatttctcacctttactctcccaaagaaattttcatattaaatttaagctctcaatagtaagaaggagtttactggtttttctttttggggggtttgctattatagcaatgcataggaccacatatttttcctataaatagaaatttctgtaaaataagaaatacttgttagctctaagactcaacagaattgttttaatttgctttggaggaagaattaaaacctattttttaggcctatgttcattctttatttttatttattgattttttaaccagatcctctgaagacactaaagtgtagttgtctctgaggacaaaaacaaacgaacaaacaacaacaaaaaaacttcaccttaccttgctgacctagctatgaagttgctcttttatggccttcctaggcatgaagaagttagagaaacttgtctttaaaagtttcatgaacgttcataaatgtacacgtttatttattagggaacatgatttgctgccaataaacgaaagaaagatttgtgtcaggactgagtgtgtagtctaagctaacatcagttgtaggaagtgagactcagaaggtgatgggtatgtattccacggatgcaaacactttttgagtttcctggcaggtgtaggcaaaaaaggaccaggctggtgtgatgaataatcacttccaaccctccctctgaccttttcaggcctccctctgatttgcctgctttccagcccaggttgctctgatcaactcacagtgctcgaatggcacactctcttctctcttcaccgaaaagcagaactttatcacatttcttccagaatagctgtttctagccaggtgggattaattggatggaggcttggttttataag

SEQ ID NO: 114603 - DNA, 2016 bp, Homo sapiens
gtgacacattgttttaaaaactcatttaaaattattgcagaactcacttaattgagctccttaatgtttttgattctttttaaaatttttaacttttaattgtgtaataacagtgtaatataataatttaactgattacttgggcgtggtgggtacacctgtgggcccagctgtgtgggaggctgaggcgggaggatcccctgagcccaggaggtggaggctgcagtgagaagagatctcaccacggcattccagcctgggtaacatagcgagaccctgtctcaaaaataaatacatgaataaattgaatttaactgtgcctaactatagtttaccatgccacccctttggggtgtgcagtgcagcaggcccagaaccccttgctttgcaaaatgcagctttttgtggtccccacacttgcctagtaaccgccgttttgttttgttttgtgtttgcttccagaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaagtctgcgttcattgcagttccagtttctcttccattctgtgtcacagacaccaacacaccactcattggaaaatggaaaaaaaaaacaaaaaaaaaacaaaaaaatgta

SEQ ID NO: 114604 - DNA, 1051 bp, Homo sapiens
gggggatcttttttactctatctactaattcaaaaaaacattctcatagacacatctagaaatcatgttttatcagctctgtgggccttccttagactagtcaagttgacatgtaaaattaaccattatatcaatcaattaaaactcagaaacctaacaggttactgcttacctatcatcatatgtggtaaaaagaaatacatacattttaaatttggtaacattcttctaaaaagtagtctgttgtggaacactgtgtaataaagcaaaaatggaataagagctatggaaaggtggaaaaatgtcttactgaatttttcagagaattgacttacttcagctagtgtaaatgaataagtaaatccatttcttttcctcctatttctgtcacatttcttgtgagaatctgattcacattcggagtttgaaatggaaaataaaaatagagcactgtttgtgtcagataattactttccaaattctgtaactgaaagccagttgggactggaactgtgtttttgttcctgtgaaacagaaattctgtcatgtgcagctacaggatttgactgatattgctagaagttacctttccactcagcgagcatgagtgactagttcatccagttacaagtgatgagaaagctgctaaaggaaagatatttccagaaagttaacatatccttacataatacaattatatatgtaatacatttcttattttgaatttgcatacaactttatcaagagaaatcttttttctttctgcccctactaaatatgtgctgaacagatgtgtgtgtgtgtgtgtgtgtgtgtgtgtgtgtgtttaaaagtcgaattgcaagaatatcattaggtttcctaggagcccacacatctgtgttccgtgagtacctgctcagtgtcatgtctctggaattttacacatattaatatttactaccacacgcactgccactctcattttcaaatgaggaagccaactctttagatgtgctctggtgccgactgaaagatttatgtttctaatctcaaactctttcatgagctt

SEQ ID NO: 114605 - DNA, 1050 bp, Homo sapiens
atctttcaaaagaaatgagtctcaaaatgtattgtgaacaattatcataacatagctgcccagcatctgaaacactcctttatattgctgaatttctaccataaaaggattgatgtggctcatctcagaccacagaagaaaatacgataatttagtagattttattaatgttttcaattatccactgccttcactatgaaaagatttgcatctctttctattgtcaagctgttttaagtgtctctctgttgaatgagtttaatttcctgccccattaacatcatgcttggctttgtaacttgatatcatcaatgaaatgtgagcagaagtgactgcatgcaaggccagagccaaagatttcacagataacacatcattctattctttcaccctaggccttgaattgtgaacagataagaaaggaaacctcagttaacacaaaattgacatataaagtatgtaagaatatattatttttcaaagtgaaggagctatagttgctgcagcataatctgaaagaagctatctaatacacttactgtcccacctaaggcatggacatgtttcatgacttcaacccatcagatgcactgattccatattatgagctagaagctagtgataaagatacaaagcagagaatacgttctgttatcagtggcagctaggttagtcatgtgcattctccaggagaaaaagtatctgttgattgatgctggcaacgaagcaatagcgcaagctgtcctgtaaataaataactagatgcagggtttctgcagtttctgtggtatggttttggctgcagttccagtatcttttagctctagcatcccagacatttctgtgaaataaagatatggctctgatgactggaagagcaccagggtccttggtctcgcaccgacaggattaatgacacagacacacttggagtggttttaaggggcaaaaagtttaacaggcaagaaagaagaaagaagaaaatggcttccccctgtacagagagagtgggagaggggcttgaaacagagaggatccctgtgcgtggca

SEQ ID NO: 114606 - DNA, 1812 bp, Homo sapiens
ggcatctgtaactctgtctttcttttcattcacttcaacatcacttgtcccaccaaacttcagcacaactactccatctgaaagttttgccagccattcattcagtttttccttttcatattcactagttgtgacatctaactgcccaatgatttcttgaatacgtttttcaagttgagccttgtcaccttttccttttaagagcatggcatcgtctttggtcacaatgacctctccaacttttcctaagtcatgaggctgaacatcttcaagattcagggtcaacccctcttctccaaacactgcaccaccagtagcaatagccatatctttaagttggttctttctattgtcaccaaaccctggagccttgactgccacaacctgaagaccaacctttagcctattcaagatgagtgtacttagagcttctccatcaacatcttcagcgattatcaccaaaggcttatggtgagcattggcaatttcaagagcaggtacaatggactggacactagaaattttcttttcactcaacagaacataggcatcctggaattcacatttctgaccttttgatgtattaataaagtatggagaaatataccctcaatcaaacttcatgccttcaataatttctaattcatcattcagtgtttttccatcctttactgtgatgacaccctttcttccaacctttttcattgcatcagagatgatattgccaatttctttgtctccatttgcagaaatcatagcaacctgtgcaatttcttcaggggtggtcacaggtttagactgctttttaagttcagcaattacagcatcaacagctaacatcacacctctcctgatttccactggattagcacctttgctaatcttctggaagccttccttggctatagagcctgccagtacagtagcagtggtagtgccatccccagattcttcatttgtgttattggcaacatcttgaacaagtttagctccaatgtttttatatttatccttcaagtcaattgactttgcaacagtcacaccatcttttgttacgttgggacttccccagctctgctcaataatcactgttcttccctttggctccattgtaacggccacagcatcggctaaaaggtctacctacaccttgaagcattaaggctcgggcatctgcaccaaattttacatctttggcataagctcgagtgagatgaggagccagtaccctggacactggtctcatctggcgaaagactgtgggtaaccgaagcatttctgtggggcggctgcagggcatgcgcgcggcgagacaggttgtcggcggcgagtgagggacagagtgctaatatatcacttttaaaaagcaaataaatgtggcagttgtactataaatggaacatacagacatctgccaaattatgagagcaatacagccaatctatgtctggttcaaataacctgtttttttctgatttaaaaatcaatttgaaatactgataaagtaataaaaatacgtctttttgttaatttctatgattgctttacgtcatcctctgtgtgtggctgtgcatgtggcaataagcaaattaaatatacgtcacaaacatttggacatgagaataaattcagataaaatgtgacttccagtaatggaagaatcatcatgatgcatcattgcttaatttataatggcataacaaagaaatccagtgacaataaccgtctgaagctaaaatggtattactgaaacctgaacattggctctaattaaatactggcaatattgtttgatatatctttacaaatatt

SEQ ID NO: 114607 - DNA, 2127 bp, Homo sapiens
tttatctgaatttattctcatgtccaaatgtttgtgacgtatatttaatttgcttattgccacatgcacagccacacacagaggatgacgtaaagcaatcatagaaattaacaaaaagacgtatttttattactttatcagtatttcaaattgatttttaaatcagaaaaaaacaggttatttgaaccagacatagattggctgtattgctctcataatttggcagatgtctgtatgttccatttatagtacaactgccacatttatttgctttttaaaagtgatatattagcactctgtccctcactcgccgccgacaacctgtctcgccgcgcgcatgccctgcagccgccccacagaaatgcttcggttacccacagtctttcgccagatgagaccagtgtccagggtactggctcctcatctcactcgagcttatgccaaagatgtaaaatttggtgcagatgcccgagccttaatgcttcaaggtgtaggtagaccttttagccgatgctgtggccgttacaatggagccaaagggaagaacagtgattattgagcagagctggggaagtcccaacgtaacaaaagatggtgtgactgttgcaaagtcaattgacttgaaggataaatataaaaacattggagctaaacttgttcaagatgttgccaataacacaaatgaagaatctggggatggcactaccactgctactgtactggcaggctctatagccaaggaaggcttccagaagattagcaaaggtgctaatccagtggaaatcaggagaggtgtgatgttagctgttgatgctgtaattgctgaacttaaaaagcagtctaaacctgtgaccacccctgaagaaattgcacaggttgctatgatttctgcaaatggagacaaagaaattggcaatatcatctctgatgcaatgaaaaaggttggaagaaagggtgtcatcacagtaaaggatggaaaaacactgaatgatgaattagaaattattgaaggcatgaagtttgattgagggtatatttctccatactttattaatacatcaaaaggtcagaaatgtgaattccaggatgcctatgttctgttgagtgaaaagaaaatttctagtgtccagtccattgtacctgctcttgaaattgccaatgctcaccataagcctttggtgataatcgctgaagatgttgatggagaagctctaagtacactcatcttgaataggctaaaggttggtcttcaggttgtggcagtcaaggctccagggtttggtgacaatagaaagaaccaacttaaagatatggctattgctactggtggtgcagtgtttggagaagaggggttgaccctgaatcttgaagatgttcagcctcatgacttaggaaaagttggagaggtcattgtgaccaaagacgatgccatgctcttaaaaggaaaaggtgacaaggctcaacttgaaaaacgtattcaagaaatcattgggcagttagatgtcacaactagtgaatatgaaaaggaaaaactgaatgaatggctggcaaaactttcagatggagtagttgtgctgaagtttggtgggacaagtgatgttgaagtgaatgaaaagaaagacagagttacagatgcccttaatgctacaagagctgctgttgaaggaggcattgttttgggagggggttttgccctccttcgatgcattccagccttggactcattgactccagctaatgaagatcaaaaaattggtatggaaattattaaaagaacactcaaaattccagcaatgaccactgctacgaatgcaggtgttgaaggatctttgatagttgagaaaattatgcaaaattcctcagaagttggttatgatgctatggttggagattttatgaatatggtagaaaaaggaattattgacccaacaaagcttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgac

SEQ ID NO: 114608 - DNA, 1025 bp, Homo sapiens
atcctgccaggctcttaagtgctaacaatcatttcaatactctattaaactaaagtgttataataataggtgggaattgaacaatgagaacacttggacacagaaaggggaacatcacacactggggtggggagaggggggagggatagcattaggagatatacctaatgtaaatgacgagttaatgggtgcagcacaccaacatggcacatgtatacatatgtaacaaacctgcacattgtacacatgtaccctataacttaaagtataataataataataaaagcctaaacacacacacacacacacacacacacacacacacacaaaagtgctataatagaaacactgttgggaaatgtctatgactccgtccaaaagatggaagaattcaagaaaatcatcacaaatgaggaagtacctgagatgagtcttgaaggatgatttaatttttctagaagtggtagtatggggaaaagtttttgtaagccctgaggcttgaaacttcaaggtgagcctaggtagccatatttcagtaaagtcagatggtcagagtgtaaagccaactacttagagtgaataaatacagaaagtatggaaaggttcaattctcatacccagatgagtagcattcttaaaagtataaagacccataaaatgcctcgtttgaggattaatattaatggaattgcaattctagaatgaccgatcagacagccaattaaaagatgcattgaagacggggaaaaaggtgtagagatagggagagcatctgcaggagaaagttacaataggcttgtgtaggaagtacaatgaaggaaatgggaaattagagtagaatatttgaaaggtgaagagataatgaaaaatttcaagattcattgatcatggcaatgtaaaggatgagacaaattagagaaatattgtgaaggcaaaatctgcagaaattagtgggtaattgcatacagagaatcaaagaaagggaagaataaaaaatgacacagatttctgacttctgttttatt

SEQ ID NO: 114609 - DNA, 1050 bp, Homo sapiens
aagttagcatttacatgttctggggtttaagatgtgaaattatctttgtgatagtcaccatccagtcctatcacagtctaacctcagcccctgaaaatttatgtgaatctatatgcaacaatagccaacctatcccggcatacttggaagtctaaatccattatagcacaaactctaaatttataatctcctctatatatcattaacccagaagccaaaattgataatttaacttagatatgcatgagactttggatatgattcatcttgaggcaaaatttctctccatttatgaacctgtgaaaccagaaaacaagttatctgccttaaaaatataatggtgggcttggcataagatagatggccccattccaaaaggcagaaattgtaaacaatgaaaaggttaccagtcccaagcaagtttgaaatctaacaagacaaatcccattaggtttcagggtctcagagtaattaatcttttgtaactcacagctcctttctcttggcctgaggctcactcctgtgggcatgagattccatctgctttagtttctacacccattgctccaccagcctctgcctttgagtaattcttccttttccttgaaggttcacacacatttacagctgagtagctctatatttctgtttgttgcctgtagatttttgaaaatcctgcaattttctgtcatattatcatcttacgttccttttggtccaagctagcagtatgtctgctataacagtctcaaaaacctagtggttctcctgtgtgaatcacagtgattcatatcattagacgagagtcctccatagattttttttcctctggataataccatttctattctcagattataatgagatttaaaagtaaatttttaatttgtaatcctttggcagaaggttgtccagtaatatctttggacttctcttaacagcacacgtttccaacagtgaattttctaattgtagtattctttgcaatttgtacaggcttagaacctcttgagtcatcaaatgctggttgctttttgcttaatagttact

SEQ ID NO: 114610 - DNA, 1439 bp, Homo sapiens
ggctaacatggtgaaaccctgtctctactaaaaataaaaaatttaaaaatttaaaaaattagctgggcgtggtggtgggcgcctgtagtcccagctactcaggaggctgaggcaggagaatggcatgaacccacgaggcggagcttgcagtgagccaagattgtaccactgcactccagcctgggcgacagagcgagactccatctcaaaaaaaaaaaaaaaaaaaggttgggggggcttttcttttatgatctttttatgttaaagtgatttccttctattcctagtttgttcagtgtgtttgtcgtgaaaggtcaatttacattttaaaaattaatgtactagataccttattaggtatactttaatagacaggatgaaacaaagatgaagttttatctatttttttaagtcttaagaaaattagcaatgcctttaatagaaacataggccttaatgatacttcagaaaacatttccaaatcgcctttggataatacttggaatcatcactctctgattcagaattctctgtctctaatgagaaactccagagttaggcccggcatggtggctcacgcctgtaatctcagcactttgggaggcagacgcaggtggatcacctgaggtcaggagtttgagaccagcatcgccaacatggagaaaccctatctctactaaaaatacaaaaattagccgggtgtggtggcgtacacctgtagttcccaacaactcacaaggctgaggcaggagaatcgcttgaatccgggagagggaggttgcagtgagtggagattgagccactgcactccagcctgggcgacagagggagactccgtctcaaaaataaaaaataaaaataaaaaatagaagagagaatctctagtgtttggaaacatttaccaaccaaaccactgatttctcatcaccttttagtcaaacctccttggatggccttaagagtggaacagcgtaaacaccagaaggtaagtatttcccaaatcctattgacaagaaaccttcctcatggatccaaacacaggtaagaggaggagaatgtacagactatcataggaactaatgccttcttttcctgatctctttagcacagtgtctgacatcatcattattttaagagttaataagaacagcaacaataattgctaccatggtgttattttctcagtattttcagactctattttaagcattttacatgaataaactttacatatagttcctattcaactttatatatagtacctattaagtagatgttgtaactatagccattttacagatgagaaaactgaggtataaaaatgttcagttatatccctgggatcacattcagtgttggtgcagtctaatccaaaactccttctctaaagcacttacaagatcattaacacaagatcattaaaagtttcatagttttat

SEQ ID NO: 114611 - DNA, 1008 bp, Homo sapiens
gcactttgggaggttgaggtgggtggatcacttgaggtgaggagttcgagaccatcctggccaacctagtgaaaccccgtctctaataaatatacaaaaattagctgggtatggtggcacatgcctgtaatcctagcttctcgggaggctgaggtagaagaatctcttgaacttgggaggtggaggctgcagtgagctgatatcgtgccactgcacttcagcctaggcaacagagcgagactccttctcaaaaaaaaaaaaaaaaaaaaaagcatgtatgccaatttctggatcaggaaactaaagagaattagctaacaatacacccttattcaagcagacaagcagaagtggtacaggaactaattaatctaattccaaagccaaatattctttccaggatatggcaacatgcaactttgacatcattttcttggttgtctagatatatttttgccaatcgtctctttgttctgttcccaatcttactgctctattacctcattttccagaagtgctttgtccctctgtgcttctctacatttccccttctatcaaaagtctactagtttatggaagattccctccttctctttgtaagcccttacccccttctttcacagatcttgttgattctccagctagtcttcccaagtattcctcctccttccctttgacttacatagaacattttagagaaagttgaaggaaagagccttaagacatgggttagagtcccagattcactactcacttagaccttctcttttccctctagtatttagacactctaggtattttcaaggtttgaacattaactagagtcatgcatatgaaaacatgttgcaagccgtaaagaactaaagaaattcgtgttgtcttttaatatgtgactctcacattaaagggaatgcccaaggcgtcattcagtaatgaatctagtttgaaagaattgtcaagaacagcaaatttactgaatgcaagtggctcagagcaggctcagaaacc

SEQ ID NO: 114612 - DNA, 1053 bp, Homo sapiens
agatgtaatgtgacctcaagaaatatcttccaaatgaataaatgcatgaatgaaccattttgtaagtagaaatgttgggaggttaatggtataatgagaacagccagaaactaatattaaataggcatctgcagtcagtgtgggtgtggggtctaagtctctctgaagcagtagttaaagagggggacactagagtatgtagaaaggtagatgccaatttgatggtagatttcacattttcttatgaaacaaggacaaacaccccagattcccaattttacccgtctactcttctccaacctagaactcaggaagaaggagactgaaagaaagatgtatagcctgcgagaaagaaagggtcatgcatacaaagaggtcagcgagccgcaggatgatgattacctctgtaagtgacacttttggccactcacacagcttgctgttatgtcctggtgcaataatttcatcatttggcccacaaatcattcccttactctaatgaattagagtacaggattagggctaaataatgtgaatgccaagctctttctgaagctcttatatcaaggaacatgcattacaactttcctaatctctgcttccctcacttccagattgtgagatgtgtcagaacttcttcattgacagctgtgctgcccatgggccccctacatttgtaaaggacagtgcagtggacaaggggcaccccaaccgttcagccctcagtctgcccccagggctgagaattgggccatcaggcatccctcaggctgggcttggagtatggaatgaggcatctgatctgccgctgggtctgcactttggcccttatgagggccgaattacagaagacgaagaggcagccaacaatggatactcctggctggtaagaagagcctgccatttcccctgttctgtcttcccacatcccttctgtgcctttggtggggcataatcttctacatgttagtatataggtaaggataacatggttagctctgtgtactcaaggttctttgcatgaacacggaactcctatttagagatcagagg

SEQ ID NO: 114613 - DNA, 1044 bp, Homo sapiens
accatattaggtggttgcaatacattgctattgtctttattagggaccttgaatatgagtaaaatttgtgtgtggattcacacctgacaagctatgctgagttttctcttaccatcctagcatgactatcagaccctctttagtgtcttaggcatcatagagaagaatctaagaggtacatttcccagaatcctgtccttgtatggacctgggttagtgttttccaatgcagccactttctcaagatttgggaggcagaagaggagaggacatttttttctgaaagcagatgcagccagatgagtagacagatgtgacacctttagaaccaccctaatcccctgctcatggagatgactagtagaggatgctccaatgctggtgaaataaagcatctttttaaagagactttgcgaacttttttcacattcctatactagatataattaacatatcggatataaactccaaagcaattaaaatttattctaatcatttttgtgtctttacacaaactattttaaaatattaaagatgtggacatagcctatgttgcacatatattagctacatccaatctgttccttaatattgtcataattaatgaaatcatgacttttaatattttacaactgtgaagaagatatagaaatttgaatacattaaactgtatgctctgaacagatatagactttggatgaattagtaggtaattttgttgtttatagacaatagcaatatcaaggatcttttttgtctttgttattatttttggcttaaatatttgttttcttgtttatactaacctaccttaaaacttctgaaataagtaatataacagaatctcatttaaacataggtaacttgagtctggacattttattttattctttattctgtgttgttttcctctgtctttgttaaaatctctggagtctgaatgtatgactgggcttctttatgaatacaaatatttagcatgtctagggcagtctttctagtccctgtatttagagagagctacctcactgtggatagagatgc

SEQ ID NO: 114614 - DNA, 1052 bp, Homo sapiens
atattagcccatcatgatttgaaactcccggataaaacaacttataatgaaaatgcagggagactctcaactgtagcgattttaatgctcacctctattattataataataggggtctcaaatggggctgtggagaacagtggctgcccctgactagaattcaaccagaaagatcaagagagagccctaattgcctttcttctcagatcaaacaattgacttaattctccgggcctacacacggaaatgtgtttgaggagattcaaataggttactatagaggattaaggttttctctgcagattatacttttatgccctgtagttcattgcttgaagtgttaagtagttttgtcaaaataagcaaggctggaaggatttttagaaacttacaaatcacatactcttgctgagtaacacaagggacctctgtttttttttttcctctccctttaaaaaaaaaattaatggttgaggcgtgaaggtggggagaaattaaccatgttcaagattagttggaaatttcaagaggcatctcagataagagaaatgcaagtgtggtggtttattgtgtttcctctcttgaaaattgtttcatgaatgatgcggctgaagaagccacataaagagaagggattttcttgtgaatgcttaactgcctgaagagaaagtccgaaggggatgtgaaatccgacccttgaggcttctctgcagtgccgtgctcatcagtgttattttactcactaagacttcatttctgcttaaaggagttggtggcagaataagctttcattctctcacaatagattattcccaggaaagggcacttgtcgggaagtcatcagtgacattctgtccttggtgccacaggtggccgttgctcagccaacttgctctgttgttctccccgttcccttgggaatgcgtccttcctcatcaaaaagttgcccggtgaatttacctactgcagggaacagtggcgatctgtacacctccctccactttttcagccctcctgggtccatcgctcttagtaaagctacatgaagaagc

SEQ ID NO: 114615 - DNA, 1039 bp, Homo sapiens
ccacactttaaaccaagtgctctcaccctggggttagtggaacctttaagaagttaatgaacagacttcaaggaagtcaaaaacctcccaatactatattcaattttctgtgtgtgtttgagatttgagagggcatggggagcaggaaggaggagggtttatagcttttatcagcctctctaagtgggccctgcagtaaaaggctaacatgacattcaaagacataacattttaaaaaaagttattccaaactaaacatcactggtttcttattaataaaggcaaaacttctttgtaaaacaaatctgtttcattcatcatttcagcaaatatatagtgagtgcttcctatgtatcagacactgttctagcctttggggctatagcagtgaacagaacaaacaaaacccctggtccttgaggagcttgggtgctagtgcaggtatacccacaacagaccaagagcccaatggcaagaaataaagcaggaacttgtgggtgcagttttcaatgaggtgtttgaggagttctccctaaaagggtattatttaagatgggaaagaggagaggaagtgaacgcttcaggtatctgggagtgtttcttatataaatattaaatattacatatgtattatcaaacatttgaaaaatgggccaggcacggtggcttatgcctgtaatcccagccctttgggaggctgaggcaggcagatcactttaggtcaggagttcgagaccagcctggccagcatggtggaaccccatctctactaaaagtacaaaaattacccaggcatggtggcgggcgcctgtaatcccagctactctgggggctgaggcatgagaatcgcttgaacctgggaggcagaggttgcagtgagccaagatcgcgccactgcactccagcctgggtgatagagcaagactcagtctcaaaaacataaaaattaaaataaaaattgaaaaacacattacttttattagcaggagaaagaaacaaatgttgcttagaaactattatggaaaaagtagaaagcata

SEQ ID NO: 114616 - DNA, 1035 bp, Homo sapiens
ttgctcttttctgaatctttaattcttggtaaataatggtgtgataatatcatttgtttgaagtttttagtttgagcttttcaaaaactgtgactccattttactgtatcctttcatctctcccagaaagtcacctgttgctaggagagtgatgctaaagcacctgcttggtaacattcccaagccacacgtctgtgttttggcatttctgtatgttcggtgcctgctatacccaagttcacatcagatactgaaatttacaatcaggggcactcatccagacttccattatgtttttgagtgatgaaagaataagggaagaaaacagttttctatcttgtgccttataaaatacaattatacacatttcatatgcacgtatatttgtatgtgtatatgtttagttgcattattctttgcactagattattaaatataattttattaaatataaaatatatttccttgtgtcagataattttccccagatggcccatcagaagcggttcatcgaacggaagtacagacaagagttaaaagaaatgaggtgggaaagagagcatcaagagagagagccagatgagactgaagacatcaagaaataaaggagggcatgcaagtgtggagtatttacttgctcagtaactgtgactgttgtctattgagacctagcctagttttcctgcagacaatgaatgaagtgtgctcattgaaataaaatacagagtcaaatcgctattgttgttttaatgatctgtttttagctggatggtctttattacaaagtattagatttttcttctatttaacggaaaacttgactttggtgaatgtgcattacttccttttattttgctctttaaataataaaattcaagaagcatattctatgtggaatagatcctgtttttccatctgtgtcccagattgtgaccctagactttcaattgacaagtaaaaaattgactttactagacattttgactgtgctctagtaacatctatcctttttcaaatctctggatttttaagtag

SEQ ID NO: 114617 - DNA, 1920 bp, Homo sapiens
gagtgggatgcgtgggttgaagaaacttcaattacatgattgaccttgtaggaaactgcatagtcttttgtaaactgaaggcttaagtgcaagggatttttcttctgaggtctgttgtgctgcacagcagaacctgtgggcgcaacatgacagtgcaattctattatgcttcaagtaccctgctaaatgaggtaggagacagcaaaatgcgggaagctaaaagtgaagaggcccagaatcctcaggcatgggagagattccaggaaaggcaagcaggccaacagccaagtggaaatcagcaaagtttcctgttcaggggcagggagtttagtgggagcagacgctgatgctgccagggtccagcatccatggattcttcactgagagttttaagctggctattaggaacttcatccattgtacatataaatttgcaatcagagtgaaataaaagtgagattccattttttgtttgttttcaactataaaacagtactggagagatcacctattctgagacaggcctgcatatccatactggtaggagtgagttgtttaaactactggaaagcaatttggcagtatgtagcagttccttaaagaagttcatacccttggtaggccaagttggaagacaaaaaattaaaaaaaaaaaaaaaattagccaggcttggtggcatgcacttatagtgctagctacttggaaggctgaggccagaggatcacttgagcccaggggttcgaggctgcagtgagctatggtcatgccactgcactccagcctgtctcttcccctccccgccaaaaaaagtttataccatgagaatcatgacaacttgatttatagtagcagataaaaaaaacctatgtgttttagagtaggaaaatgtttaataaattgtggtatatcccaggggttaggaaacatttgctgtaaagggccggatagtaggcattttagacttcccagaccatataatctctgtcgcaattctccaactctgccattgcagcccactggcctggatagtgtgcaaactaatggatgtgtctatttaatgggtgtgtctgtctgccaataaaaatttataaaaacagatagatagctgtatttggcctgtggatagtagtttaccaacccttgctatacccaaatgttgtatgcattacagtaatggttttaaaaactaatgatatgggaaaatgcttatactagaataagtgaaaaaaagtatacccatgaatacatacctatattgtactttcccaatgagtaatgattttaaatgttcaagtgtctaggtgtatgtgtgtgtgtgtatatatatgtatatatgtatgtatatacacatttacattgcatatatatgtagtacaacttcataggaaaagggctataaggatatatttttaaagttttatcaatagttaaatgtgaattttgtttttcaaatgcaaatttgattttacagtagagtttattccggaaatagagttcattttgtagaaacttgctttacagcttagtggggtttgtttatttttgaaaaaagtagttatatttgaaacctacataaggaatcaatttgatcagttcaggaataggattttattactgttttatttccaaaatacagatgtcatgttctttttttgtttaaaatcaatctctgggccgggcatggtggctcatgcctttaatcccagcactttgggaggccgaggcaggaggccaggagtttgagaccagcctggccagcatggcgaaaccccatctcgactaaaaatacaaaaattagccggttgtggtggcacacgcctgtaatcccagctacttgggaggcagaggcagagaattgcttgaacctgggaggtggaggctgcagtgagctgagggactgcgctccagcgagattccat

SEQ ID NO: 114618 - DNA, 2035 bp, Homo sapiens
tcagatgtttcagaaattaaatacattttctgatcttttagataagatacagacattagaaagaatccataaaggatgtgaaagcattcagatgtggcttgaagtgtattaccccaatatttattgttttaggctgtgattagcactgaaaaccaatagacaggagctcttaacttttcatgataaaagtttgtgaatatgcacacttagaaattctttgaaaatattttacacttcactgttagccttttgatgttatttatattactttgggaagaaatattaaaatacaatgcagaatttttaaaaatttctatttcaaatgctctcgatatttgtcggattagcaaatcaaaaacttaactctttttacctttctgccattttcacatttcctgttattttacttaactctgtctaggcactaagtacatggttttcctcatagttacatagtaaccatgacaaataacactttaccataataaatgttctttcctttccctttcaggactctgcagacagtgggcccatcccatgcccgaacctacactgtggctgtttatttcaagggagaaagaataggctgtgggaaaggaccaaggtatgagaagagaatacctggaattgctttgaatgaacatcctgtgtgtctaattccctagctgctatctccaaactcagtcatctgtcttttttaactcagagaataaaatgttcaagagtagtagcaaagtgaattccaggaattaatgtccccacattaattgtctcaaagccgagccctggaccatgggaataccattgtgtaagggggctttagctatcttgagaaaaccatattacctggcaagaaggtctgcctagttttagttacccagagcacactttgatgcaagctgtgtgtgtaagatgtgtcatgtcgcacatgacacgaccattagacttttatttatttttttttttggagacagagtctcactttgtcacctagtctggggtacagtggcatgatctccattcactgcaacctctaattgtgccttggctactcgagaagctagtattacaggcatgtgccaccatgcctgctaatttttgtgtttttagtagagacagggttttaccatgttggccaagctggtctcgaacttctgacctcaagtggtcccaaccccccctcagcctcccaaagtgctgggattttaggtatgagttcactgtgtccagctctgttagacattcgatttactactactcacctgagctgtatggaaacgctagcatctttaggtgaaaagaattatgtatattatcacctttctttgaactctccagtctgtatcttaaactgagaaatgatttgaaacctgtctgtatttttttttattcttttcctctttaaactttacagtgagggtattcaaacttaagtatgaaatacttcagacctaacataaatggaaggcattttattgcagtattaaagtgtggagtgaataacttaagtaggctttgtgcaaatcaatgacatttctgcatgctcttgtgtatattcctatctgtgcaattcagtgtgtgacactgtaagtaatcagaggagattttatgcactgaacgtgaaaatcagcctgaaagatttgtagccataccttgcattttttgaaaaaaaaaaaaaaaaaaaaaaaagaatcttgaaattaaagtatgtcttactttattttatttaatagtattcagcaagcggaaatgggagcagcaatggatgcgcttgaaaaatgtaagcctgtttttttttctataattatgttcataatgtaatgagtgttttatggaaaggaaatgaggaaggagaaaaatggtaagtattgataaaatgtgatcttgttttcttcagaattattctttacacagagaatatagtagaatgtgagacattctaaaatgggcttatatttaaaaataaaagtattcctgagtgctttttgatttgcagtttccttttttgcttagagtcctaatctcagcgcgggtg

SEQ ID NO: 114619 - DNA, 1591 bp, Homo sapiens
tttttctctttttgggcagattgaatctataaattaccccatttctgttcattaaatttaacatagaatccttaaaaacaggggatctcaggattggtgttgaaaatggcaagacccaagaatgtgcgtattctggcatcatatctaatcttcaagtaatattttgacttatttgatgtgaacagggttgggtgctcagcattttttccctgatatacagcggcattctgtgtaccttttaagctattcctttagcccttagctaaatgcagtttggtgtttgtactctatgatttgcatcttacacatctcttgctgcttctgatattaatgataaaaagtgggggaagatgaaatggtagcactgaaaaataaagagggcctggaagttgaaactattactaaaattttgcttaaaggtctaggtctcttactctttctgatagatggcagtgattgtggtttattttaaagtattcttttttccccagcatttattgcagcgctgtacattgataaggatttggaatatgttcatactttcatgaatgtctgcttctttccacgattgaaagtaagctcatataaagtttgaattagtggtctgctttatgtttggtgattccagaacccattactaaatagttttgggggacttccacaggagttcattttgaatcaggattggaatgaccccaaatcccagcttcagcagtgttgcttgacacttaggacagaaggaaaagagccagacattcctctgtacaagtaagtacttgttgcctgcaggccattggttggatccagcatgcctaaaattgactttccatgtgccttgaagaatgagtcattgtggggtgatcatgacaggagcccaggattgagacttcttggctgttagtgtgactttgggccccacagggaaactcactggggctctcactcttagctgtaataagtgggtcccactccattatctcaatgttctctcccatttctaaaaatctctgtgaactactgcctgggagggagaccaactaagattatgagattaaaaagaaaatttggattcagtggtttttatatacatttttatatttgtcttcttgcttgtaacttctgctgggctgtgcatccagatgagaagatcatgtatgattatttgtagcgatatttgggtacctctctgcactttccctgaacccctattggcttcaacttggaacttttcttctcagaatgtgtgtcaaaagccatcatgtactttgaatatctttatcctttgagtggtagccaaaagtcattaaaaaggaatgtaggtgagtaatgggtcactacaccacttaatacccgttttgatgaaaacaggaggttcagctctgaagtagagtaattatcttgagacacacataggttgattaagaagatgctttcaaagtggaattacaaaatgaaaggattattgaaataggtgggttgcatctcaaggtattgtctgggtacatgattttaaggatgtttaaagattgtttcaaaactgtttcaccccatgtggatgcatacacggttgcaagcacacacatctgtgtgt

SEQ ID NO: 114620 - DNA, 1047 bp, Homo sapiens
aaggattcactatcagacactaagaataaatcttgattttcataagctctgttgacaccatggagccacagagcataaaacttgcatctaataaagaaagtgcaacatggaacagcagggagtggaataccagcacaactcacagctgcttcctgttcctcgtccctgttttcaggaatgtttcttagcaggaagttttttaatagaccgagaatttgttatatgtattctaagaaaagttgtagttgtagatgcattactctcccaaatcttagagatcagggatgattatgttccatttttgtttggtgagttcccatctttgtatgtacctccttgctcccggctgtcctcctctcctcttccctagtgagtggttaatgagtgttaatgcctaaaccatacttgttttatggacacttctataatggattcgttgcataattttcatgcagtgtatagtgttactagttggaaattcttggaggactcttagctgtctgatgaaattcctagtagaaatttttgttttgaattcctaaagttgaaatatgaaaattatattttaatttgattagagacaaaggataccagtatgggctgggcgcagtggctcacgcctgtaatcccaacactttgaaaggtcaaggtgggtggatcacttgagctctggagttcgagaccagcctaggcaacatggtgaaaccctgtctctacaaaaaatacaaaaattagctgggcatgttggcaggtgcctatagtcacagctactcgggaggctgaggtgggaggatagcttgagtccagaaggtggaggttgcagtgagccaagatggtgcaccactgcactccagcctaggcaacagagcaagagcctgtctcaaaaaaaaggatatcagtatgaaaaactgagactcaagctagataccataaatctttaaaataataataaaataaaaatgtaaataaataatttaaatcttttcatagtatttacttaaacctcacttaagtcctataatatcaaaattagcatcagtgccgtga

SEQ ID NO: 114621 - DNA, 1048 bp, Homo sapiens
ctatagcggtgatgaacctacagtttttgtttgtttttaatgatttgggataatgggaaagagagcaaggattacagataaaaagctcaagaaccagtgatctaatcctgccctgatgcttccacacagcactgagcataaatcattcagacaaacaggtattttatctaaaagatctcgttgagaagatagattacacagcctcctgtatgaggatttctgtcactgacataatttggctctttgtatctgacctgtatttgcctgctagcatttatgtaccttttctttagttatcacaggaaatggagaccatctggcgaccactcttgttataatagagctgtgtggcatattattgtcactttcaatagtatattctgctttcaccccgtgttcttatattaagccctcaaaataataaatcacagtctgcttaatttacactaggtgtccctctttggtagctcatcccccagctgtggtttttcccttcagattcaagagtgaaattgggaacttgaaggaagattgtcaatatgtatgttttatttaaacgaataaatctttttcttatgaaagtttaaagtaatgatgaaagactgctatgctggcataatagaaaacatcctggattctcaataccagagtttgagatctgggatatttacattggtctctgacattgcaccaggaattcagcagtcctttcctcaggtttacagagagctttaattatagtcttcttagtcatttctggtgatttcaaattaaactttgtctttttggaagtattttttttaaagttgttgatgacaggttagcacctggtaaaatggggaattttgaggacagtgagtggacaggacgggtatccaaaacattttacattgaaaacaaattcagaggaattcttagaattttctagaaccttttcccataactgaagagcaaacatattttgtcgaattatgatgatgctgttgtgaataacacagcaacagctaacatttctgttgtgtttatcatatgccagtcattgtagtta

SEQ ID NO: 114622 - DNA, 1632 bp, Homo sapiens
catttgtaatgacccactgtaaaagcatgatctcataaacataagatcttatgaagacgacatggggcgttttccactccatcttaaaatagctcatatgataatgaattagtgcctaaaatgaaggacatttgaaatgagttttaattacaaaaggcacagctgatgcacatttctggacaatggtaagaaaaaaatatgattaaaagagcagcttagtgcagtgtattaagttaaccaaatatgtaacttagttttaaaaggtgtctgacttctgggactagaggaggctcttttcccccgtagcttaataggctaattagagtcactacaggcggtttgagtggtgaatacacttaaaaaaaaaattagtttgccagcactgttgaatttgccataagtggagtcagtgtctgaaatagttccgtatttcaaataatgacattttatttagtactctagagtgcgttaaatggctcccttgagcattaaaggcatcactccattttccaggacctgcgcgaagtctggctcaattatcctctccacccactccaagtaagtatgacctccctgtctgcagtgagctttataactccagctattcatgttactttcctttgcctttttttccttccccacttttatcttttgattctcttcggtggcattgtgcctttaagctgaggtgtcagacctggaaaactttggaacaataggagaatgaacccatgcattgtgtttatgtggtctggaatagggtagggggagcattgggagtcatcttccctcagtgaggaaggaagagctactgtgtagttatggatgccccaccaccaccaaaaggtgatattgaaagcataaaatgttgactccagtatatctacacacttgcttttgcagggaaagtgttaatagtatggaagcgagtctgagcatactaaaaaagtagaacaaatactaaattaacattgttaacgtatgatctaatctggatcttagaaattgaaagcttcaattcagagtgtataaaacctgtaaattaaaaaattagtatagtgtgatagcttttcactcaagattttggaatttaaaagctctacatatggtggtggcacctatttccccagatggtttaagaattcttactattctttgcctttatttctgttttactttgggatatatgcatatatgtaaacatcatatgtatcctcatatacttatttttatatatgtatataaaataaatgtaagaagtggttgaactctcataagaggctttacagtaagaaatgacattaattcagagtactttaaaaatattttattaatacatgagtgcccaaagttgttgcaaatgttcattttaatcacacttttcatatttgctctctaccagttgttaaaggctcattgttggagcaccacctgtctagtggtataataatctccaatgtacattgaactctgttttaatgatgctcattgccaaaataagttggtccctagaaaacacagtagtaaattactttaatgcagtagtttttaaagggcagacccagaccagcagcatctgcatcacctgggaacatgtcaggaagacggattcccagtcttgattccagacat

SEQ ID NO: 114623 - DNA, 1876 bp, Homo sapiens
tgaaatgtcattataattgaatgaaatagccctcatggagcaataaagaacacgggaagccagttttaagcctctgtgaaaccttcagcttaaatggctgtcagacgttattactgtattactttgggtagtttttttaaaaaaggatcaatagttttggaaaatatgacctggacaatgttcatatctgagaatttgatttttgtatttgtttttctagagatatgtgatgatttttatggatgaatttcctccttatgggaagattatctacagatgctctgtgtcccccatttttgtcctgcacatataaacacatgtgcatcttgatttgcatctgtatcagatggtgtgtgttttaagaccttttctcaaatcttaaattttctttgttctggccttcaccttttgtgggtcatttcagcaacctctttgctctctttccttcctgcagtcttgtctgtgtgtcccccagcaccctttagactccttcccccacccccacctcctccctgtcctcttctcccatcttacctgcatcccccaatccactgtgttctgttgttctgttttgctgcagttttctacttgtcttctttaattgcatcagtctgtgtttagattcttttctctttaaactgcctctctcccagttgtctacttagtgagcttatcttgtgtttccagtacctagtgcaatgctggcatgtgcagcgtttaatacagatttgttagaagagtgaagtgaataaatgactggattaaaagcagagtgtgaacattatcttacaaacagggtggttgagattcagaatttgttttagtgtgtcttttgtgaaactgcataaggctcacaatgtatgggttttcctctttagcattttgaagtacacaaacttggacactgactcatttgacatctccatattggtttccacctattagttgtagcatgtgagagatgttagtgaaccaatgtacttcttttttgaataaggcatcatgaaagcctaattagccaaagacagccagggacaaacctgtaggcaacaaagtcaggttgattggctgtgttgtgggggtggagagagacatcctttgtgaggcctgggctggtgctgaataattcttaggaggttcttggctgtggccagtttaggagcagcaagagattactttgggattgggtgccgtcccaaggcaagggcagcttggcgattaagtatctgcggtgatccttagtcagagggtcataatggcattttacagcagctgcaagaccttgaggaaaacattgtttcctgttcactttgctgctggctttatctgtgtctgtcttctcagccctgtaaacagcagggctgtttttttctttttcaccctcaactgagttttactctttcagccccagttttgctggttttgtattttggtctttgtgtaacccttcaagtttgacccagtacattcagatccattgtttcattttgattatgttaatggcccgcttagaaagctagagtggtgttaatgtgatttttcctatgcccctgctttccacaccttttctctttacacagctgtcccagtacctctgactcaggccttttctctggagctgcagaaactggaaaaagtgtcttttcaagttgcctctgggcacctcacaggtgtttcacagatacctcatttcaacatgtgtaacattgaacccatcacttttaacccccaaatgtgttcctccttccttatttttatcttctaaaccagaaaccttaggatttatttttgtccctaagctttcttctcctcttatctgatcgattgcaagagtctatcaattctgaccctaatatttcttgaattgctaccctac

SEQ ID NO: 114624 - DNA, 2262 bp, Homo sapiens
agatgaaatttacatattctagtataaactcttgcactttgggatcaatttttaaaaagagatattttctgctattgcatttgcggtagtcaaaactcatttgagtatattttataatcacaaatttcaaacagtataaaatactacagcatatatgtcttatttttattgtctttgtgtttttccaatatgaataaatatggatatttaagatacatactgagacacacagaatctatgtcttttgtctgaggactggtggaactcatattgtcctaggctgttcattgacttgtgatttgttccatgttatgtggcatgttattgcttagtatttattgaattgaattacatggtaatggaaatggatttattgcatatttatgcaatgtttgtagctttcttttttatggaaagaattatgatttccatttattcaatctcaggagttgcataaaaaatattctttcacattgtgtctagttctaaaaggctggaattgatttgtatgttgtaatgccatgggataagaaataagcagccacagagatcaaagtaaaggaaaactatgagtaagatagtgaaatgaatccagaggtaaagttagtatacactgacgtattcatcagccctacacctacaactgggctacaaatttggctctaaactcttctgaggccaaatcagaaaaggaaacacaattcactacaaatgctattttcagagcccttaagatcaatccaattcattgcttagaaggtctcagtgaacccacagagagatgagtatggaaacctcatgagggggacacaagtgcagaggggtccccaaatcgtcacaacaaataaaaataaagatttagaagtgtaaggcattttgaagtcttctgagggtcctcacttactctaccacataaaaatctattttgggccaggcgtggtggctcacacctgtaatcccagcactttgggaggctgaggtggctggatcacctaaggtcaggagtttgagaccagcctggccaacatggtgaaaccccatctctactaaaaatacagaaattagctgggtgtggtggcaggtgcctgtagtcccatctactcgggtgggtgaggcaggagaatcgcttgaacccaagagttggaggttgcagtaagccaagatcataccactgcactccagcctgggcgacagagccagattccgtctcaaaaaaaaaaaaaaatctgttttgtatggtgctgacattgtcagtaccacatgacttgagtcaaagacgtaaaattgactttcagaagtttgtgttaggtttgtaattctctccctaggcatattggatgaacccaggggcttgtagcagagtcttattccagcctgggctagtgcttgatctgaacttggaattggaaagttcagatctgatcaattctgaaccctacttgaactattggagtttgtagaagcctgtttgggaaagaattgagttagtgaaaactgagctgtatgtataggacttctaatgaatgttaaactaaactctctcttaatatattcatggatttgtaaccattacgctgcccccatctcgtctccgcaccaactctctgcaagagatgctgagttactatagttaagattttggcaaactctttcttacgttttgtcattgtgaattttgtagaaacttgaactggatcgatttatgctgtatgctcacgggcctgacctttgtagagaatcggaccttcgacatgcaatggccaattgttttgaagcgttaataggtaatttctctcttcttcaagaagtctactttcttgcatgtctaaacagtctggagagcacataaaatttagtgtggaaacttgggacagaattacttgttcccaaagcacatgaggttcctaggacgacacctaccaccttatattatagttatttcagttccttcagagcagtgaacatgcctctttttttttttttttttttttttgcattctactgcctgaattggtgtctggtgtctgatgtcatgtagatggttagtatttaatgaattgaaatgaggtgagttaatatggagatggattactttccagatttgattcaggatcacatacataaacaaacagattaggttgctgagagactccagtgttgcttttgattaaactatttgtaagatttctgttttaaacatcttgagaacaccacatcttttaagccccacccagggtttgagtctgtataactgttattgat

SEQ ID NO: 114625 - DNA, 1130 bp, Homo sapiens
cattcagatatactgttcttaccatttaactttcaaagactttaatcagatcctttagtttgattcacctgatatccattgcacagctactgtgtgccagccctgtttctgtgactcagagccacagacagaatgtcgtgatgcatatttattcatgtacttctttttttttttgtagcgtccatttgtactatttgtttcctagtctggaagaaggaggattagcaacctatcggactgccattgttcagaatcagcaccttgccatgctagcaaaggtatagaagacatctgcagcatttgtagttacgtctgacatgctcttctgcggtccatgcataattttgcatttgaataagtaactcgttaggatatattaggagtgttaatattttacagaccaggaagtattttttgttgggttttaaggatccagtcttattagttctgttacctttgtgagtttcaccagcagctaatgaactccacagtgaggtaacttgagaacagatgaagaaaaatttgacagatgtgcatgaacagagttaaacatttggggaaaaggaacatgggaacaaagcaaaagaaatgaaatatactgtcttttccctttgtgtagtatttctgtagtacatttgtttttaatttacattaacaagccaaatgatagctttgaacagaatattacagaccattttttatccactaggggtactttctacacctttgagaatcccccaaatcacaaatcctattaagatttagggtttaggctgttcccctagcctcattgacttagctcagtgactaacagaaccttttcataattcagataaatgtgatctgatttgatgtttccatctccatattatgtcttattataataaatcatggctgataagaacattccagtccacactcctcctcttacaaacaggtggccatggacaaattgacaaattgttgttctcttctccaagcctctgctttctcgtctgtaaaatggaaatgacattagcccttggcacacagcctggttgtgagaattaaatgagattatgagttttaatgatgtcatttataaagtgctacgcataatacttgtttatagtaattacacaaagatgtta

SEQ ID NO: 114626 - DNA, 1103 bp, Homo sapiens
attctgtgtaccctcactggatttggcctatcccaagatggctttccttggagtgaatggcaccttacagtacttactgttacagggagacggttgtgttttataaagtgcattgaattcctcagacaaaatgtgctgtataaatgttacagttaatctagatttcataatgcctctgttgattcacttcttaaaaacaaatggagtgtttactgctcagtaaacatctcatcttggatcctgctagtatttataaagagggtgattaaagaaagtctaaacaatgaaagaaggaacaaaagatttgctactgctgtgaggactagcagcccactcttcccatttttccagataaaccgttggcttaggaattgtagagtataataataaactaaagtggtatttaatccccattcttatttatggcttattgccagagtttagtcataatgtagatacagaaaaacatatgttggatttgggcaaattatttaataaatggcagactctctgttgaataaatctgtttagaaccatgaccttgtatttcaacaaaatgaataataatccaactttgtggttattaaaaccttagatgtagtttttgtctccatgaaagtttataaaagaaattaaggtaaaacttatgccaatatgacttcagttaaaatagtatatgacttcaagcatatactaaatatgacttattgtcatgtttgactaaatgtcttattattctttaaaaatgcattagacatccaaatatggtttgtccccagctcctttgtccccagtttcttgctttccatgtgaagatttttctgtatagtactttgcactattaggaagaagataaagcctgtgccacagaaaatgcatttttattttactggctcatgaaaaagaatttatttcttaaaactcactatttctttcttatttctatccttaccaggacagcagcttaataggtttcttgaaattgcaggaggacttaggagttaacattgtcttaccattaaatcatgcctctattccttgatgttttctccaagaatgatggcagatgcttttgaagttctggtgtatttgacagaaagcaa

SEQ ID NO: 114627 - DNA, 1018 bp, Homo sapiens
taaacaacctgattgatatataattcacgtactatacagtttactcatttaaagcatacaattcagtggtttttagtatgttcacaaaattgtgtatccatggccatcatctaattttgcaacattgacattaccccaaagagaaaccctgtactcattagtaatctcttcccatgttccttagcctgcccaatcctaggcaaccaccaatttattttcaacctctatggatttgtctcttctgaacattttatatgaaaggcatcatataaatcagttctttgtgattgtcttcttttacttagcatgttttcaggatttgtccatagtatagtatgtgtcaatacttcattgtttttattgctaaataatattccatgatatgggcatatcatattttatgtatctgttcatcagttaatgggcacatggattgtttccactttttggctggtgaataatgctgctttgaatatttgtgtacagattttgtttggacatatattttgattttgcttgggtatatacttaggagtagaattgctgggtcatatggtaactctgtttaaccttttaaggaactgccagactgttttctgaagtggctgtaccattttatattcccagcagcaatatagcagggatccaatgtcttcacatttttgtcaacacttgttattgtctgtcttttttattctagcccttctattctagtgaatatgaagtattatctcattatggttttgatttgcctttccctcagggctcatgaaattgagcatcttttcatgtgcttattgactatttgttcatcttcttcagagaaatatctattcagatccttttcccatttttaattgggttattctaaattattgagttatagtagtttttaaatatattctcagatacaaattccttatcagatttgcaaaaatttttttcattctgtgaattgtcttttctctctcttgatgacgtcctttgcagtactaaacttttgatgaagttttagcta

SEQ ID NO: 114628 - DNA, 1100 bp, Homo sapiens
cacgtggaggtgctcaattatatacttactgaattgaactggcaagaaagatttttttgttgattagagatcctatttggtagaatgaatctttctttataagttaataacataactaatttctatagtttcaagcaaatccattttcatgtatttttaaacaataccagcttaaaacacttcaaagactgaaataatataaagcatatgtcaatcattctgtgggctgggtccatcctccaggttctgatgaataagaatgactccttacattctcttgtgttcttgcgaaatagtattaaggaaaagaaaaagatatgacttccatgaaattatctcccaataaggaatttatagccaaatgaaaagggattgaaggaaaaatttaaattctgtgtccttgggtaccttaactatactggtggctttataaaaattgtcttcagaatgttagatcattaaatgtcaaacttagggtggcatatctggttgagaagctcttcaaggatagtcgtgggctttaggggtttgtgaacccattaaacttgtgtacaacttttgcatgtttgtgcacagggacatttttctggggaaagagtcattttccttggattcccaaaaatatcttgaccctaaaaaagtttcagaatgaatgaatcctaatccattcccttttaattaaagatagacaaggaggcacagaaatgcatgtgacttactcgaagctaccctgctgaatactgatagaaccagggctattcctaatggaatgagggctaacaggccttgttctaagaagatttttgtatttcctcttttaatccttttagctatcctcggaagtaggtatatttattattctcattgtgcgggtgaggaaactgaggcagagaggtaagataacttgccccaggtcacacagtgaatgagtggcagagcaggatttagacccaggcattctgattctagagactatatactcttaacagctacagtctctcacagaggattctccagaatgccatgcagccaataagctgtttcaggacttagtgagatggaatttggaatgtgaaaatggttctggcttgttgtaaaat

SEQ ID NO: 114629 - DNA, 2365 bp, Homo sapiens
tacatgctcatttcaaatcccaaaccacattttgcttcctttatcaatgaaagggcatattttgttcaaaaataccagaatggtagatttggtttagagtttttcttatctagttgccaagaaaggctgggctgtgttataccccaagctttgagcattccagcctccattttaaagaaaatattgtaattttgtatgaagaggtttgagtatctgaatgtaggggtaatattaaatgaatccaacttattttctaatgcttgatgtttggcttactattgctttatagcagttgtgttactcatcataatgaattcttttctaggaagccctccaaaaaatacggcagaagaatacaatgagacgagaagtaacggtggagctaagtagccaaggattctggaaaactggcatccgttctgatgtctgtcaggtggggagacttctgaggacacagttatgcccatacttttcttcctttaaaacaaatctggtactgagggtttcttaattgagaatgttctttagaaaatactaccttgagactaaatggaatatcaactataaattgttttctattatttggattttgtttttgttgtctgttttgatgctggtgtgtgtgtgtatgttgtatttgtgggtgctggggcagggagaagcttacttagtagtgttcagttcagtgtcttctctttggataaaggtaagtctgtcctcatgcatctgctcatgcatctgcctgtttgcagcacatgtataggtgcttatacaaaagagataatccagcagccatacaagcagactcgtaaagtgtatgttttctagactgatgactcaaatttacattgcaatttatattgcagagaactgaaggcattaatgaacagaatcagtgtatacttcatatttgaaccaaatgataatatattttccctgggtgaacgcaatagagtaacatttctgctatatgtaactgactgactaataagcatttttgtttttcctatgggtggaatttatatgtgattaaagatcccctaaaccaacatattctgttttttcacttgattcttttgtcacaattgatattggatgaagtccatgagaattacagtaaaggaaatgagtactcaggctatggttaggtaatgcagtttgctgtgttcagccttttggaagaatacttccaggcttccatttatctgtttcgatggtagcatgtgttgcagtaagttcaagcagcttactcttagctcttcttagtgttcatttcatcataatgaattttttaaaaaatcagtgttggcttttaattattatattgactagcagggtttaaaagtattgctacacaatttatttactaagtgacgtccaaagctaactatttttgcattaagatgaactgctattggtgtaatattgccctattttcagggtaatcatctacagtggtagccagctattttcaccaagtctacaattattttaccgattgacaaatatcttatgactgtcagtactttcagatgaatattttacttccattgattctctctcagggccatttgaagccgtatcacctggtttttctgtttgtcagtgtttccccaaaaccaatgtaatgtcatccaaaggtggacatcatcagaccagtgagcagaatcctagacagtttgctccaaatctgatgatctcagtgataagtcagagttgattgtctaagagatcataaaactgttgagcattaagaactagaaggcgccttccagaccttctagttagtagttttgaacttgtgtttttggttaacttcaaagtatttttttttcatacaaaacccttctagagccattatttgtaaaaagataaagaataactgcctgattgactagtgggagatgggagtggagacagtatcctgttttacttgatttctcccccacctcctgtagcagtccctaaggccactgaatacagtatcttttttttttttttctgaagcattgagcctttttttttctttttgtgaagcaaacaagagtgctgaattatctgttccagtacagttttgtattcttcagctatatcacaaatgtccttcctctaccctcagctagttgagaagcagctggaggagtaagtgatcttgtctcttgctgtgtgatatgctatattctgtttcgaggttggtaggcaaaaggactcactcagtttccttgcctaactggtggaagaaaagggatcccgattaaactcctgcaaaggtgaatgctttatgatctaataaccgttcctccctctgtagaactctcactcttccagagagaactgccatctgtttagaagccatgcttccatt

SEQ ID NO: 114630 - DNA, 1067 bp, Homo sapiens
gcttaactatttggcctttgcaccactatactttctaacttaaagatgtagaattaaaggaatacataagatccactgagaacaagtgagggaaaaaacttaaatagaggcatctgtgcattctgaaatgtgaaattaaagcagaagaggctctgcctgtgatgtggaatccttcccctgtgccttcagagaggttaaggaaaagttatatctgactaggtgtccttttaaaagtttaatttttaaaggtttctatgtggactgcaaaaaaggacaaaatcattgttcattatgccaaatggcataggctcatttacaaggatgacattatagtttttagatagtatagctgctgtaattaaagggttttaaatgaccttttccctttggggacaaggctttcctggaaaaaagtccgatttattccttccctacttaggttaaagtcaatacataaagacttcttatgggaataaatggctttgatttttctctctagaaaccaagctctgtccgtatcgatcaactggatcgtgaacagttcaaccccgatgtgattacttttccgattatcgtccactttgggatacgccctgcacagttgagttatgcaggagacccacagtaagatatttctcagtgtttgtcttagccaatttcaccttctactaacagccaaattagcagagaaataccctttagtggatgtttcctttttaaaaattaagacctgaaatgagccatacttccaatttagattacccaaatgaaacaattgtggtagctcctgaagaattattttctgtacatatttgagtgcaagaaactattattcaatagaatatttttggcaaacttggtcaacataagtccttgtatgtttttaaactttaaggaactttttctttattcatccttataataataattattattttttattttttcagtgccctctagaggaaagtagcacatattggttcctagcactgccgaatttatgcagagttctctttttgggggcatcttaagagttcaagatcacatgcaaagtcaaggttgtgttg

SEQ ID NO: 114631 - DNA, 1001 bp, Homo sapiens
actagtatatgatttgcatctattttttaataattcattgagcagatggatatttttaaagattgtgatatatagtgccaaatttcttgtcaaaagaataacatcagtttgtgctgccatgaaaaatgcattattattcatttttagcattttgcctttcccatcttccttctctcctttctttcttccttttaaaaaatttcagtggtgagttccatgaggctgaagagtaaacatttgtctgtcttgttgtatcactagtgctaacatacttcatggcacatagcagggacgcagtaaatgcttgtttactgattttatttaattggtcataataatgccttatctaagtattcatgtttttggttactagtgagtgtgcttttcaaatagtctttggtattatctctcatttttataaagtaaacttttggttgaactataacataaatactgaaaagtgcatggatcatgaatataggaccttagtgagtttttacaaagtgaatatgaccatccacccagcacccagatcaagattagtagcttccaagaacccccttcggacccctttccagtcgctgctgagaccctcaagggtaaccgctattctgacttgaaacaccatgtattagttttacctgtttttgaactataaaaactagaattttatattctgttttgcttctgtcttttgtttaatgtatttcagaatcatatcctgttgcacttaactgtagttggctcattctcactactatatagtattatatgggatgactaaattaaaataaacctatctatgattaatggacatttgagtattttcagtatatatatatatatatatatatatactgacattgccaatagaaaaacgggcaaaagacttgaatgagcactttaaaaaaaacactatctaggtacctaataaatatatgaaatagtgctccattttattagtcattaggagaatgcaaattaaaatcacaatgtgatac

SEQ ID NO: 114632 - DNA, 1302 bp, Homo sapiens
cctcagcctcccgagtagctgggactacaggcgcccaccactacgcccggctaatttttttttgtatttttagtagagacgggatttctctgtgttagccaggttggtctcgatatcctgacctcgtgatccgcctgcctcggcctcccaaagtgctgggattacaggcgtgagccactgcgcccagcggttggaagtatccgtattctagcaaacagttacttatttattggtgaatggcttttcaaactgatagcatttctcaacattttttttttagtgtagtgattaaaatgggaaagaatgaacacatagtcacattatatcatgcagtaattcaattataataagtcttgatagttttgaattttaaaaataattttactgtatgtatttgctacttggggctttcatcctcttcttgccttcctgtagtctcctcattgcagtcttccttgggtgcttgtggcagttaccaatgattgatttagccactgaggaggagtggcaggaggtggtggtaatttttatgcctctacttctggtggtagtttttgtggttatcataaatcttagaaattaagttgcagtgcttgttttttaagactgagttttcttttttttttttttttctcatttgtttgcttcaggtcctttgtttgaagacagccctccctgctgcccaagatttcatttcatgccacgttttgtaagatttcttccaggtaaatcttctggcttgtcagtgacctggtgagatagtgcatctgaaaataagcttgccattttcctttcagtcttcagggacaactttcccaccttcgatactgttaattatctacttctcaggttaggcacggaaatgtaaaattatacatgtggatttatatccctgcataaattatggtagtccaaattagatgaacaatggaagaacagatttataaattttagaaatctacttgacaaaatatcatgcgggtgtgttaatgtggagaaatgattgtggcttaaaaaatgcatatggctaattggaaaacaataaaaaaatttaaatgcaatatgattataactgctgaaaaaattactgtaataatagttacattaaggtagtaggattatagtgattttttcttatcttttgacatgtgcttgaattcattttacagtgaaaaaaaggtataaaataattttttctcccaataaaatatagggaaatatatgacagttttttaaagcaatattttaactgttttctaattttttaaaaagaatccacctgtaatatttggcattatattt

SEQ ID NO: 114633 - DNA, 1036 bp, Homo sapiens
aaatatatctgtttagcttgtttacaggagaaattttggtgcagagttgtataattttcttagccctttatttgcattcattactttttgaactttttgggtacacaggacctctgttttttggtaactccatgacaattatgctggatgtatggggcgggggtgggggacaagcctatcaggtgcatatgtataatctgaattaacaaaacatcctcagaagattctgacacagtttataattgaattagaaaaatatattaatataagtgagactttactttttgaatttcttattttatttgtatactgagaagggctaagttgacattaaggaatcctagtggcattattgtctatttcatttccatctgaaactagcgatcagtggccaaactcttcaggaaactatatggtcttagtatagttttaacagacacttttaaagacacttgacaagaacaagttgaaccttcagttaatgtatattttgccaaactacagtaatttaattttggtttatttttcagaatttttgtgtgaaagggcttgaactcttttcactgttcctattcagagatattttggaattatatgactggaatcttaaaggtaagtaataggatttaaagaagagagtagtgtttatggaagaacattatggtatatgtgaaaactcttataaaagttgtagggagatagttgaaatttctcttattttttaaatacccagagaaaagtgttattcacaggaatgcttgttatcatttgacatgaataagtttctatggattttactttatacagtttgacagggcttattattagctggtagcggcttgaagatggtaccagttattatgtgtagctaccttgatatatgtgtacctgggaaattaccattagttaatattttaaatctagtaaactttgctgtaataaatcttctaagatgcaaaactttggttagtcattaaaacacacacatgcacacacgcagacacttagagtgaactagatagattcaaagacttga

SEQ ID NO: 114634 - DNA, 1046 bp, Homo sapiens
tccataattgatgagttatcaccctactatccctgatctgcctaaggagccagagattctaaaatattttaaaaacttgagaaacagaaatgtttatggttatggttttattaattctttagaggtgatacttgtggttttaatgggttcttgtcatgtttgtgttgctgctgctaatactgttaattaagcaccacattatgcaggtttcttggcgaggccaggccagctgggttcttgtcattaaaatccagcagttgtggtcaagcttcatgtgcagtgttgttagccgctgagatgaaggtgaagccttctcatttggttcatggccttttgggtcaggtaacaaacgtgtataatatgagcctgcagggagacgttggggaactgaacctcacttctttttattgcagattccactgtgtaaagtaattagattcaacatagactacacgattcatttcattgaagagatgatgccggaggtaagggaaaagattgtgtgtggtttgatgtagtttgctcttttgcttgttccatactactattttaaagcattgaacttggccagatctggcttttgccaggaatatctctaaagtatcatattcactgttgaaagagtcagtgaaatgtagctctagtatcaaggttaaaattcaggccaattttcaacttgttgacctgtttttatacccctttctccttgtgttacgtctgctgatattaactttacatctgtttctagtttcttttacgtaggggacagattttggttactggccattatcagaggggaaattggaatagtgaaacaatctgatagctgttgtaataatcttattcgttatctccaatgacaagatcaatgcttggttcatttttcttcccatatatttacatatttttcctaattgtttttcattgcgagtgctcaacagcagatttatctcaatatatgcaagagatttaaaattccaaaggaagattaatgtgaatctcagaatgattcatagtctgatcttgaatttagtggtgtcaacaaa

SEQ ID NO: 114635 - DNA, 1139 bp, Homo sapiens
cccaggctggtcttgaactcctgggcttaagcaatcctcccaccttggcctcctaaagtgctatgattacaggcatgaaccactgtgcctggccctactttacagttgtttttaaggtgagtcccatcacaggccaaacaagctctcttggtctccgaagttaatcaggctctgtgggcccttgccatgctggaaaatgccaagacacaaccaccacccaaccaagtgtttccagctgcagctcacacctctcccagccccaacttggcaccttgtagccagaggttcagacacctggcatcgctctccttggcctccccaggcccatcacccacaggacaagaccctgtccagctgtctgcaacaagggcagagctacttctactggcagctgcaataaaggggactcccaaatgggcccatctccggcaagcctcatgagttccttcagaccctccttacaactgacgtggcctgctcacccaccgacccagatggaagaacaccaagtcttcatcaaggccacctatgtgtactagcagtccagtgggtgtccctctggtaccctcatggatgataattgctcatttaccaagttcatggtattttggaggccccaaaacctcagacatttgcggccttattggtcatccttgcttcaccagcacctgaggaagcggctgagagctggagactggccagcccttttttattggtctaggtatggcaaagccaatactgttctttcctaccagtctgtgaaggaacagacataaaacctgttttgttagatgtgaatctaggaaatacaatatatttttaagtaaaagtactcttgctttacttgtaaactgattttcgtttttttcccctcaggccatcaagccctgtcgtcctatgaccaacaatgctggcagacttttccactaccggatcacagtctccccgcctacgaactttttagtaagtttctaaagaatcacatgcatatcatttaaaatgtaaatagagtaaaatgtgaataggctaaagttattgattctgttctcaaatgttcttactttgaaaaatattttatttttatgttgacaaattggcctttctcacgatgacgtttctttcagcttcctcttcactat

SEQ ID NO: 114636 - DNA, 1626 bp, Homo sapiens
cccctctggagtatactgtaagtggcatattgtggctgtaagattaagggtagccataacttcattcaggtgtctcacagggctgatactccatgtcagcagtgttgtccgtgtcagcctgtgtcagcagtctacaacctagcctggagatttccaggagacaaggccacctaggcacagatgcagctttcataagtcttaaaacaaagtttccccttacaagaatagtttaaactccttttagaaaagagacacctggtaactgacctggactgaatacaggtataagcaaaggagaaggatcctccaaacttgagaatggtctctggatgaagaccctcctggtgacttggtcatctaagtccctggctatatctggcctgcgtctgctgttcgtcttgtaagagaataagcagaataaactgcttgagcatcagttggtgactaagacttatctttgaggagaatcagatggaaagggagaagtccctcctgaaagagctggttaattaggtccactcaaaacaccccagccaccaacacgacagctggggatggtgatgggatttgcataagcaggtgagtaatggcactcatttctatgagagaatcatgagagagtgaatgggagctatctctgatccagctactgggtgagccctatggactgttccacagtgggactggcagtttttattctgctttctggccaattgctaccttctgtgtgcactttgtacctctgttatggaaattgccaccaggcacatgccaaaattattcttaagatccttccaggcccatagtaaggggggacaggctcccaagtggaggaggactgtctggatgtcagggatgcccttggcttcaagagttgactgccggctggcgtgtctccagcccttgctgtgccagaggagcatcttggcctgaaggatcctgggattgtgacaccataggccaggaagtcttaggtcaggtttatctgcagaaagcctctctgttgttgtctgccagtgggggaattagaagatgatcccctgcaagtctgtacaatcactgaagggcacattatcctctctgcactcctgatgggactgcgcagcttctccagggatgtgctctaccctcagatgcctgctgggtgccacgtaccccagtcacatgggctcagctcagagtcgcatcacttggcctggctgatccgtaggccttcaagctgtggaatgatgatcccgagtgcacggggttaccattggttgcactacaggcattaccagtcaccacctgggtcatggttaggacagtggctgtcacctccacaacctgctcagatgaggaggcatgccccagacaccatggaagtctgcaaataggtttaccctttgtcaaggccagaaatttagagcttcctcaaagacctgatgcagggactcagtgagaaagttgtcactggctgtactgtgtgtatcacacaggaactggactgtaactcacagactgaaaaatgtaacagtcggtagctatctccaaagatggtaagatctctcatgacttcaacacccagtcaaggttatccagggagcacaacttgatggggctgtgggcatagagcaggcagccata

SEQ ID NO: 114637 - DNA, 1674 bp, Homo sapiens
tgccccgaccgtcgggagctctttggtattatgagtgggtgggagcactggggcaaaactataactataaatgtctgtgaaccattctgatcctcatttctgattgggatagaaaataacccattcaccaaatcagttgccatgtactttatatctgctctagctaaactacaacacctggcccggcagctacaatcagagttcctgcttggttaagtttgtggtagtttgcagtcatccttcaggtcttcaggggccagacaggtgaattaattggagataggaccggtaccatctcccctatatccttcagatccttaagggtggcacttacctcttccatccccacagtgcaatattggttttgatgcctgggttgacgggggtggtggtaatttcgtttctgcttggctttcccattaggatagctcttattccacatgtcaaggacccagtgttgagtagcacgttgggtctgccaagaatgtcaattctagtgtacattcaaggaccaggggaaggaccactgggtagatctgtgattcagtagacccactgtaagtcagaccttgaccaagatccatttattaccttggcctcatattctctactctaactggggcaccacagtgatgtatccagtctccaagtatcaatgatgattcagatactgcatctaacatggcttgaactgtctgctattcctcttttcccagtgtacagctccccaggtaaatggccataagcccctttggggaatgacagggctgttattttgttacaggatccttcctcctgggatctggccacctcttcagtcggtggatttcagtccaaaaaacatgatcacgtctggaactgggcaaggaatagtgtgactatttattggaatcacctgccttcagtgtcttggttatccattcttggtttcttatgttcgtacaaactaagtagtactcttactggttacccacttattttgtaccgaaggacaccatgttctattaactatttccatgactctttgtgggtcagacccctttggctgctactttggcctggcttccagcacttagtcctatcacctggcatctcttgtttcaggattctgtcatccctattactgctggtgagctctgctctctgaccacttttgtagtcagccctggcctgcagaggaggctaccactgatcttcctgatgatgtttgtgctcctgtcacctgcacatttgttttggtgtgtcctctggggcttcccatgcaacatgattatttggcatattttccagctgtagatactttatccattctaacttccttgagtccttgaattccttcctccactgtctaccacggcaattccggtatttcagctttgctcagcgtgggccgttgcttcttcatgcttttaggagccatgctggtagggagttctcaacataccctggtggtgttgtatcctgagtgccccaggtcaatctactcttccctaaacaattttatgttctggccctgttgatcaaagctctcatcatcaggtcctctgcagacttctctggctgttgccacatgctagttagttcctgcaattcttttgaaatataatctgtttccttccagcacctccccagttggggccctgaaatgaccccaattataggtattggccagga

SEQ ID NO: 114638 - DNA, 1404 bp, Homo sapiens
gttcctccaggatataaaatttgcttttgtgaaagagtcatttttcttgagataagaaatagggaaacaaaagtgtcctgggaattggtagaagaagatgggggcaaacagtgtgctgacattgatattttctgcttggctgcacaaataactcaggaatgtggtgttgtcacacggtttccctttatcagacaatatagacagtttgcagctttattggttttggaacatccgtttaatcttctaaccgtgacagcctctcagagcttcagcgctcatgacattaaaacccacgcattttcggaggcatcaccgtgcatggtgtggatttttccctccaataaaaacgaattacattgtgtttctgacagatgaatgatggaccactctgcaaatgcagcgcaaaggcaagacgcacaggaattaggcacagcatttatcctggagaagaggtaactggtttgggttattatgtttgtaaatgctgagaagccagaagtagacagatgttgttgctgttctttcccccataaatgaaataataccatcaaaattctcttcatattccctaatagtctcttactgataattgcagaggaaagcacttgggttttgggagcgcagtggggaatgttctcaaggaaactttaacaaaagttttagtcgttttattatttaaaataggcatggtgtgtttgatatggtttcccatttcaagtattcttcagctgcacatattatagttttatgtttcatcataagtggctatgaatggccctggagcgacgctcttagtaaagtgctttgaagtgcatgtcttctctctctgttagtctgtcctttccaccaaactgaatatatattgactattttacctgcgtctctgcccttggtttatcagggaccctctaataagtttaactgaataggtagaacacttttacattgcagagtcatatataactatccctttcaattattgtccctcatttgttccctttatcttttatttttataagctatttttattaatcccaagctcctcactttataattcagtgcattgtatttaaacatagtatatgtaaaaccttaatttctatttaaaacttgtttgagggctcaacaataatgggaataaagactatgagatggtgcctgataatttgaaatacttgcatcacttctgctcatttgtctttgaaagttggcaagtgtagcgaggaattgtgggacaaggtggcatcttgtgagcgtttgtgcacatgcctcaggttgggagctctgagatgttgacgagggatcaacacctgtgacaggaaaagagcagaggtgggaactattcacctgtgatgtgggtctgatcaggcctggcttgtcagaatttttgtgtgttgtgctgga

SEQ ID NO: 114639 - DNA, 1177 bp, Homo sapiens
tcttggctcactgcaacctctgcctcctgggttcaagtgattctcctgcctcagcctcctgagtagctgggagtataggcatgcgcctccacgcctggccaattttgtatttttagtagagatagggtttctccatgttgatcaggctggtctcgaactcccgacctcaggtgatccacctggctcagccttccaaagtgctgggattacaggtgtgagccactgcgcctggcctgcctaggtagttttaaaaaattatttgtagagatgaggtctcgctatgttgcccaggctggtctcaaactcctaggctcaagcagtcctcctgcctcagcctcccaaagtgttgggattacgggcatgagccactgcgcctggccctctagtctttttacttgactgttgtttcctgtttcgcaagaagcctctacactgatttccgtggatacctgtttctatcagaaattcaacagtgctttgtaaacagtctttctaatgctgtttagtgttattggttttgtgtcctctgtatagttgagccttgtgaagggctgaatatgtaggatcccagaccttggtaaaaggcaagcatgtaggatgtctctgcttccctggagatccgtgaacactaagttaattttttatatttttcatcacaacaagtcatgactggcattaagagtgtgttataactttttttttgtcttttttttttttgagacggagtctcaaaaaaactcctgctctgttgcccaggctggagttggagtgcagtggtgtaatctcagctcactgcaacttccacctcccaggttcaagcgattctcctgccttagcctccccagtggctgtgactacaggcttgcaccaccacgcccagctaatttttgtatttttagtagagatgaggtttcaccctgttggctaggctgttctcgaactcctgacctcaagtgatctgcctgcctcggcctcccaaagtgctgggattacaggcatgagctattgcacctggccttaggagtgtgttataagtttttttttttttttgagacggggtctcactctgtcgcccaggctggagtgccgtggtacaatctcagctcgctgcaagctctgcatatctggttcaagcaattctccctgcctcagcctcatgagtagctgggattacagg

SEQ ID NO: 114640 - DNA, 1103 bp, Homo sapiens
gttgcttagtagagtatttggtgtagagtaggcctttaagtattttctagaagaataaagaactcttcttacctttagaggtttaggtcatttggaagcctccacaaaaaccagtttgtcagccgggtgcggtggctcatgcctataatcccagcactttaggaggccgagacgggtgtttcacctgaggtcaggagttcgagaccagcctggtcaacatggcaaaatcctgtctctactaaaaacacaaaaaatagctgggtgtggtggcaggcgcctgtaatcccagctactcgggaggctaaggcaggagaatcacttgaactcgggaggtggagtttgcagtgagctgagatcgcgcactgcactccagcctgggtgacagagcgagactccaactcagggaaaaaaaaaaaccagtttgttaattccatcaatttctgtatttttctcccaacccctgttagagagttccagtgaatccgagtgtgagtctgatgaggacagcacctgttctagcagctcagactctgaagtttttgacgttattgcagaaatcaaacgcaaaaaggcccaccctgaccgacttcatgatgaactttggtacaacgatccaggccaggtgcgtgtttttatgcccttgctgtgaaggttgcaaacccagacataacggttattgctctgggctcagaagatacatgttgcctagtattgaaactgaattttactgtcagggttttgtccttcagagctatttcttttcagcttcaggttagttccaaagcataagcaccagagcagctgtcccttgaatcatttttgatgatgtttgtaaattccatgttggggagaggagtaatggccctgcctcattaaattgcagtagatggaaggagacacatggtaggatgaggagagagaacttggaggtctttttagaagtagttcacctggaaggtatcttgctgcaaaatagtaaataagtcctataagatttcttttttttagttggtaacagtcacaagttctcttccttgttaagcatgtttgagctaaaaacataataggtggacataattatttttatttttaattactgtctt

SEQ ID NO: 114641 - DNA, 1041 bp, Homo sapiens
tggcacagtcatagtcatagctcactgcatcctccaactcttgggctcaaacagttctcctgccttagcctcccaggtagcacaggcacacaccacctggctaatttttttctttttcatagaggtggggtcttgctatgttgcccaggctggtcttgaactcctggcctcgagcaatcctcctgcctctgcctcccaaagttgctaggattacaggcgtgagccagcacgcctggcctgttctaatgtttctgaatgttggcaaggcacatttacctgaagactgtgtcagcgataagtgtgtgtttgattcagagtatgattgccagtacttgagcattttgtttttaaatgtttgttaaatttagggttgaaaaatagcatcttgctgttaaaaatgctttgattacctgtgagatcttacatatctttgatatgatcgttattgatatagttcctaatattgatcctttatttttaaaagggagattctacagtggttggaacgagtaggcttcgtgacttatatgacaaatttgaggaggagttggggagcaggcaagaaaaggccaaagctgctcggcctccgtgggaacctccaaagacgaagctcgatgaagatttaggtgagtcagagtcactaactagcctgagacccttgcgattatagcttcattcctaaattttggggaaatacccttgagagtcccacattgagatttcttctttttcattttatttttcttaattacagtcagtaagatacatagcagtagaacttccttctttttgatcgtatttttccttagttcatttggcagaatacagcagcgatctcatttgcaaggcatgctaacaagggtgccccttggagagttgtccagtcagaagagttcagcatctttccgagagcaggagcccatgccccctgcctctcatgaggacaggtgtccttccttggccctctcctttgccaggtgcgcctggtttgatgagggaaacagcgactgtaccccagctctgtttgaaggtttctctcca

SEQ ID NO: 114642 - DNA, 1433 bp, Homo sapiens
tgtgtgttttctccaaaatgaaaaataaggaagaatttgagtttgtctcttcgaagtgtatccttgaccaaaagagcaccaaccctacgaagttgcccatgcatattggctagttttgcagaaagggagagccattgtcacccttaatgggctggagggaggactcctagagcacatgctgccagggccggggcgcctgtggtgctacagccggcgtgctcattgccatgacagactccaccactatttctacatgctcacttctcttttctttcttccatctccattttattttctgtcactgtcacctttttgctctctcttcccctcttccccctaggcgttatgcctccatcctgttaggcatatttgccacagagtaggcatgttgtaatgttcattgattaaatgaatgagtggacatctcattcatttaattaatgaactcgtgcagatttcgggcatgaaaagttgcagatgttagatttagtgtatgggattagataagagataagagagagttgtgttatttggaattttgtgaaaatagcttctatttggactcgtatctgtggggagcttgaaaggagatttctgtgtttttggaaacaaaggatttgagaagtctctcatagtggtgtgatattttatttgataaattagagcaggcttttaagtcatagttgatgtggtacagggaagggaaagctcacatactgtgcactttacggtgcctgaatgttattccatgcttctcatgttgtcttagttgaccctgaaaacacccctggcaagaaggtggttctgtccgttagaaatgctgctaggagtaataacacctgactaagtgggacttaaacaagctgggtttgttcttctcataataaggtacctggagggaggccatggctggtgttcactgagtggctcagtgatggcaggccctgctgtcttcctgagcatcttccacagttgcaggatgatgcaggactagcaggcctcaggtccttacacacccgcatcctcacacgcaggatgcagagggcatgttgggtgagcattcttctagtgtcttgcccgagctctcctttcatcccttgactccccttccatccctttaccagagccatgtgacatgcctaccccagggattcatttttccttactgccatgacagagttccacaaatggcatggcttgaaaccgcacacatttgtcatctcacagcttgggaggtcagaagtccagcatgggcctcactggctccatcaggatgtcagcaggtctgtgctcctttatggaggctctggagaaaatctgttttcttgctcattcaggttgctggcagagttcagttgcttgtgtctggaggacagaggaccttgtgtccttgttggctgtcaggtgtgggcacttcttggttcctccaggcc

SEQ ID NO: 114643 - DNA, 1027 bp, Homo sapiens
tatgtggacatttccaaacattttgcaaatatctttttcttttaggagttacggtttatcggttgttcctgaacctgctggatgcacaccagaattacctggggagattattaaaaatacagattcttgggccccacccctggagattgtgaatcagtaagtagatctggggtggggcctgggaatttgtatttttaaacaagtaaacttcaggtgattctgatgccaccagactggtatttgggagtcactggtttaacaaaagtacacacggtgatttggcatggtattcatattttaggtgaaaaatgcaccaaataggtgaaatagaatagtttttacagtggaagagtatttttaataattaacctcctttgccctcttttgaagtcgctccccaagtagggagaagaagagagctcgttgggaggaagaaaaagaccgttggagtgacaaccagagttctggcaaagacaagaactatacctcaatcaaggaaaaagagcccgaggagaccatgcctgacaagaatgaggaggaagaagaagaacttcttaagcctgtgtggattcgatgcactcattcagaaaactactactccagtgaccccatggatcaggtggtaggtctgaagtagcagacaagctgtagactagggcttctcggcgttgtcactattggcctttggggctggataaattcttgattgtggggactgccctatgcattgtaggatgtttagcggcatctctgggctctacctgttagatgccagtagtacccctccccagttgtggttaccgaaaatgtcttcaaatattgccaaatgtcccctggggggaaaagatcacccccagttgagaatcactgttacagacaaaagccgttttaaaaagctaaaagccaagagtgcagtaggttaattaaaatatctttttataatgcatttttatttatttatttttgagacagggtctcgctctgtcacccaggctggagtgcagtggcaccatcgtggctcactgca

SEQ ID NO: 114644 - DNA, 1078 bp, Homo sapiens
attaaaaattgtgttaaaagtaactgatgaaaatataaaatctttttttaaccttgggataggaaatggcttccaagcatactaaggcaggaagcataaaaagatctctagatttgactttataaaagttgtatgtagcagcaaacagatttcaaagcaagaaactggaaacggttacaatgcatatgacagagggaggacagttatcttaatgaaaactgtttcaaccaattaaagactctaatcataattttaaaaaatttgcatagcctgtgaccagaatgttcacaaaagacttaagcatgaaacatattcatttcaatattgataaaatacttcaaattaaattatatgaaaatactgtttcatcagaatggcaaagattaaaaataaccatagtgacaggatgtgtggaaatgggaactcttatgtggttttgatggtagtctaaacgagtactgcctaactagagagaagccttaaaaagtatgcatttgggaaagaatctgacaagtgtgcaaagaacacaaatgtgttcatgatagcattgtttatggtggaagagaagtaaatgttaacctaaatgactattattagttttgttaaattatggtatatacatataaaagaataataatgtacctattaaaaatgctccaaatatataattattgaaataggtgttcctgatttactactgaatgagaaggtcaggctataacattaaaacatttatgaaatatagtgattttctctgagtggtgttatgtgtggtttttatgtttgtgctttattttttctacagcgaacatacattgacagtaatttttctggtaacaaaactaatgatgcgtattgtaatgtctggaagttatataaataatatgtataatctttctaatcctcccaaagtatacatacctacacacatatatatacatacagactttccctgttagaaaattacaagttagtggtagagttaatgagaatacttattactttgatctggatgtaaacttacatggatagtagtaactttgttagtggagctgtgaaggctaccaggtgatcttac

SEQ ID NO: 114645 - DNA, 1010 bp, Homo sapiens
ggggaacttgagcaaaggcatgacagcaaatggtgaacaatgggatgttgaattggtcattttggaagtggagcagctttaaggaatggtcggtccagggactaaacatggcagtgggctgggtggccaagaaaggggaagaggagtttattgagcatgagggtttcagatgttagcaggaacccagtattaaatgggtggcctattccagtggcttgactagggggtctttgagttgctcatcaagatggtcaggcatttatgaaaccctgtttacatagtaagaattattttttaaaaaaacttttccctttttcttttctgccatgaagtcacagaatgtcgttccacccgggacgagggtgtccccgaggacgaggaggacatggagccagaccctcagcaccatcctttaggccccaaaatctgaggctgcttcaccctcagcagcctcctgtgcaatatcaatatgaacctccaagtgccccttccaccactttctcaaactctccagcccccaattttctccctccacgaccagactttgtacccttccccccacccatgcctccgtcagcgcaaggccctcttcccccctgcccaatcaggccgcctttccccaaccaccagatgaggcaccccttcccagttcctccttgttttcctcccatgccaccaccaatgccttgtcctaataaccccccagtccctggggcacctcctggacaaggcactttccccttcatgatgccccctccctccatgcctcatcccccgccccctccagtcatgccgcagcaggttaattatcagtaccctccgggctattctcaccacaacttcccacctcccagttttaatagtttccagaacaaccctagttctttcctgcccagtgctaataacagcagtagtcctcatttcagacatctccctccatacccactcccaaaggctcccagtgagagaaggtccccagaaaggctgaaacactatgatgaccacaggca

SEQ ID NO: 114646 - DNA, 1050 bp, Homo sapiens
acgcccggctaagtttttgtatttttagtagagacaggatttcactgtgttagccaggatggtctccacctcctgccctcgtgatccacctgcctcgacctcccaaagtgctgggattacaggcgtgaactaccatgcccggcctatgcctacctgtttttaccatgaaggaaacgagagtatgaagggggagaggggaaatgatatttttcccaagtcttttaacaaattagagatgatctatgcctataagtctttttagctgctgatagttttgagttggcaaaactagtaataatgacattttaaaatttaaggacattaaaaatttagttggaaactttaacacagttcaacatgcttttaattttgtttgtaggctaagtgtattggaaactacaaaattagtgttatggtaattgcagaaatattttgtagcattggcagtttgggaaacatgtttatgtctgttttattctttctgttttttagagcttatattctctgtggaagatgtgacatatccaggcggaacatcatgatgcagggaaacacatggtgagtgccgtgatgggaatggcaatagtttgggagaaccgagagaggagcagacattggtgctgggctatagagggtggaaaggatttagatacatggggagaggggataatgtgctcattctttcaacagtgggcacaatacaatagagggccatgcccagggctgggaagccagaccagaacagttaatagaaatcccagagcgctgccctgacagcgcttgcagttccgaggtgcaggcagacattaaaggtggaattaggtccttagaaggtggattgtaattattgtaggacctgctaagaagcagcacagagtgttgtgagagcaaggaacctaacaaagccctagggtcagtgacagtggttgtagaaaggccagcaaggatattattataatagccatgtaagaggtgatgatgtgaagtagatgaattcaggaaatatttatgaagcagaaacaattggattttttgtttattttttattaa

SEQ ID NO: 114647 - DNA, 1079 bp, Homo sapiens
atggatcaggatgaaggtgactgccctgcagatccacctggggaaagagggagttctcaataaaaatgtagtcacactttaaaattctttttacatgcactgacgttctggccgtgttaactattcaagacagctccttcagtgtctctgtttccaaaccgcaaccgagaagagacagacggagaaaagagagttacttttccaggtgcagtgaattccttgacttttgaattaaagtctgcatccacaacacagccggactatgccttcaataggtcaatttcatgattagtatttttagattttctaactactgaaacatccatgaggatctggcagtgaatgttcagctcttgttacacactgtacaagagtgttcgtgaccctgacttttgcccacctctaggtgcggcacacacctttgtgttcccctaagccctgcacatacctcttttttgtgtgtttattgcattattttgtatttttaaaacacttacttgtacgtgggttctgagttccttgaatcctacaggctgtgtgtcttattatctctgagtctacagggcctgggacagtgcttcccatttatgggctcattaaatattgcatgactcagtgaaaaggcctgctttctgttgcggaggtacatggaagggaaatgtacagtagcaacatggaaacatactattggtgagagagtaaacatttattgaccacctactgtgtgtaggttgcttttcccggggatgtgaaggatacagaaatgactgtgaatcaacccatatcatcaaggagctgataatctagtggaagagttagacgtgtgcatacttcactatgatatgaggcagtctctggtaagtgctgtaaaaggattaagtatagactaagtctagagggaatgggattacctaagggaatcaggaagggcttcatagaggaggtggcatttaagattgatagatggatagaaaatcactgggcagattcatacgttgggagatttttttttttttttttttttgagctagagtttcgctcttgttgcccaggctggagtgcaatggcgcgatctgaac

SEQ ID NO: 114648 - DNA, 1106 bp, Homo sapiens
ctagagactgctctcagtttttgtcaaataggtccgttcttatatttctgccataccatagtgaaatgtcaactgatttgcccattcttcttaaaaatcgttttttcctctgattcagggttacaagtacagatcattatttcctaagtgatggtctgtatgtacctgaagaccagctagagaaccaaaaacctttacaattggatgtaattatggtaaaaccttataaactctgtaacaatcaagaagaaaacgatgcagtgtcttctgctaagaaaccaaagctagccctggaagattcggaaaacactgcctctactaactgtgactcttcttcagaaggactggaaaaggacacagcaacacagagaagtgaccagacttgcctagaaccatcatgttcatgttcttctgaaaatcaggaatgccagactgctgccagcactggggaaattctggaaattttgaagaaagggaaggcatttgttttagatattgacttggattttttttcagtcaagaatcccttcaaagaaatgttcactcaggtaaataattgtgtttttaacacatagatcttgagaattgtatggcttttctctagatgaggaaccagcaaactctttaaacagccagctagcaattattttaggctttggggttcacattctctactaatacccttttctgttgttttctaaaccttttaaagttgtatataccattcttaacttgagggccatacacaaacaggctataggctgtggattgccaactcctgctctagatagtattcattattttgcatttattaattggggtaatgtatacatgggtgatggataaaaattaagtcatacagtacaggtatatacagtcagccctctgtatccgtgggttctgtattcctggatttaaccagccacagataggaaatattcagaaaaaataaaaaacaactagaaataacaatacaagagtaaaaaataatacaaataaaaaacaatacagtataacaactatttacataggatttacactgtattagataccacaagtaatttagagatgacttaaagtatatgagagggtatgcatatgttata

SEQ ID NO: 114649 - DNA, 1046 bp, Homo sapiens
aggctcggcggatcccctgcgcagcgaggcgaggagcggaccccagcgccggtgcgtgccggccccgggcagcgggacgcggcggggcggcggctgcaggcagccgaggagccgcaggccgaacccaaggcaccgggattgcgcctcccgcggctgccggcgaaccgcggctctgcagctcggggcaggcgcggcggcggcaccggtggtggccgcggtggcggcagctgcgcggggacccgccgggcggcgcctgggtctggacgcgcgaggaagccgcgggagcctcggccaagccgcgagcaggtgaagcgaccgtcccgctgcagccgggacgcgcggctccgggtgggcaggggatgggggaggcccggcacccccgagaccgtgtgtgcccaggaaagtttagctacaaatccgggtgcgggaatcccagccctggcagggcggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaagacagggccgggacctcctgctcgggcgcgcatcccgggtccccatccctgggccgtcttctggtcccttcctccgacaggagtggaggtactcaggtactccggcctcaggtaatgtcttggggaccatcctccctcgggcttgtttcatctctcaacccccgcctctttgcccagatgagacgttagacgcggggcgagggaatgcagggggcgcgcaaagatcaagggcatcttagggccggttattggcgtctgccggggagatggggaacatagtgatagggaaatcctgctctctctctgaagtcgagtttctcctaaaatctggtttctccctccctctgttcctctctccctccctcgggtttgcgtttgtgttttaagtctttgagctgcctgtggtccccgctatttggaaaatccattaaagcgcaaggc

SEQ ID NO: 114650 - DNA, 1050 bp, Homo sapiens
ccatcgctttatctgcttctttgccaatactctaaccgtcctatcttttttcctttagttgcccccacccaacaaattctctacacaaaataagttcaaccactggcattttctgcccctatgtgctagctgctaagcatttctatgaaagaaaaaataatcacccagctgtttggattggtgcaatcgcagaataatggtctctaagctcatcagatccacaggctggcagacaggtggacggacagtcttcagggccccagtcaccccagggtctattctaactcttcccctccccttcaaactttgacctccctgtctcctccctccctctcagcaaggaatcttcatattttcttcacagaggatgatcagcggaaactccgttcatcctgttccctcacttacaaaggatctatttccacctccagcctgcgctctttccttcctgcttctgagaaaatttccctccttttatcaaagatttccccaggagctcaggagcgtgtctcctctcttgcctgtaacgatcatatttgatcagtatactttcttttctgccgttaacctctctgtgtctgtgtttcctctccaccatgtttaaacctcccccttctttaactaatacctctttgtctttatatccttaacaaccccatgatttgaaaatttggtctatgtgggctgttttcacttttttttttttttgagacggagtctcactctgtcgcccaggctggagtgcagtggcgcagtctcgtctcactgcaacctctgcctcctgggttcaagcgattctcctgtcccagcctcctgagtagctgggattacaggcacacgccaccacgcccagctaagtttttgtatctttagtagagacggggtttcaccatgttggccaggctggtcttgaattcctgacctcgtgatccgcccgcctcatcatcccaaagtgctgggattacaggcgtgagccaccacgcctggcctgttttcacttcttaaatctctcattaattccacaatggatggtgtagtttgattttgctc

SEQ ID NO: 114651 - DNA, 1012 bp, Homo sapiens
gagtttactccaactaaatatattgtagtggcatagcttagattccttaccagaagcggaaaatgcatagtataggaccaaaagagggctgtaattttttttggaacatcgcattctttcttctccctaagacgcatagatagatataattatatgattggaaaattagacccaagtggcgagtttaaaggaactggggctggttaaactagaggcgagagcgagggtagcaatgatggtctgaagcagctgctgtgtgtttcctggaggacccacggggagggggagagctactacacaagcttcgcagaggggcttaggcaggggtcagtgtttgaattggacactctcgtgtctgtggtctgttttaagtttgggtgtgcaaggccaatatgaacagttttctttctttcaagtccgtggttagggcaaactgtcccccgggagaatgtcggtgccttagttgatagctttgtgtttccggaagcctggcttccaataaaggtggttaattgggagaagtggaatggtacattcttgctttccaattaagaacaaggcttcattacaacaaataaggccagcacaatccaatactattaactttgtatttaaataagagtgtaattttaaaggttaaagaaatgtgaaaataagcactaatccccatttaaagttcttaataatggtttaattgaactctgttaattttctcctccaagattaaatagaactagcgcattctcagtctttcggctgtgtgtgtgtgtgtgtgtgtgtgtgtgtgtgtgtgtgtgtgtgtgtgtacatggtttacacattttgggatttcaggacagctaaccctcaaaagccctgcaggtgaatttttacgtagaccaagacgctccatttccaccacaagctaccttgtaccttttgtatcctccacccctccctttcccctgactttccagccataagcttacgcagaaagaccccttctcccgatcatggggagtgtgcacaccag

SEQ ID NO: 114652 - DNA, 1051 bp, Homo sapiens
accatccttttaggacaaatttcatggagtgaaggtattaaatcaaaggacatttttgccaaattgttttatacaaattattttaccaaattacacccctaccaataatgtatgaatgccagagtgccagaagcatttccaggttgggtattataatttaaatttatgttttcttaattgaaatatggctcattttgtagttttaatttgcacttatttgatcaggaagtttggccattttgccctaatttttttttttctattttattttacttgtcatctaaacaatctattcatgtcctttgtccattatctcttggggccctcatctgcagcactggatatgcatttaaatattatagatcttaatctttttaccccatgtggttaaaattctccttaatcttttaaatgttgttattactatatggaagttttaactgtctctgaggcaagtctgatttttttcttttataatcatcttttcacttcttcagatcttaggatgatgtcattttcccaaagacccacaactctcttctaccaattttagtgattacatttttaaatttatctttaaaatttaaatttaaatttaatgggcatttattttgatggaaattataaatctaattttttgtaaattactatctgattatctaaataccatgtaatcattaatttttctcagtttgtgaggtttgagttattattattattttttttttttgagatggagtctcactctgtcgcaaggctgaagtgcaatggcgcgatcttggctcactgcaacctccgtctcccaggttcaagtgattttcctgcctcagcctcctgagtagctgggactacaggcgtgcaccaccacactcagctaatttttgtatttttagtagagacggggtttcaccatgttggccaggatggtctcgatcttttgacctcgtgatctacccgcctcggcctcccaaagtgctggggttacaggcgtgagccactgtgcccggccatgatttttttttattacactttaagttctgggatatgggtg

SEQ ID NO: 114653 - DNA, 1043 bp, Homo sapiens
tttgtaacttacatctgagatatgctagaagaccttgatgtttccatttagattaatcctatggtgaagaccttttgtagaacaaataattttttaaaaaaagtcataagacatttgtcccaaatacataacagatatatatatgcatgtgagcgtaacttacagttgtgtatgtgttgtcatttcttcccccgcccccaattcattctctttcttcctctgtactaagaggattgtgtctgtgaactgcagcatctggactccttgctttttctgtttctggttgggttcagccaatgggaggcactggcaggggatcagaggaggaggaaagagcatctgggtatttatctccctagcagtccccctaaccttgctgggcttctgacgatggctgatttcttctaagcgcttgaggcactttcctagctccagctcctgcatagtctgataatgctgcttccttcccatgctcttcagacctagaggtcctagcagtttcccttctgttgttgctagccccagggtgctgcactctgcctgtctccggtctgcacctctgtaaacagtccctgcctaaaacagtctccagcgaaaccttttttagtgtgccttctgtttcctgctggactctgactgatagtctatgtccatttctttctcatatataatcttaattgtcatgcttggctctaaaatgccagttacgtttactacatctgaatttgaattgcatccttttttttttttggagacggagtttcgctcttgtcgcccaggctggagtgcaatggcacaatctcagctcactgcaacctctgcctcccaggttcaagtgattctcctgcatcagcctcccgagtagctgggattacaggcatgaaccaccacgcctggctaatttttgtattagtagacacagggtttcaccatattggccaggctggtctcaaactcctgacctcaggtgatctcacctcagactaccaaagtgctgggattataggcatgagccacagtgcccagtcgaattgtatcttgta

SEQ ID NO: 114654 - DNA, 1024 bp, Homo sapiens
acctcaggtgagccaccgtgcccggccaggcttctgcttctggggaggcctcaggacacttacagtcatggcagaaggtgaaggggaagcaggcacatcttaaatggccggaacaggagccagagagcaaggggagaggtgcctcacacttttaaacaaccagatttcatgagaactcactatcatgagaagagcaagggggagatccacccccatgatcctgtcacctcccaccaggtccctcctccaacaatggggattaaaatttacataagatttgggcggggacacaaatccaaaccatatcaagactgaagaggagtcccttggggaaaggaaaggcactgagctgggtgaaaggtcactggcatgttccattggaaatgtcaattccttacatatgacacagaaccaactagggtgaacagagttcctgggattgaaaagtgaagatagagaaagaaccatctggaaatcattcatgggcatcattttgggcatttcagaattctcctttgaggtttattatagtcagcaaatggaaaggacagaaaaagacacctggtgttctgactgtctcagggataacctttctttttaagtagtatggttaatcatgctagtttaagcttctcttttgatttttagggtagccttaatcattacaattcttttatcttccattagacttggctcatccctagccaggaaataatttggaaaataaaaaagatgaaggttacagtgctcctgaggagggaagtgcagttccctcctgagtggacccccaagatctcattgatggcaccggcacttagccagcaagatgaccaggaggcttttctgtgctactccaagagtgggtgttttgtgtagcttttccaggggaatcctgggtggcatgtggttcctggcttcctgctcttgtcaagtaactagtggcctgattggagctggcagcccctttgggaaccgctgagtgctgacttctgagtctttcaccacggctgtgcactgagctctc

SEQ ID NO: 114655 - DNA, 1050 bp, Homo sapiens
gcgcttgcaggccgggcgtggtggctcatgcctgaaatcccagcactttgggaggccgaggcaggtggatcacctgaggtcaggagttcaagaccagcctggccaacatggtgaaacccccgtctatactaaaaatgcaaaaaattagccaggcttggtggtgggcacctgtaatcccagctactcagggggcagaggttgcagtgagctgagatcgtgccattgcactccagcctgggcaacaagagtgaaactccatctcaataaataaatagataagtaaaaataaaaataacttctccctttcggattcccgatgcggtggttgctgtaaggggtcctccctgtgccacacggccatcgccatggtgaagctgagcaaagaggccaagcagagactgcagcagctcttcaacgggggccagtttgccatccacttgggctttatccctcttgtgatttacctgggatttaagaggggtgcagatcctggaatgtctgaaccaactgttctgagcctactttggggataaaggattatttggtcttctggatttggaggcaatcagtggacagcatgaaagatgtgtgctctggctcggataagagatgggacatcattcagtcactagttggatggcacaaggctcttcacagatgaacctgtagcagagtggaacttgtactaacttatgatagaatgtatcagaataaatgtttttaacaatgttaaaaaaataaaaataaaatacacttgcagtaagtcacagtggcatggggtatttgttgaatgcacactctgtacaggtgcctggacaagcacaacatcagtgactgcccttgaccacttcggcacactggtgagagtcaagcttcaagcttattcccctgtcaaatgagaagaacactagagtcgtgtctcctgcttctgacccacctgggctgcacctccacactcggtggcgttaagatgcaccacactcaggggagtcattagggaggaaacagccacatcgccttgagtttctgaaaaccaaatgaatggcagtg

SEQ ID NO: 114656 - DNA, 1050 bp, Homo sapiens
tttatgttttgaagagttgaagaaacaaagaagaatataggacagagatagtgacccacaaagcctatccgatctttagaaaaaaacatttgctggtttgctggttggtctgttgatttccgcccccatttagagacagagtttcactctgttggccagattggtgtcaaacttttgacctcaagtgatctgcccacctcggcctcccaaagtgctaggattacaggtgtgagccactgctcccagcactccaccttgacctgttgattttttaatatcattggtgaataatgtgatcagtgggttgatgcagcaagttaagccctcagcaatttgaatgggctcttgtttgggaaactgattttagtttcttagtctgtattggtgccatcgcctccaaatgggtagattcaggagttaggaagttgaagcttttctgcagggtcccaacaatagtaaagaaatattagatgaactatgtgcctgtggttggattttcaccctctttcctggtttatgaacctgctggaaaagacacctatgagtccagccatgtattgactgtgtgccctactggaagaacccattggggaccaaaactctggtaattcacacaagtcattcacttctttctcttttgcatactgaatgctggctagacttccacaatctgagagcatttggtgttgccactttggaaaaaaaaaagatgttttttgcaattataaaaaaaagacagctgaataccatgttttctcatatttagaacaatgtttctttattgccctctaagaaagcttactgtaggccctccaaccttacctctgaacatgcagtgctcctctacccagcacagtatttcattgttatgtcatttctaataaaggaagaggaaaatctggtgaccttgttcatgtttaacttgtgtcgaaacttcaggcctcggtatggagccatcttgtgtaagtagctttttgtccattgcagaaacacaggaaagcatctcacaggagattgttgtttactaccgggacatttcaaccatctttc

SEQ ID NO: 114657 - DNA, 1018 bp, Homo sapiens
ttttttcgttttgtttttttgtttttttgttttttgtttttttttggagttgggggatggagtctcactgttgcccaggctggagtgcagtggcatgatctctgctcagtgcaacctctacctcccgggttcaagcaattctcctgcctcagcctcccaagtagctgggactacaggcgcacaccgccactcacagctaatttttttttttttttgtattttagtagagatggggtttcaccatgttgcccaggctgatctcgaactcctgagctcaggcaatctgcctgcctcggcctcccaaagtgctgggattataggtatgagcccccgcacccagccatttctgtacttttcatagtccccttttcagcataatgaatcctcaaggagccatgtgcaatactgacctagagaagagatctgattccttctggggatcagtaggggttcaatggatgggtggcatttgactattccataggacttccacaggaacacctgcagaaactgatgacattctggaacagaaaaataacatgtacagtggtcctcaaataggaaattttgaagtctgtccagaaatccacaaagtctattgagcaaaatgttcagcccatgcttctagtttcagactatggaattttgacttcttttgcaaggaaagtgactcactgatggcttttcagttgagtgacagggtcagagtttttaagattactcaagcagcgtggcagaggaggagtgggattgaagaaaggcaggatggaggtgaaaagatggatttggaggcctttgctgtacctagtcccattgagaggtaaccagagcctgtgctgcaggagtgatggtcatgaggatggagaggcgggaagccgtgtgagtgacaggcaatgggaggtcacctgccagtcggggtgctggcttctgggagcaagggccccttggcatggagggagaggatgaaaagtttccttcccttttttcctgaaggcagggctggccctatgcaatattt

SEQ ID NO: 114658 - DNA, 1133 bp, Homo sapiens
atgattgccaaaaaaccctatgctttccttttcctctgacaactaataacttatgtctcagttccttttcctcccaggtagcaatctgaacgtcagtataatctcaagctcagaaatgtgtgaagagtccctttaggcttccatgctaaaggaaactttatttttaagacttgatatgtttcatattttaaattcatatgaaattcctactatctcaagccttctctgcctgaagttttccacttgagcgaaatcatgatttttgctacctctattacccttttgaatggaaactttttaattcatgtaaagaaatctcaggctttttggtagataatactctgcatctaccaaactactgaaattctgggtatcgtttccctttcatctttagcattttgaatgaatcaagcatatatacatgcaacacttctaacttacctttgcaaattatttgtaagtactataagaagcatgcatgattagatctttaatgaagcacattaaataactgcagaaatcaaaactaacagccaagagaaagcatagactgtctttgacagctacttttgccaaacctgataattaccaagaatccaataatactgcactggggagtgcctgtgggtgaacttaatgagaaactcttctgaatgttgaatgaaaatgtgagattacagtacctaagccaggagaggaattggcctctttgctctcctgataagtgctgcgtgctatgacttcatccatttcctgctcggaaacctgattttcagcagaaagcaaagattagatggttttatttatttatttctcccaatgaaagtacctaggaccagagtcagagtcaagtgcagataaagaggcaaaccacagggccaaggattatgaccatcctccgaagctgtaactcagagcatgtaagaagtccagcaacacacacataacaagacttttcaactggtgcccaagttcattaagcaaagcattcagtgctatgattaccaacaacacagctgatatctgcctctccggaaaactcacttcaatttttttttttttttttttttgagacagagtctctctgttacccaagctggagtgcagcgtcttgatcttggctcgctgcaacc

SEQ ID NO: 114659 - DNA, 1076 bp, Homo sapiens
caggagaggttgtaggggagataaaagggataatataagaaagcagcccctcaattattaaaaactagaaaattataaacaacctcaaatatttttttctttttcagaaagctgggcgtggtggcgcatgcttgtaatcccagcactttgggaggcggaggcgggtggatcacctgaggtcaggagttcgagaccagcctggccaacatggtgaaaccccatctctactaaaaaaaaaaaaaaaaaaaaaaaaattagctgggcatgggggtgggcacctgtaatcccagctacttgggaggctgaggcaggagaattgcttgaacctgggaggtggaggttgcagtgagccgagaatgtgccattgcactgcagcctgggcaaaaagagcgaaactccgtctcagaaaacaacaacaacaacaacaacaacaaaacggcgttctgtggcctaaatggaggcccttcttgtcttcctggttttctctctaaaattatagagtacccacatctaacaaataccaccctgctttagacgctctaagagaactcagattagccggcagaagaaacatttacatctgcccatttttctctcttttggtatttctatgatggcagatgttcctaccacaaagaaatgatacatttgatgtgatggatatgctgattaccctgatttaatcattgcacacttgggtctctttatgccattcaccctctgatggcaaagccgcaagcgtcaggctcttgttctatttggttccctactcctgcgtggatgcagcagggccctcatggacctctcagtcccagtatctggccagtggtgtgtgggtttggctcacactgggggatgtgaatgatgtacttcagtgtaaaacagtccaagtgccgagctcaagaggcttcctttttagtgcaggggctgaggctaactagggaaaacatacagaatacgaaagctgggatacaggtctacaccgagctctggctgtcttgacgaattcagaggagtgggagagtgagaagccagattatcccaggaagacttgacagaggaggtggggacatgaa

SEQ ID NO: 114660 - DNA, 1114 bp, Homo sapiens
tgcctgtgatcccaactactcgggaggctgaggcacgagaatagcttgaacccaggaggtagaggttgcagtgagctgagatcgtgccactgcactccagcctgggtgacagagctagactccatctcaataaaaataaaaatatttcacttgaacatatgtattgaatattttaaaacatgtcagaagtgtcctgttaagctccagcattggtcccataacttcttgaggggatctctgaattcatagcagttccccttgccattggcagtgaatgacatttctgttcagcactcaggatttattcttccattagtttggaatggaagttttgaccaaaagagagcagaaaatacctgttctcttttgtatagtagaaaggagatcattttaaatgcattcttataaaatgaagaaattgcttttttctttaatgttcttcaaatatatttatattatttagtttggatcaacttctagtctcagcgggggaccagcaaagattacagtctgttttatcgtcagtgggatcgaaatctaccatcctaactctcattcaggaagcgaaagcacaatcagaggtgagtgaaacacagaaagctcaggaacatgaattgcggccgcgtgagtgcccaggtatgtgctgcctgcccagacagccgaggagagcccgccccgagtcctggagagggaggactgccttgggttgcgagtttcacagctcagtctgactttggcctcacgtgctgctagccagcttcagaagctagaccttgtcttgaatgttcaggtgccagatgggtgtcactgctgttttcatcccccaagtagcaactagttaccattctcctaactcctatgtgtggagtttgtttgcagagagtcctcaaagcagagctagtcatctcggaaatacctctcgccacctaactgtggacataaactagtcaagggagccacctgctggtgagagaagagttacattggtgtagtcccgccgttgccctgaaatatggtggacccctgaacaacatgagggttggggcactgaccttcgagcagtggaaaatccacatataacttttaactctcccaaaaacttaactactaacaa

SEQ ID NO: 114661 - DNA, 1054 bp, Homo sapiens
gttagccagggtggtctcaatctcctgacctcgtgatccgcctgtctcagcctcccaaaaagtgctgggattacaggcatgggccgccacgcctggccaagtagatgctttttattgagctctgtgaggtaggatcccagatcatccaagtaggagggggaaggtgaatgggtagggtttttgagaaaaagaacattattgtgaaaaatgagaggaaaaactgacaaggaaacaagtgctgagtggcagcgagggtccagttaaggctggaaactgtgaatttacagcagcagcgttctgtctagttgtgggattttcctctaggaatacggttataggaaccaagatgctggctatttggaagggtccagaatcgcctggtaagacacaacagtggggcaagggatctaagcctgtgggctgggcagagtttgctgtgctacgctagggttctggtctgagaagggaatggaagggtggagttctgatagggagaaaactgtcaagggctttttgaaagtgaagacgtgggaggaagtgaccaggaggctgggagcgtgtggtaaaagagtaggatgttcaattgtaagaaagatttagaggtggaaaagttttggattgtgtcaagattgtgagtgtggcctggaaaagggtggctaatttgagttctattgcctttgtacctctgatgcatttaggtgacaataaacatttctcatctcaatattactctattattaacaaacaaacagccaaaagagaaaaaaaaaatcaagtagtaagcagagtgtttattttttttaaaattacttaaaaaaggttgtttacagagatgtggatttatataacttggtgacaacatttttaaaatgtacaggctatttcatattattgcacttactctttaatatataaggcattttactttacataaataaaggttaatgtataatatcatacaaagttatggtgccaattaagtcaaccatcaaattcaatgagatgtgtgggaagatggaaatgaaacccagcctactttaatcttcatggtata

SEQ ID NO: 114662 - DNA, 2818 bp, Homo sapiens
tgaaaatttgtatccttccagaattagctttatattgttatcaaataatagcatggcctaaacaggctttcctacctctataggctgtatatgtgtagcagtttcaggaataacatattaatcaggaagcttttttttttagtctattagttgcagactggtgtttaatagaaaacttatttggctattggctgctttttgacttcagctggaaggaagctcaaacataatatttggctcatttccacataagactaagggttactgactctggtctgaagactgcttgcagtttagtcgtctgagtgactcctgtggctgaggatgtgctgggtgcttagaatccaaaggtctggctaggcttaaggggttcatggtctagttagggagaaaaacatggcagattttcttctgtttttcttggggcaaaatcagattttactgtttaatagtacaaaatttttgcaaaattagcagataatactcatcatttctaacttctgaaatcttttgtttaggtgagacatggaatccattaaaattgcattatcagttaagaaatgtacgggaacgattagctaaaaacctggtggaaaagggtgtattgacaacagagaaacagaacttcctactttttgacatgacaacacatcccctcaccaataacaacattaagcagcgcctcatcaagaaagtacaggaagccgttcttgacaaatgggtgaatgaccctcaccgcatggacaggcgcttgctggccctcatttacctggctcatgcctcggacgtcctggagaatgcttttgctcctcttctggacgagcagtatgatttggctaccaagagagtgcggcagcttctcgacttagaccctgaagtggaatgtctgaaggccaacaccaatgaggttctgtgggcggtggtggcggcgttcaccaagtaactctgctcggggtgaaccattctcctttctctcaagtaaaccagtagtttttcttctgttgacttctggttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggtttctggtctactttgactttcaaagtacctccagcctcctcatacgcacagcttttggatgacctcagcttgagtttctccatatgtgcatgtacatctagcattctgcctacagttcagacagaagtcacaaaaaggccttcaactcaccaaaggtaaatatctgtatctattaggacattttttacatagacttcagttgagatgtatacttagcaaaattatttttaaattgaaacagcacagtaaatacttaatataaaatgtcccttggattttgcttcccatgtaaatctattgtattattacacttgttataattttaactataaaggtccaattgtttcacagagccagtttgggatgggctgcattccatttatgctgtatatagtttgaattatatataaattaccccttcttctggccacccctgctcccatcttagtattttgcaagatctaatcagttgtacacctggtgcccctcgcttgcttcaatcatggttatttgatggcaaaatcgacctcttgtcgctgaaggagagagaaaagatgtgtgtctgattggtcctgggattttttgagctgtgccatttatggtactctttgcctatgcatccccttgttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtgcctgaatcagagcaagcatgtcatttgtgtttttgtattctcatttagttttctttcaaatgaaatgttacttactgtagcattgtaatattttaatgcagggcttgggtttcttaaagggccagatagtagatattttaggctttgtgagccgccagctgtgtcagttgcaactactgaactttactgaatgaaaactgttatagataatacaaataaataggttagactgtgttccaataaaactttatttgcaaaaacggggctggtcaaggccccagttttaatgcatggaaaaaagacagatttttctatccattggagtaaccttctttaccttcaaaaatgatactgctggtggtaactacatgtaggaactattaaa

SEQ ID NO: 114663 - DNA, 1027 bp, Homo sapiens
agaaatttgggtaaaatgtgaaactaatacttagcaaggttttttaaaaaacaatgtcctgtgagttttagattggctgttgatgccagaacattgcctgtagcacttgagttgcttgctcttgacatacattgggaatgctgctgcttcagaataaaggaagggaatccagagtgggagaaggaggaaaaaggactttttttaaagttaaaaaaattaaaaaaaatctcctggcaaataacatgtaaaaagaagaaaataaaaaatatctatttcccacctaattgaaagtatcaagataccagcttgctgattttttaattgtagtaaaatatatataatgtaacttttaccatttttaccatttttaagcatacagttctttggctagcttgctgatttttagatttttaaaaattttctgttgcttcaatataatatgtggtatcaaacaccagttattgcaccaataatgacatatgtgctatgaaatttaaaatgtgctctcagactgaaagaatcttaaaatccatttggggaacagttttatacatctaataatttgatagaacagatgagagtttgacagtatggttctctgaaagttcagtagttcagagaaaagaaaaatccttgggaactttagtagttacaagaggaagtggagcttagattaggcctttgaagggtaagaatgagatgcaaagaaagaaatatacttgttcagagggattccttgccgtgaagccaaggaatgttttaataaagaacagtttctttacctggggtggaggatacccaggggctcattttattattatttatactgtacatgtatacatgttaaaactcttgataaattttaaacattttctaataatttaaaattagtatacataagtttgaggcaagtcgagagactacgtattttgtttgttttgttttgtctttgggacaaagtctcgccatcacccaggctgtagtgcagtggtgcagtcacagctcactgcagtcttgacctcccagg

SEQ ID NO: 114664 - DNA, 1013 bp, Homo sapiens
tcccacctcagctacccgagtagctgggattacaggcgtgcaccaccacacctggctaatttttgtatttttagtagagacagggttttgccatgtgggccgggctggtatcgaattcctggcttcaagtgatctgcttgcctcagcctccccctgggattcaggcatgagctactgagtctagccaattttcattcattattatatctaatctggttaggttaaatattggatttccttaacataaaagtaatttaaaatctgaactttgatactacatgaaagcttgaggctttaagcataatgaattatttatataattgtttgtttttcatttaatgagatcaactcagaaaaggcattcgtggatcctttcattctttttgctttctttttaggtaatctgtaagtcagatgctccaacaggggatgttcttcttgatgaagctctgaagcatgttaaggaaactcagcctccagaaacggtccagaactggattgaattacttagtggtaagctgctgtgaataaaccaaaaaccaacttctgtttaaaagattgcgaagtttaaatccttttgaaaggaacctacacaaaatagccagaagcttgtttagttatttaggcaaacttgaaagttatcagtcatagagtggggaagtaatggtttttataaaatttcattctctttaacaatactgaacagatatagaatgcgaagataatactcttagagctcccatgttctttatcaaaattaccacatgctaccttaatctggataggctaggttaagctgtggtggtaacaaaccccaaaacctcagttgcttaaaacaaccatttatttctcattcaggctgtaagtcagtcacaggctacctcatcctcactctggcagccaggcagatggagccactgccacctggagcagtatcagtcactataataaaaggaggaataccatagcacatcactctggctcttaagtttctgcttagaaatgacatgtgg

SEQ ID NO: 114665 - DNA, 1017 bp, Homo sapiens
tacaaaattagccaggcgtggtggcacacacctgttattccagctacttggaaggctgaggcaggagaattgcttgtaccggggagggcagaggtttgcagtgagccgagattgcgccactgcactccagcctgggtgatgagcaaaactccatttccaaaaaagaaaaaaaagaaaccaagaaacctttcttacctctataatttgttagcaagttttaatgacatttgtttaaaaatttgtttcttcactgatgtgaaataccacctttataatataagattgagtatcctatatctgaaatgcttggtaacagaaatgtttaagattttggaattttctggattttggaatatttgtattatacttaagcattcctgacttcaaaatttaaaatccagaatgttccaatggatgcatgttggtgctcaaaaagtttcagattttgaaggagttcggattttcggattagggacgttcagcctgtactgaattcttaaatataatttagtcttatttctgggactaataataatgcttaaatgaatttctggatcacatagtccaaggttcggtgatgagtcagtgagtataaactgtcctagtatgttgctttactaattattgcacagtagcttttttttttttttttaagtcggagttttgctcttgttgcccagtctggaatgcagtggcacaatctcggcccgctgcaacctctgcctcctgggttcaagcaattctcctgcctcagcctccagagtagctgggattacaggcacctgccaccacgcccagctaattgtttgtatttttagtagagatggggtttcatcattttggccaggctggtcttgaactcctgacctcaggtgatccacccgcctcggcctcccaaggtgctgggattacaggagtgagccaccatgcccggccagtagcttgcttttcttttctctttgagatagtctcactctttcgtccagggtggagtgcagcggcgtgatcttggcttcc

SEQ ID NO: 114666 - DNA, 1065 bp, Homo sapiens
cctcgggaggccgaggctggcggatcactcgcggttaggagctggagaccagcccggccaacacagcgaatccccgtctccaccaaaaaaatacgaaaaccagtcaggcgtggcggcgcgcgcctgcaatcgcaggcactcggctagctgaggcaggagaatcaggcagggaggttgcagtgagccgagatggcagcagtaccgtccagctttggctcggcatcagagggagaccgtggaaagagagggagaggagggagaccgtggggagagggagagggagagggagagtcatttgcagcttttaaaagccataattttgaaagacttgacattaaaaactcagaagtgttattgtgcaatttacgcataggctattgatcttttcatcagattatgaatacttttcagatacctgtctgttgaaggtctgtgtaggtgcttctcttaatagaggtaatattggctagtttttagaaatttaacttcaacctcaatctcaaatatttaatactgtttttcttccagtttgttgttgtgtttcttgagcatggtgtttcaaaactagtttttttcctaaatcagtgtcctaatgaatctaaaagttttagatcagagcggaatgcatcttgattaataagctatagagaataatagttctgtaggaaagaacaccattcatgtatcttttttttttttttttttgagactgagtcttgctctgtcacccaggctggagtgcagtggcgtgatctcggctcactgcaacctctgcttccctggttcaagtgatttacgtgcctcagcctcccaagtagctggtactacaggcgtgtgctgccacacccagctaatttttgtatgttttgtagagatggggttttgctatgttgcctgggctgctctcgaactcctgggctcaagtgatccgctcgccttgggcctcccaaagtgcaaggattacaggcgtgagctatcatgcccagcccactgttttctagtatacagagttgcggtaaagtctggtgcccttctgattttcttttccttttttttttttttttt

SEQ ID NO: 114667 - DNA, 1118 bp, Homo sapiens
ctcaagccatcgtcttggctcagcctcccaaagtgctcggattaaccttgtggttttatcctaaacagcaataaatgaatggtattctaattctctgtgaagctaacttggctaggttgtctttgcctgagcttcttaacttgtccacataaataaatcactataatctggggttaactgagtattccttggagtttgcagggttctgaaagaacctaataaacacacagcttggtgaaatgtgagttatgtttctaaacttatgacctctaaagttatttgttgtttgtatgtaagaataagtggtggaaagataagcccccgaaaattctcgattagtaatttatgttaattgtattttttcagtatattattatagaaagacaggaaaggtaaaaggcaccaaatatgactttggctgataatatttctgttttttactctgaattcaaggtaaattagctattttgttttatttcttcttctttttttaatagggttacacatcattttggaatgactgtatatcatctggattacgtggctgtatgttaattgaattagcattgagaggaaggttacaactagaggcttgtggaatgagacgtaaaagtctattaacaagaaaggtaagaggagtgctgagtaacattctttttaaagaggttgtactgcttaaaatgtatgtttttactagtagccttcaaaaattaaagtggaagttgatattaaagttgtctttcttcaattgtatttccatatcttttttgcattcttggtttcctggttctttcacctacaatgagtaatgtaattgattgttaaggtaaccggccactggatcttacaaattcagaaagattctagacttcatttgcagcttttatttatttatttatttttaattttattttattattattattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaag

SEQ ID NO: 114668 - DNA, 1050 bp, Homo sapiens
gtaggtgtatttatctctacctttgttctgaacctctggtcagtttcctttttgtaattcctggcaaaactggtttgggaaatttggaaacttgaagtaccacttgacttctgatttttatttttttattttttatttatttatttttcttttttgagacggagtctcgctctgtcgcccaggctggagtgcagttgtgcgatctcggctcactgcaagctctgcctcccgggttcacgccattctcctgcctcagcctcccgagtagctaggactacaggcgcccgtcaccatgccctgctaattttttgtatttttagtagaggcggggtctcaccgtgttagccaggatggttttgatctcctgacctcgtggtccgcccgcctctgcctcccaaagtgctgggattacaggcgtgagccaccgtgcctggcccgacttctgatttttaggtcaagcccagagtcttccttaaagaatccttgggattggttccatgattcctcttttccagatactgcttagcctccagacgtatcagtagcctccaagcctccaaaatgactccagtcacaattaaataaaatagcacatgtaaagtgcctgatagttggtgcacaataaatattaagtttcattacgccttgatgctccaaatcagaaaactcaaaaggccttgacctcttccagcccttgtggtcagcagttctctccacctttccatattctcagctttggttttttttttttttttcctcagctttggttttttttttttgagacaaggtatgctctgtcacccagggtggagtccagtggtgtgatctctgctcactgcagcctcaaacttgctgggctcaggtgatcctcccacctcagccttccaagtagccgggactacaggcgtgcgccactatacctggctactttttgtattttttgtagagatggggttttgctgtgttgcccaagttggtctcaaattcctgggctcaagtgatcctccctcctcgtcctcccaaagtgctgggattacagatgtgaaccac

SEQ ID NO: 114669 - DNA, 1521 bp, Homo sapiens
ataccatgttgtgtagctaaagtgaaattagaggttatttagtatttatatgttccgtttaatccaagtattgaacagcttctctgtgccattcattccctttgccagatgctggggttacaaagaaaaaaaatatatatatatatgtatatatttttgagaccaagtcatgctctgtcgccagactggagtgcagtggcatgatcttggctcatgcaacctcctcctcctgggttcaagcaatccttgtgtctcagcctcccaagtagctgggattacaggcacatgccaccatgcccagctaatttttgtacttttagtaaagacggggtttcaccatgttggccaagctggtcttgaactcctggcctcccaaagtgctgggatcacagatgtgagccgctgtgcccccggccacaaagaaaaattttttgcttttaaggagcattcagtctgcatagaagacagatttgcgaatgatttcaataaagtgaattattaactttatcctgcctgcctcttctgagttactaacttttatgggagtatgtgttaggtgcagtaaggatgtacatagggaggatgctttggatcaggacctgcaagactgctgtgttcttgacacctagccttgcccttgagtagttgaaagaattagaataaatattttgaattttagaaccttagttttctcctgggcaaaatgggcctacttttttattttttatttttgagacggagtctcgctctgtcacccaggctggagtgcagtggtgcaatcttggctcactgcaagctctgcctcccgggttcacgccattctcctgcctcagcctcccgagtagctgggactacaggcgcctgccaccacacccggctaattttttgtatttttggtagagacggggtttcactgtgttagccagtataatcttgatctcctgacctcgtgatccgcccgcctctgcctcccaaagtgctgggattacaggcgtgagccaccgcgcccggccatgggcctacttttgtgttctgtccgaaagcctctaagttgtagggatccaatgtgttggcatatgtgagtgctttgaaaaccacatggtgctgaacaaatgcaaatgggtaattacctagcctagagaagtaagttaaagtttatagtggtcttgacaagtgacaagtatttaatatttccattatttttactatttcttgattctcttgcactttatatgctgggcttactgaacgttttactcaaattcagatgctcatctatgcgtgtatttttttaaaaattttaattttttttttttttgagacggagtcttgctctgttgcctaggctggagtgcagtggcccaatctctgctcaccgcaagctccgcctcccgggttcatgccattctcctgcctcagcctcctgagtagctgggactacaggcgcctgccaccacgcctggctaaatttttgtatttttagttgagacggggtttcatcgtgttagccaggatggtctc

SEQ ID NO: 114670 - DNA, 1069 bp, Homo sapiens
gtgcagttccttgttctttggatgaaaaagtaaactaggggtatagcgtcctagtaatgtaatttttagaaaatattcaactttaggtttcaaaattggaaatcttgattataaacatttgtctttttttttttctttttttagacggaatctcgctctgtcgcccaggcctggagtgcagtggcgccatctgggctcactgcaacctccccctcccgggttcaagcgattctcctgcctcagcctcccaagtagctgggattacaggcatgcaccaccacgccctgctaatgtttttatttttagtagagacggggtttcaccatgtttgtcaggctgcttttgaactcctgacctcaagtgatccacttgcctcggcctcccaaagtgctgagattacaggtttgagccaccacgcccggccataaacatttttctttttggacaaaaataacattattatagacattttagaaaatacaaaaaaaaagaaaagcaaaattaaaacatattcctgagtgaacattttggtttatagtttttgagagttttccgtgtggataaaactcggtggaaaacaaaaacctgaaaaaaaaaaaactaaaaaataagcttttggtgttctgagtcacactgagaaattatagtgaggaaatacctatttgttttttcaagtacatgttactctaaatcaagcttttccaacccgcgggccaaatgtggcccaggatggctttaaatgcggcccaacataaattggtaaattttcttaaaacattatgaaattttttttgcaattttttttttttaaagctcatcagctattgctagtgttagtgtattttatatatggcccaagacagttcttccagtgtggcccagggaagccaaaaggttggacacccttgctctaaatgtttaaggtgaagcatattaacatgctgtttttcggtgattgggtcttaagaagataatctaaataatttgttgaagtttaaccatactcacataatttaaacaatttaaagttatttggcgggtaattgaaaccatgtgttctgtttatttt

SEQ ID NO: 114671 - DNA, 1576 bp, Homo sapiens
gccgccgacaaggagcgggcggcgggcggcggcgccggcagcagcgaggacgacgcgcagagccgccgcgacgagcaggacgacgacgacaagggcgactccaaggaaacgcggctgaccctgatggaggaagtgctcctgctgggcctcaaggaccgcgaggtgcgggcgcggcgggctgggcggggggcggcggcgcggggcccgggcgccaggtgagctccaggtaggtgccaggtgagcgcccgaggcttccggcccgcgcacctgccctcgctccgaagtccgcgcctggtggcgcccagctgacgccgagcggtgtcggagttggttgaccccctggcgcggctggtgctttctggatcctccccgtagagatggcttggatttttccttacccctttcacagtcgctcctttcatttcgacaccctggcagtttgtatttcttcgtcgccttttttccgcgtttttaacccgtgtagaccccagggtgcaaatccaacccggagactgcccgggaaactaacagctggagccaccagcgccacgaactctttgggtttttgcaggctttaggacctgggaggggtgcccggatctgcttgctggggatgttttttttttcttcttcttcagttaaagcttactgttgggaattacgaaaaacgtaggcgaagtggtaatagagggaaaagctcttttactgagtaaagttaagttaagtttctcatgaaacctcctggtaaatgactttctaggtgaacttacattaggtgagagattatttttagtatcgcttttatattttatcagttgatgaatctcaaagtcttgccgtcttaagaaagggctttttcatcgagtgcttgaaatgtaggtttgtgagttgatcagaggcctcaaagcttcaggtgggttgaagttgcaatagataattctttgtattctgactttgaaagcgtttattttcacttcagtgtccaaaattttcacacacagaaaagttgaaaaagtgatagatacatatgcatatatactctttctagattctatgacgttttgctgtatttgttatatttgcctacaaaaatgattatttatttatgtggagacggagtttcgctcttgttgcccaggctggagtgcaatgccgcgatctcggcttaccgaaatctccgcctcccgggttcaagcgattctcctgcctcagcctcctgaggcaggcatgcgccaccatgcccggctaattttgtgtttttgttttgttttgtttttgagacggagcctcagtttgtcgcccaggctggagtgcagtggcgcgatctccactcactgcaaactccgcctcccgggttcaagcgattttcctgcctcagcctcccgagtagccgggactacagacgtgcgccgccatgcccagctaattttcatacctttagtagagacggggtttcaccatgttggccaggatggtctcgatctcttgacctagtgatccgcctgcctcggcctcccaaagtgctgaaattacaagcttgagccaccgcgcccaggcctgattttaagaaagtttt

SEQ ID NO: 114672 - DNA, 1396 bp, Homo sapiens
cggactgcagggttagctggtcctgctgtctcgtagcatctttttgtttttgttttgaaacagggtcttactctgtcacccaggctggagtgcagtggcacagtcatggctcactgcaacctccgcctcccaggctcaagtgatcctcccacctcagcctccctggtggctgggactacaggggcgtgctactgtgcccggctaatttttgtatttttagtagagacagggttttgccatattgcccaggctggtctgtaactcctgggctcaagtgatccacctgcctcagccttccaaagtgctaggattacaggtgtgagccaccacgcccagcctgtatctaacttaagagtaaaactttcatgcaaggtattgtgtggaggcctgaggacacagagtgggaatcctccacaaagtctaagaacaggaaatacgactatttttttttcttttgaatttttaatgaccaaaacaaagcatctaaaaccgcagcttctggaagaaccacttgttcttgcctgtcttatatctctcttcaaacttgaccttggcttctcgtggggccttgcgtttaagagcagggtctctaaagacatccttattgatgacagttttgtctaagggaataagatacccacagaataccttgtggccattaggtgattgtagttataaactttcacaaaagacttgatctttgacctcttggagatcttcttcttgcccatggcagctgtcactttgaggggatagcggtcaattccagccaccagagcatggctgaaggggctatctgaggtgccatcatcattgttcttcacaatgatggctttgcgtccagcgtagcctccagccaggacaagcaccaccttcccaggtttcatgaatttgcccattttggcagcaatcactcgggcctacagcaaaaaggcggaaattttgggctgttaacaaaagtccaaggctcccgctgtcattgtaaaacaccactgctggggaggtggtggtgatggaagcagggagctatagctctgcctgcctctaactgccagaagctactgacaccagaaggacatcaccattgccgaatggccaagttgacttaggtcaatctatgacatcctaccagatttactggaaattctatcataattacattatagttgatttactggatattcatggttatatctgggggcctccttgctcattccttagagctgtgcgggagcccagggcatatgaattctgctggtggccttctgtccaccatggctgctgcctaggagctctttgcctgaggtctatatgtgttagtttggattcccccagaagcaggctctggatcaaggatttgggtgcaagtggtttatctgggcagtgttcccaggta

SEQ ID NO: 114673 - DNA, 1027 bp, Homo sapiens
atgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaatactgtacttggtgtggttggtataacacatggagtaatccgtttcattctttcaggaaatattgagcatgtactgggtacttggcagggccagtggggacagcagggaagagtgcagtttgcgttcttgtggggcacagggaggtttggtggtgggaaccgataaccaaacaaatatttataataggtgatttgcagtta

SEQ ID NO: 114674 - DNA, 1067 bp, Homo sapiens
catgaatgggcctgacccacaagttcccctaaatcattaaactatcttaagttaaacagctttttcagaagtgctttgtgtcctgtggtgcccctgtgacagaggaggagggcaccaaaagctcctttctctgtgtcccagcatgcctttctgcacagctgccacgtgcacctgcttccccatttgtttctggtacagtgtgcaccatggcaatacacaggaataccccacctctggatgtcacagcgtgttaatgagtgtgcattcacatggcaacactgatgtctcttggaacttgttaaagcagggttatgctctttttgttatggtaacagctgttaactgtgcctgttatgttaaccagtgatttttatttgtgttttctctcaaagcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggc

SEQ ID NO: 114675 - DNA, 1222 bp, Homo sapiens
gataatctcagtgcttctgagcagcctcctgagggctacaggctttgcttgagctgggaggattaccaaatcccccagtgaagtaggagcaacagccctgctttcagagctcagccttgtgactcaccagctttgtgaccttgggcagttcagttttctgagccttggtttcctcaaatgtaaaattggaaaaacaacagttgcctcgcgaggctgtggaagcacccagcacagcggctggcgtgtagactgctggaaaggaagtgtccttgttcttgccctcctcccacaccaaaagcttgtagtgaataaccacaggtagcctcagccttaaatgcccatgattattcattctcagggcagagcaggagcatgcttcctggtgcctgtgtccagaagtatgtgtttgccttcctcagccctccctggaaaacagcatgacctgtgcttgttttggcagggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaagtaagatgtccacatgtctaaacccccttcagctgcccagaccccgtgcatgtaatgataaaaggtacttacggattctgtctgccagcattttctacccctcgaagcagtctgcagagttgagacttgtgatggtcaaattgtcaagggccattagaatcctttgctttcagcaaatcacctttgccctggtacaacagggccatttgccagatgtcactgtggatgctgccaccctggtcatactccatggaatcgtgcctcttgtcctgcctgtgtgtgtgtgtgtgtgtgtgtgtttgtgtgtgtgtgtgtgttagtagagtaaaaggaacattgattgtgtgggttttacttggccgataccagttcatttattataataaatagtaagacttttcttaatgagctgtgcctgtaaaccacaggttgcaaaactctgtcaagggctgcaaagtctctgtcacaactacccctctactgttgtagtacaaaagaagccttagtctgctctgcccttggagtagccattctttattcctttacttgaaaaaaaaaaaaggagccttagtaggtgaacaagtaggcatagctgtgttc

SEQ ID NO: 114676 - DNA, 1203 bp, Homo sapiens
ggctggagtgcaatggtgcgatctcagctcacggcaacctctgtctccctggttcaagcgattcttctgcctcagcctcctgagtagctgggattacaggcgtgcaccaccatgcccagctaatttttgtatttttagtagagacggggtttcaccatgttggtcagactggtctcgaactcctgacatcgtgatccacccgcctcggcctcccaaagtgctgggattacaggcatgagccaccgcgcccggcctacaattcattcttaagtttctctaacaccaatgatactagcaccatcctcctcatggacattttttaaaaacaactcgagttgcacctatttttgtgaaagggaaactatggggatgtagaccctgacttttaggatcttaaaactcttaagacaaatgcacggataaagatatgtggttcttttgctctaagtcatgaatgttaaacaagtatgtgagtggacttttcatcaaatgagttttggaaagtgcatggcaggtgggcatgtagaagtagaccaaggagagtttgtctcctaggataggcaggagaagcaggcacctctgtgcccctcaaacagaaaaggacagagccttagagctgaaaatagaaataattttgctacagtcaagaaatattaaactttctccaaagtagagttagtggaggacttaggagtggaggaagggatgtctgaggtgagtttgagaagcagctgagccatgaaatagtgagttcagtgacggaggcgtccacaccccaggaggagttcagtgacggaggcttccacaccctaggagggaagagctttagtcttggcctgcggagcctggcaggtcatcattatgtgggtgattctcctgtctctgtgtggcacacctagacccccacaagctgaaagtagctttgcagtgctgcatttatttattcagtatgcaaatccacatttagtaccagcgtatgccagaacctgtactagacatgctagagcagttcatgtctcagtctgaaaacataaccctttgttattggcccttgcctttagggaataagaacatgactgttaatagtagaccttggtgttgggaatcctacttttaactgtgcaagtgagagcattctgaaactttttaacattttatgccctccttcctctttgcactgctgctggggcctctcctagagga

SEQ ID NO: 114677 - DNA, 1138 bp, Homo sapiens
cagtttctaatgggcaggaatatatcccagtatctaaataatgtaaatggaagttcgtttcttttctagaggattttagcgtggaaaaaaaaaaaataagagagaagactgaagatcaagtcagactctctctcaactacgtagtgtttgtgttaccaagctcatgaactaatgcccctttttcttgtctctttcctattcagacgttgcctgaaaaaagcaatagagattacagaatgtatggaagcacaaaacatgaatgttcttcttttaggtaatatataggaagcacaaaggatgatttccattttccttcacttgagattcaatttttgtatatgtagctttatgtatttggaaacaaaaggagtgagttagtgtagaaatccttcctattcctttctccctaaccttggaatcctttgccttggatttcagtgttagagtttaaaacaaaattctttcactttgcacttggcagacctattcacagtccacaaaggaattgttggtatctttaccaaagctcacatttcttaatgttttggattttgttttatattaactgagcttggttaaatttaaaatctttttagaatccctcttatataaagagatccatggatgacttggttgttatttttatatctttgtggttgacaactttattcagttaccatagaaacttggtggcctgtgagttccttttcctcagtgggcttaactcgctgtacatgatgcaaacattcagaatgtgcgaaagcaagtgtgaaccaccatgcaaggaagattggtgctgtaactagttacatatgagctaaaatattacctgctgtttagaaatactatgtttcgtttagccccacactataaattaagtagattgtctcatgctttatacccccaagcttttatcattctctgaaactctgtaactgttggccctgggttctaagggcagcctggaaaatgtatctttctgtggcttctgtccatctgatattggctgaccgacttagatttgaatacatttattgagcctctgccatgtgcagggctctgttccgccttcaagaagtttgcaacctaatgagagagttgccttaagtgtgctattgaaaaagacctaaccagccgt

SEQ ID NO: 114678 - DNA, 1638 bp, Homo sapiens
acctgacatgtaataagctgcacttgaatgatagctactatcctaataataataatgttgttgttgtcatcatctgggttaccagctgatgataagtcaaaaggtatatgttagaccataagtctgtgtctgactacctagacctgttttattttttaaaactaaatcattctttttcattgtgactaaatactcccaggcttaataaagttaagtatgtccagccatttcatactgaagttacagatttccctgtatgcatttaaatgctaagcttatgtgtcccctgttgggttgtgtttattgtatctggtaaagctttatttgtttctacagatatggtgttggtcctgccacaatggaagtgcccttttgaaaatgtcagcactgcccaaagaacaggatgacggcattttacaaatccaaaagagcttcttagatgggtcagtactagttctacattttgttcttgttcagttcttgttttccaagaagcagggaacagctcttagtagtatgtctatttctgtttacctactggtagcttaatgctaggggaatacaacttaacagtgatcattttgagttaatttgaaaggagtcagtataacataataattaagagtgtcacctgcgtcgtttttagaggtgcacgctaaagtcttcagtggggaggtgacatgatgtctgtaatgttaacagttgtcaaatttaggtcatggtacatgtcacaatactattctactttctacatgtttcaaattaaacaaaacaaagcaaaaaaaacccaaagtagatgaatttaaaacaaaaaagaaggaatagactcagagttacattgccttggtccaaatcatggttctatcagtttataaattggatgatcttgggccaggcagttttactttatgcacctccatttccacacccattgactgggaacaggagtcctgcagcaattgcctggtaggtgaagattaaatgggagaatgcctactgagcccttaacacagattgtggcacgtagtaaatccttaagcaaaatttgagtttgctcttctaatctcatattcctttttgatacctagaatttacaagaccatccacaggccaccctatgaaattgttaaaacggaagacctgtcaagcaacttcctgtccctgcaggaaatccagactgcatactctaaatttaaacagctatttctgataggtgagaagaatactgagcaaaaacttttgtgttatatggggaaagacatgccatgcagatcaggtgaaagttggtgccttttccctgggttccttacgttagtacgcagagcccagggctgtgatgtcatggagccaggggtctggctgccattaccacacttccctctccatctctctccaggctttccctccccgcctccttattgtggcagtgatcacacggccaccctcctcttctccccttcctcagcataccatttgcccagtggtgagcattttggtttcttcctttaaaagtttttgaactatgtagtatttatatttgttgacttgcagtaatttataaagtgaataatgttcgttttcctctgtagactttttcccaaagtggaaatactttaattttttcccctgattgggaat

SEQ ID NO: 114679 - DNA, 1157 bp, Homo sapiens
ggggacctgcgtcagtttgggtaagaacaaggaactgtctacttcactttcccacaaggtcagagctggctattctggtaccacaggtctcttccttctctttttcattctcctcctaacaaacctttctcccatcccacttccctgtaaacgcataggatggtatgtggccctgtggagtgtgtaccacacagagggacctaggagctgttgctggcacaggaagacattgctgttctgggaggttgtgcctgagtagatacacaattttccatgagtaaagtcatctggtatttgcaggaactgtttactttgtgttctaagctcatcttaatgactgaaatgactgctttccaaggagggaggattgattgcttgtgtccaatgggaatgtcacagtggggactccatggaatccacctggaattaagtggtcaggagaggacaccctccacacctctcactgactgcagtgctcttcgtctctgtacagccttctctgctcggtgatggatgggatatttgccaatacatttggttctgacttttttttttttttttttttttgtgaaagaccatctataagaaaactcaccgatgaactaacagtgtaaaatattcaacctcactagttggggaagacatggaaattttttaaaaccatggggccccagtccagctttatagcatgagccactgaggaaggagctcaggatctggtttaaacaactgcacagatgactgtcctgaaaaggttgagaaacagtggcctgtttgtaagctaccatctagagcagtgcgtctccatttaatgtgtgtctaatcgctggaggctcttgtctaatattcagaatctgactcagtaggttgggggaggctagagcgtctgcagtcctcatcagcttccaggtcatgctgctgaaactgtgagtagcaggatcttctggaacaacagtgttcatcccaactgcttacctggagagcttttaagcttctgatttaatagttcttggatggagcctggacattggtaatcttttaatcttcccacttgatttgaatgagcagcctgagtttaagagcagttgatctgcggagaggtttttacttcaatgactacacctgaaaaagggatgccttaccagtcacccattcag

SEQ ID NO: 114680 - DNA, 1142 bp, Homo sapiens
gatctttttgtgttatataaattaactcatggtcagatgactagaaatggagctataaattacttttccaaggaatggaactcagttcctacaatgtaaaaagacagctggcctggcgcgatggctcactcctgtaatcccagcactttgggcacctgaggcaggtggatcacttgaggtcaggagtttgaggccaacctggccaacatggtgaaaccccgtctctactaaaaatacaaaaattagccatatgtggtggtgcgttcctgtagtcccagctactcatgaggctaaggcgggagaatcactttaacctggcaggcggaggttgcagtaagccaagatggcaccactggccactgcactccagcaggggcagtagagcaagactccatctcaaaaaaaaaaaaaaaagagactcagtcataattttggattaatgacaaaaaatggaacaaggttaggattaagcaatcaattcattctgcttggataaaaatgggcttagtggaggaaaccaaaacctaaggagggactttcacataataaaagcaccagtgcttcatggaaagattttattgtcttttacattttgttctcttagtcactgatcccaagaaccataccgtaatgtttgacacacttaaggactggtgttgggaactggaacggaccaaaggcaacatgaagtacaaagcagtgagtgtcaacgaaggctataaagtctgtgagaggtaagctttccatgctgggcacatgctgtacaattcacccattaaaagtgtacagtgttttttagtatattcacagggttgtgcagtcatcaccacagtcaatttagaacattttcatcctcccaaaaagaaactccatacccattggctgtcactccccattttccccgaatacctctctttcttccccagtcctagacaaccactaatctactttctatcactatagacttgcctgttgtgaacatttcatataaatggaatcatatcatatgtgatcttttatgacttggttctttcacttagcatgatgttttcaaagtctgtttattttgcagcttgtatcagaatctcattcttttttattgccaagtaatgttccataatgtggatatagcacatttaatt

SEQ ID NO: 114681 - DNA, 1051 bp, Homo sapiens
ggctgggcaggatggttcatgcctgtaattccagcactttgggaggctgaggcaggtagatcagttgaggtcaggagttcaagaccagcctggccaacatagcgaaaccccgtctctactagaaatacaaagattagtcaggcgtgatgatgcaggcctgtaatcccagctactctggaggctgaggcaggagaatcgcttgaacccaggaggcaaaggttgcagtgagccaagatcatgccactgcactgcagcctgggcagcagagagagctgtctcagaaaaaaaaaaaagttaaaaataataaaaatttttaaaaaagaaagaaaacctcacaaaatggttagcatcctgttgatttgccattattccaaaaagctaatgtcatagatacagatctcaaatgagaattaatatgttgtccattggaacccctttggcatgactaagaacttagacaccttgactcttgtctttgttagtgtttatctgtcaaaaccataactatatccattgttcgattcttttttagattgtcagtggcataattcatcatacccaggctcctaaactgcttaaacgattatttctgttttcctatgcgactgctgcacaaaacaatacaggtaaatatcttctgggttctaatttgagggtaagcagaagccttccaattcccacctgaagccagtgggggagaacacatctatgggttgttttgttttttcctgtctcctctaccaattggtcaccccttgcttgagtgattcatttagatatctacattttctttcctgtgatcttttttttttttttttaaagatggagtctcgctttgtagcccaggctgaagtgcaatggcatgattttggcccactgcaatttccgcctcccgggttcaagcaattctcatgcctcagcctcctgaataactgggattacaggtgcccaccaccatgcctgactaatttttgtatttttggtagagatgaggtttctccatgttggtcaggctggttccaaactcctgacctcaagtgatccatccacc

SEQ ID NO: 114682 - DNA, 1026 bp, Homo sapiens
ctgggacagtagggggtctcagcaggggtcctagctgtaaacccaggagttgactgtcatgaaagcatgtctctagtcatttccctttcatcttttataagctcaactttcagagtgggttttctttgggccactggaatcagttctgccaacagtggccagtctgttcttgtgcttactccagaggagtgaagcacgctgactgctctcagagagccagggcccctgctggaagagattgggcttcctttggcagtcacttaaaagtcaggcagcacctttcctctcattcttgggaagtatccctagaagttgatcatctacttcatttctttagcattcacttattgctgtgtaacataatttcccttcctgatttcattgctgatctgtagtgtttgatgagaaaaagaaaactctctttggacaactgaagaaataccctgagaagctcatcatccactgcaaagaccttcgagtgttccagttttgtctgaggtacacaaaggaagaggaagtcaaaagggtaactagttgcatgtgtttttaggttttatttcccatcaggttttccccactagctctagtttttgcttacgttgcatgaaggttgaggggaggctttcactctgtgaacttgaaattggttgtaatcccatattctttgattagaacgtgaaaagtaatttgataaagcatgcgtgtgtatcatcttggcacatgctacctttaatacttcaattcataatgtttttattcctggagccactaaatggtgggaggtggtaaaccaggtcagtaggcggtaggggaaaatgaagaaaggatgagacagctaaaagtttatccctattctcccacctctgacagtctttccaaaagacagtagtgttggagaattccaacttctatgagtaaatgagtttacctctgggaggtagtagttgtgcatggaaaggaggaagtacacaggtcagatgagcaaagccaaataatcagacatgcttttagagactaaataaacat

SEQ ID NO: 114683 - DNA, 1217 bp, Homo sapiens
taaacaaataaaaagtagccataacattggagtaaatgttgaagtaaggaattaacagtggcggggcagggggctcacacctataatcccagcactttgggaggccaaggcagaaggatcacttgaggctgtcatgcttctgttccctctttttttttttttttttgaaatggaatctcgctctgtcacccaggctgaagtgcagtggcacattcttggctcactgcaacctccgtctcccaggttcaaggaattctcctgcctcagcctcccaagtagctgggattactggtgtgtgccaccacacccggctaatttttgtatttttagtagagacggggtttcaccatgttggccaggctggtctcaaactcctgacctcaagtgatccacctacctcggcctcccaaagtgctgggattacaggcgtgagccactgtgcctggcccatgcttctgttctaattgaatttaagccccactgagatattctagtttagaaaacctggacgtgctgtgatcctggtgccagcagtttttgcctttcctttgtgccataatggcaagctttgttcaaattcaaatggagcagcaagaggtggtatacaaagcacaaagaccatttttaactgatgcatttgttgaaaatttccataattttcagagttagttttttaagaaaagtctgtcagcctaaccagtagaaccagttctgcttgagtattaaagaactataccttttctacctttttgctgcacattgaacatgatagttagtggaataagtgaggaatgttacctcgtgtttcacagctgcagaagtaaggttgtcaacatctactaactaggtagttggtagggagtgtcagagttaaaggcgcagaggcttaagggcaactctagacccttctgtaaaactagtttatggtttaagaagctcccaccaccccaaagaatagggatagtacacaggcagctctcactggatgctgattgaattggctgttagatcctgggatgtgctgggcctatctactgctctctctgaaaaggcttcacaagtaatagtctttccattaagctttagaggaatcctccgtttttcagtatattgcaatatgagtagagcatttggtgatgccatccatattagtggctaagcctagctattgtttcttttctattctttttttttttttttttttttgagacagggtc

SEQ ID NO: 114684 - DNA, 2199 bp, Homo sapiens
ggacatagtaaactcctatgacatatttttatgtgtttaatttaggcatatatcattgtggataatagattcgtagtctgaaatgctctgttgagtttccaagtagccctctgaaatgaatacaggttgagtatttctaatctgaaaatccaaaatcccttgagtgtcatgtttggattaagaatactcagcttgtccattttagggctgagaactgatttgcataacgcgtaaacagcagaatactgaaagaccaggtaccaggttgaatttgtgtatgtggtttgttaccttgagaccagacgttgtcagttagcctcttactgcatgtctgcctccctggcttcagatgctgttctcttggtttgttgtcagagtaattgttgcttgtaactgccgaaagtatatagctagtggaatagagctgtggtcagcagcaaagctgcctcctgtcatgctttcagaagcatggggaatgagcctgctagtcaggcctgctcggagggagccaagccttctggccaggagtggggtaccagcagccttgggaatcagcttcaggaaacaaatcctgttttggtttttagcttcctacagctggatagtagatggattcattcagtctttagtctgtattctcagtgagaaagctccaaattaaaagtctgaccttggctatgcccctactctattagtgagaccagaatgtgtttctggaagccagctaagggaagaatgtgacaatagttcggtgatacttggcactaatacacttaggtaggaatttttaatagagcaattttgttaatttcacaagagctatgcataggattgaagaatattatccggatcaagaattattgtctctatgtatgttttcatgtgtccattctttcagcagacttactgacaatttactgtcttgtcaggaattatatgctagaagttgaggctaaaaatccataaaggtacagcctcagccctcagtttgtatcattggttggcaagacagacaaggtaagagactcttgcagttcagcgtgaaaagtgctatgcttggccaggtgcggtggctcacacctgtaatctcagcactttgggaggccaaggtgggcagattactggaggtaaggagttcaagaccagcctagccaacgtggtgaaaccctgtctctactaaaaaaaaaaattaaccagatgtgatggtgggcaccagtaatcccagctactaaggaggctgaggaatgagactcttttgaacctgggaggcagaagttgcagtgagccaagattgtgccactgaactcctgcatgggggatagagggagactctgtctttaaaaaaaaaaaggaaaaaaggaaaagtgctgttctggaggcatatacagagtgtggtttgggtatctagcaaaggggcacctcagtgttctgatggagagagttttgaccacagaaagcctcacaggacctgaactgtgtggacagtggatttgacagtgagttggatggacaggagtggagacagtgggttgggtggtcccagaggatgcagtaggggccagttggaggcagtgcgactggcagtcgggagcatgcgagctaggaaatgatggtggcccaaagtcagagcgacaacaggaatggatagacgtgggcaatatggagcagagcacaggctgtgagaggcagggagtaggtaagagtgactctcaggtttctggtgtggccagctggatggctggtcctgaaccagagctcagagcattagatttggcaaggggtggcgatgagctgattttgaaatgtcaatttgaaggatatgagggacattctggtgcaggtggccaggaggctgttgaggtgtccaggcctacagctctgaaggcagatctggagtgaagtaccacttggggatcatcagcctatactgttgaaacacctttgagtgagagagctcatccagggaacacagggtttgtgaggaagtaagaggaccctgcccagaagggagacttgaccaagaagagcccgagaaagtgagtgttagcctgtattaggattccctagagggatagaactaataggatatatatctcctatatatatctggagtttattaagtattaacttacatgatcacagggtcccacaacaggctgtctgcaagtctgaggagcaaggagagccagtcagagtctc

SEQ ID NO: 114685 - DNA, 1036 bp, Homo sapiens
gattttgcaaagttctgatccaggctcagccacttggtggtgaccttagacatgtaacttcacctatccgagacttccttttcttacctgtaacgtgaataggtgtcttccctgcaggctgatttagaggatgagaagaaataaaccatataaacccagctaaggacttgacacatggcagatactcaacaactgctaggtgctgttattattaataacttgaactggaagatttgttatttaagcaacatttttatgtatctaccatttgctaagcactattaaaattaggaatgcaaagaaacagtctgtgcactcaggagcttcaccttctcttggggagatggctggtcaccagagttctctgcacagaggtcggagctgcctacttatgagggaggcatgcccaagtgctctgggggcacagagcaagacccactgcagaacccaaggcagcatctggtcttatgcaaaagctgtgtaggacttggaaaggtcgacattaaagcgggatttggtgtggggaggagggggataatgtagcaagcaggcaagaggggtgtgaaaggctcatagctgtgttaggactgggtgacatctttccccatctcttatgtaaggtgtgtgcacacatgtgtgatggtgagagagaagtcttgaggaatagaatccaagggtcgctgctcggacctgcaggagtatctccaagattctatgaggattccttctttctgtgacatgctgctgtaccatagatcagtctggcccttagtgagcctgtgggcacctctcatctgtccctggttcctcttgccttcttcctgctccaagccttttaacttctcccagctcttcccctaacttaatgtttatagagcagttttggaggcggtggtagaaggggaggcacagatggcaatgccatgtgtctctgcagctgctgtcagtcacatccgttagcttaaatcataaagcagtgacagccccataactgccacctgacaccttttttctggcacttgtacatatcccagca

SEQ ID NO: 114686 - DNA, 1594 bp, Homo sapiens
cttttaatctctaatctcctgttggctttgggaggaggaataggggaggtggaaatagagagggattctgggggggagtacagtgctgggagagatggaaaggcctcagggcctcacccttcctttattcccctttgcttacctcccgtatcgcaactctaaggaaagcaagagcttgtcagtagctcttcatactagctgtaatgccagttcctttaagcttcagttatatttctacctcgaaaatgggaataatgatatgtccatgttatataatagacatgtatgaacatttattaatatcaaatgccattatgcatgtaaagcccctagcacaggatacttagatgtagttaacctttaagagatgtgggccattattgttgttattcagaagtttcgtcagagccacttggatggcttcagaaagtgcttaatcattaatcttaagagtgcataaatctttcccagctaaggtattaataaaaggggagtattttgttgtgattgttgccatgttgtcatgccaggaaagttccttgtgtggtaactctttcttagaaaattttttgctatctctaaaagtttcttttccttgttcctttatacatttgcgaatgatttggttatatttaaaattccaatgtaatgagaacacttagttattgacttttttcattattaacatttggcctttgacattttgctagtttcattgtgtggacttatttttcttccctcttccctaattttttttttttttttatacggagtcttgctctgtcgcctgggctggagtgcagagtgcattggcatgatcttggctcactgcaacctccgcctgccgggttcaagcgattcgcctgcctcagcctcccaagtagctgggattacaggctcgtgccaccatgcctggctaatttttgtatttttggtggagacggggtttcaccatgttggtcaggctggtctcgaactcctgaccttgtgatctacccacctcggcttcccaaagtgctgggattacaggcgtgagccaccgtacccagcccctctttcctaatttctaatggtctctcttcaaaggttaaattttgtccatttatcacatctctttagtggttcatttaagatatgagtaaatcaaatcaagtaaaatcataactagcataaataaaatcaaattgtctctgaaactaatactctctttatttcaaaggcagttgtaaaaccatgctgttttgatttcatatttaaatgcttttcctaaaataatagccatcacttttccctctcgtaccctgtccttcatttcctataggcctggctggtgcacaggctttcagaggtggcatgcaaaacctcagttgttttgggaagggagggatttcagccgtaagatagggcttatgtataagtgggggcaagggaagccctggccacagtgatgaaatatgttgaagatgaccttcctcttgtgacagattgccagctcctgtttcagacaatgttttttgttttttgtttttgtttttgtttttttgcttttgctaagagtttttttgtttgttttttattttttgtttatttttat

SEQ ID NO: 114687 - DNA, 1044 bp, Homo sapiens
agcttcttacatattcttgttatcccctgtcagatagatggtttgtaaatattttctctcattcagtgggttatctcttcattttgttgatagtttcctttgctgtgaggaagctttttaacttgatgtgatcccatttgtccatttttgctttggttgcctatgcttgtcgggtattctttatgtctttttttgatagaaccctggttgaagtgcaactgatctttaaacttttctcttcagggaaattaaactacaagtggaaagtcttctgaaatgtggccagagttcaagaatgttcaaattcttcgtccaccaagtgcacatgttgtaattagacatgtttccctctttgcccacagtgcctgatgtatttcctttgagggataattagggaaggggagtggttcagtctaaaataagcctgaagtggtcacatttttcagatccttatagttggcagctttgttttcttgcattaaaataatgctgtgcagacactatgcctcgttgttgtagtctgactctaaacatgttttgtaacagaggataaggctctgtcctaaattgtggatggttttttaaaagataagggtaaggccgggcgtggtggctcacgcctgtaatcccagcactttgggaggccgaggtgggtggatcatgaggccaagagatccagactatcctggccaacatggtgaaaccccgtctctactaaaaatacaaaaattacctgggcgtggtggtgtgtgcctgtagttagtcccagttactcgggaggctcaggcaggagaatcccttgaacccaggaggcagaggttgcagtgagccaagatcacgccactgcatttcagcctggcgacagagtgagactccatctcaaaaaaaaaaagaagataaaggtaggaaggggtgagaaggcaatgtatttttaagtatataggttttgccaggtaatcatattacgggaaatgcaggtgagcaacatcgaggcatggcttatgtgcttctgagagccctgggtctggtaaccttctcttggct

SEQ ID NO: 114688 - DNA, 1080 bp, Homo sapiens
ggaggggtagggccgtgggtcggagcccccaacggggcctgctcggagcccgcgtgggtccgtcctgcctctggactttctcagtgagcccagaagcccgccggcctccgctgcctgcgtctgagtgcctcgggtgcggctggcgggatgccctgcacctacgtccgcctcccgtcagcgctgcggggagaaaagggggtcggcctggcctcagccagtctctgcttgtctctcccttgggaattctccgctgtcgcttctttctcctcatcccctcaccatcatcctttccacccacttcttactcttctgaatcttcaggtcaagaaatttgttcattcattcagaaaatacttctcgagctcctactgtgtgtcaggcactaagtgcttgtgatagacatcagtgaacaggacagagatctctgcattcctggagcttatttgagggggaaaggagaaacggggtgaattatagataattaagtaaattatacggtgtagtaggaggtgataaatatcatgggaaagaaaagaaatctttttcctcctcgcaaaggtggcatttgagccgagacttgaagatacgagaggtctgagagaagagtcgtccaggtagagggaacagcccccgggaaggtcgtgaggtgggagtgtgtctgaagggttggcggagcgtcaaggaagccagcatggcagaggcccatggacaagggggacagtcataggagaggaggttagagagatcagaacttgtaggccttgctcagggcttcttgagcaatagttcttaatccaaatgcctaatgagaagccttcttgttttgcatctgtaaaggtttttttctgcccttctctccagcagaagtgcagaagcaccgccaaatttgttgcagatgtcttcccacctctgtaatgcagaagcacgtgggctgtggatgagagatctgatcagggactgcttccgtaaagaccacctggggcctgaggcatttgcatatgtatctttaaattcaagatatgtgtgttttctccaggggaaagtgctcttaaaatgggtcttatttttagtcctagttgt

SEQ ID NO: 114689 - DNA, 1039 bp, Homo sapiens
gcaggagaatcgcttgaaccagggaggcagaggttgcagtgagccgagatcacgccactgcactccagcctgggtgacagaacaagactccatctcaaaaaaaaaaaaaaaaaaaaaaaaaagaattcagaaagagggcagggcgtggtggctcatgcctgtaatcccagcactttgggaggctgtggcgggtggatagcttgaggccaggagttcgagaccagcctggccaacatggcgaaaccctgtgtctactaaaaatacaaaaattagccaggtatggtggtacacatctgtaatcccagctacctgggaggctgaggtgggaggatcgcttaaacctgggaggcggaggttgcagtgagccgagaacacgccactgcactctaacctgggcaacagagcaaggctctgtctccaaaaaaaaaaaagaattcagaaagagtctaactctagaccacttccaacagtctctaaggaagatattaaaagagctggtagcactgagagtagacatttggatgggatgacttggcgacccacgccaagacaggcagaaacagaaaatggtaaagttcttggtaaaggctcatgttttaatgttaaaatttagattattttaattcctactataaaatggctaatattatcttatacaactttcacctcagttaaaaaaagctacactgagacagcaaaaaaaattaatttatttactgttggggctaggaaataattctcatggctcaaaatccaaaagtttaaaaagggcattttttttccaataatttctccaaacacccagtttccttttgtttgtttgtttgtttgtttgtttgtttgtttgtttgttttgagagagaggcctactccgtcacccaggctggagtgcagtagtgtgatctaagttcattgcaacctccacctcctgggctcaagcaatcctcctgccccagcctcccaagtagctaggactacaggcatgtgccaccacgccaggctaatttttgtattttttgtagagatagggtttcacaat

SEQ ID NO: 114690 - DNA, 1869 bp, Homo sapiens
tatttcagttgtgaaagtaattcctttaaatgtttctttcattacacatgcttttttaggttgcatttggagggaggtaaatgtagtaagtattactacttggggtttttcaattaactcaaaattctgactctctttgttgcagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttattgagtactgcatcttgttattcctgacaaatgtttgttgtctaagcacataattttcagaaaattttgtaattcaatactatattggcttaatttctttctagggtcagaatctacccccaaagtcttagagg

SEQ ID NO: 114691 - DNA, 1614 bp, Homo sapiens
ttgctcacctggtcaaacacccattcctcactgcattttgccaattcaatccattttagatgtaacctcgggtatggtgaaagacccaccggacgtcttggacaggcaaaaatgccttgacgctctggctgctctacgccacgctaagtggttccaggttcggaacatcattttacttttttcttgtagccttatgagagaagtagttcagtacaacatgtttaactgtgcttaaacatttcaaaagactgcccaagcaatactattttaaattaaatatcagaaaatatgttaacatagaaagctgggtatgatgatctgcatattgcagttattattaatttgacaatgaacttaggtttggggagtgttttgtagttggggtttttttattttttatttttagtggctatatttaaagttgacttgtttaggaacatcacatgtttgtgtatatatattatattccataaggctgcagattaactttgctttaaataatggaatatgtgtttaaagctttgtgtatagttttaagatttttttccccctctttctctaagttaataagtgtagggagtgaaaggtgaggaagcagctgtttggtttagtgactttgcagtcatgcaaaggcacagaagggaaaccaaacagatttccttaacctttcagtccctagacaaactttttagctctttactttttcttttatttctaatgtaggcagactttttttttttaagtttactgttttaaatgaacacaggtcaaggttcacaggggatcaagaaatattattcttgtataatctgtttactttgacctaaataccagcttttaaatactaaccctggcataaaatactgctgtaaatggcagctcattgaatccaattttaagtgtgattgtttttgtttttatctgagcttccattgaacggtggtattttaactttttttcatcaagggatatattcagtatttctaagattaattcaattggtttttatgttgctctcaaggctagagctaatggtctgcagtcctgtgtgattatcatacgcattcttcgagacctctgtcagcgagttccaacttggtctgattttccaagctgggtaagtagtacgtaactgtatggtgtaaaaacatgtaggaaataattctgcagcttttatcctctcagtttacatgtaattatcagccttatttgcatttactaaatatagtttttcttttctgatgaaaaatcctgggggagtcttagaatgtttaattttctcagatgtgactaattaaagaattttcattgatgtttctctttgtgtgtttttttctttttgctgttttcacagtgttttttttttaatattacagcatttattagttggcttttacatataatatacaaatgtataaagaagactttgaagaactgttaatctccttatgcagggacattttttaaaataatgtatgtggttgggaactgtaaaaattcagaaatacatattattcaaaaataatacaaaaaaaataggagattcagtaacgcagaaagctacaaaataaccaaaagccttcttatttaaaggcagattatcttaacaatctg

SEQ ID NO: 114692 - DNA, 1048 bp, Homo sapiens
cacagttttccttgattatctgtctttcctctaaatgtgtcttctgaagaatctgtgtccatctgattactcgaggagtaaaaaactaagaaaaagaaaccttagagaatagaattctctatcagtttcaaaatatgttttttatatgtcatctactcaaaataagaacaagttatcctttaagatatctgaatgcttatgagatatgagtaacttgaccagaactgcagctagtactcttaagataattaactttttcatacttttatcatgtattttttcgtccatattcattttatatattcgattattaaactgtattctaaatgccccataatttccaaaggactattatatttaatagattatataatttttctatattgagaaaatattcatactatttaaatcactgagagctgtgaattagattggaataattgccatttgcttactaatagcttgattagcagatttgctgttaatatacacattttacagatgtttagatggatataaagatagccctttgtctacttttatgaatgatatattaatgtaaagttaacttcttgtcctggtttagtttcatatattctcaagttttgtgtagctcatttatgttttaatcagcttaaagaccctacacatctatcgtcacaggatcagcatcttttccactcttaattctgtttaaccatactagttcctattcgctgttctgcttgcctattgtttctcttttatcattttttgaaatactttatgggaactttaaattttaaagggcatttcatactctctgataactaaaattttcatgcggaagggagagcattaaacttttagaaatgcctgttttgggccgggcgcagtggctcacgcctgtaatcctagcactttgggaggccgaggcgggtgtatcacttgaggtcaggagttaaaaaccagcctggccaacatggtgaaacttcgtctctactaaaaatacaaaaaattagcctggtgtggtggtgcacacctgtaatcccagctacttgggaggctg

SEQ ID NO: 114693 - DNA, 3417 bp, Homo sapiens
gcaaatcctggtttttctggatattgactgagactttctgctccctgataaaatgtgtatttcacagaaaatgtacaatatgggaataaattgtagctcctattaaggtcaggtagctattttagcttcattcaaattatgcaaatatatgttataaatatggcagtgtttcttttatccaagaatttattatctaagagagatagacctatgtacaaataactcacaatacaaacaatggtaaatattagttcaacacagaattctgaaagtagggagtaagactaataatactggcatgtacggcagggcttcctagaaggagcagtatataatctggtcctcatatagaatggttagggtagtaagagagtgaaagagccataatgaaagtgcttttgtttgttaatacaacagatccaatttgtttcttatcatcttcattacacaggttataagccctgagaagtatgacataaaatgtgctgtatctgaagcggcaataattttgaattcatgtgtggaacccaaaatgcaagtcactatcacactgacatctccaattattcgagaagagaacatgagggaaggaggttggaaagccattaaactttctactttctattaactttttttttcatttatctactctttaagatggcattaagccctagaaggcaacatgctggcattacacgtgaatttgatagatttgacttatttagcaaccggttttgcctaagataatttcccacagagtaaatgctctttttagtgatgtatttttatataaaacactatggtatgattgattttcttgatttctttcttttcttgctaacctcagatttctggaaaaaaaacttcaaaattatttttactggcatagtcaatgcatgaaaaaatggttttaaaatgttgctagtgactagggggacacaactttaagttggattaagaagtttttgctcttgccttgtcttacaaaaaagacaagagttttcacaaacaaaattggctaagtattcgtaacacatttttaagaggcatttttatacatatatatataataatggatttggcttgtcctgtggtaaatatttctagttctctgaggttgctctttggcttggagcactttcataaatgcagaacatcctaaagcaggaggatttggacatttgaccctaatatcacacttaagatactgaaaaataaactgtgtaaatgtagatagtgagtcacagcacaattcagggtttttaaacttaatttacaactatagaatatgaaatcctgctggtgccagcaatgttgctttagggactattctgtaacattttcaaagcttcaaaagcttttaagctgaaaagcatgatcagtgtctgcagtatgttggttctgttgttttatgggtcagataaaatttactttgtttcctttcatgtttttatacatcttgttgagtatggaataacagtctacactaatatttctttgtgatacaggttgaggaggaagagggtactacatacttaatattaaaattcatttgtataaaatagcatcagtagtctctcaattactgtttctttaaatttgtttgcttataacaaagcaattttttaagacactgggcttttcacaacccaggaaaagaacattttaccaaaaatgtcattgggagctatgtctaattttacatactttgcatgtataccataatcagatgatatttatatcttaagctttgcatcttaaatgagttttgtgtaaagggttttcttatgtgaacgtgagtttctactcaaggtctggccatgggtgttgctggagaaacagttcctgagtcaatctggtcaggtcatatacagcatatgggatttgataaaactaatatgatacattataaatgttgctgtatttagtgtaaaatgataaccatttaactttatttcagaatacattttgttcagttatatttagacttaattaaatttatacagtatcaagccattttattatgttgtaaaagtctaaagtgaatagtgtcatatttgcagtaaattatttgataacctatcccttctaaaggaaacaaaattatatttttgtctgacccagacttgagttagaattattgttctgaatttcataaatattatgatgaggaaaatggtcagtccaaaatggaaagattttgcttcaagacactgagctgaaaagttggatgtgccaaagtgtagaaacactgatagtgttccttgctgcagataactgcagtaaaccatgtctttagcttcattatgaagattgcttctttcttgctgcagaataacggtatgtattctctctcactgcagctcccagtgctctgtgtcttaaaatcatttaaagcctatagcttgctttggggagttagtacaggggttaaggaaggctttgccggaagaacaattgtaaatcatgagagttactacttgcgcattgtgtggtagtctctttaatgcataatggtcctttttaataccaaaaattaattaataaaggaaatgattacattgtccaaataactgttaaacacatgacagatctgttttatgatactgtgtttgacagttaaacattaagtaaacatttaattgactttaagcttgaaatgttcagaatgctctaacccttgctacagaatcttttctgcagcaagttaagtattttgtgtgttttttcccacctgtagcttatcaggcccggtccaaagccttctagcagaggggattgatcctgtcaggggttgctgccaagacatcggaaggatttttgaccaaggttttcaaaagctcagtgtcacatctgccatttgataaaggagggattttggatgcagagcctggcatttattgtcctttgtgtggctgttttgtttgttttgtctttgtctcttctagaattgagcagtgttcacactagtttttaaatggttgagtgggttatatattttacatgaccatgttaatttgaattaatatattcccattaacgtttaatcttaaaatagtgtggacacagcatgtcttctaattggtgattaaccccttaaaatctatgaaatacattcacatagaataagaattagcattttgtttttataaattaactgatttttttttgctttgttaactgggtgttaggcaacaagtatgattttagcagaatataaggggttaatctacttgaaatagaaaatgggtacaaaaatccacactaaatttaacaaaaattttctacttatagctgtaatttgtttttaaattgcaataggtattagctgggcgtggtggtgagtgcctataatcccagctacttgggaggctgaggcaggagaattgcttgaacccagaaggtgtaggttgcagt

SEQ ID NO: 114694 - DNA, 1968 bp, Homo sapiens
ttccttaacctgttctctcatttatctttgctcagagggttggcagttgtaagacttgaattactgaaagcaaagaaagtttcagaatcactggtttctaaggttgagtaaagagcattttcatagctttaggtttatatgtattagaaatgttacttgttttgaggcaaagtgggtgtacatgcatgcatgcatgcatacatacatatagtcttgatggtataactttccatagtttgcattttcgtttttactgaaatggaaaaaagaagataaaggctttcttattgaaaagatacaacaaatatgtatagttgaaaaatataatttgcttttgctcaggaaacttttttttaaattgagcaactttgtttctctgtagcccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacaggtgtgttttgaaagttatttaccatgtgtaattttggtttttcttatgtggacttcttacatttgaaatatagcttatgactggtaactctggtgtgagttctatgtgttttaaccatgcctgtgttcgatatttcatgtattctgcagctgcttgcaaaaatagaaatacacaagttccacggacacatgtagtgtctaacctcgtaattgtactcattttaagtttatataaactattttgagtctatttcaaagcagccattatagttttacagttgtactcagctgctgtttttctgttcttatttgtttgttgcttctgccccacactcagtctttgttttaataactatttccttaaagcactgactgtaaagcatgattaagcctaagctttagtaatgtctttatgtcaagtttgcattattagctgtaactttttattttccttttaccatttggaaatatttttgtattacattaaacataactcctattattctgacttgtgaaataagaaacagaagtgttaatgtccattgctttgcagttgtctttctgtaaagaacttagctctttattattttttttttttatccacattgcttaaatgaagtatagttctaaaaatgctggatgtctttctactgcggttgatggaaattttaatggcacaaaagttatttcacttactattgtatgtttacagaatatcatgcttctggttaagcagagaaatatcataatataattttattttactgcagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgtaagtattatggaaatgttcatttttaccccttgtctggttcagaagtttttggcgggactgactgtgcttcggtttaaacctaagccagcctttaaaattttggcttgactttctgtattgagtttttttgtttgattgtgcaaactgatgaaactattttctacttcatcttttttaggttttatagtgattatatttggcatgaagccatcttgctgatttatttaaaaatgtaaaattgcagcatatgccttccttctcttgttctttttccaagacttgaatcataagaaggcagttgttaggacaaagtgattttttaaaaaaaaaatcccatgtgtagcaaggttaaatttttttaattcatgaatctcttgcctatttagtttaatgcttttaataaaatgtagtaactaaaatagtgtttctgattttaatttccccagttttattgtga

SEQ ID NO: 114695 - DNA, 1053 bp, Homo sapiens
ttctttaccataattcccaacacccttaatgtgtccccaacagtaagactgactatgacttgccatttatcactgccttgcactgtttttcttcatagtagagacataggaaagagcatgtttctttgaggacatgaagaaaattcccaaatgttgatctgtgcacttcaggtcatttactcacagtgttggcctgcctcctttaggtggcattgggtttctaattcatacttaaagcaggagagaggtaagaaactgaggtttctgatgcctgttctttttactttttcctcaggctgaaattttctgcttttcatgctcttttctctttcatttacttcgcaatgaaagcaaacatggaaaatcagatacatttgggaagaaattttagctaggctgatgttggtggggttttttattgctttttatgtcactattgatgcaagttcttgggctgtatttttcctcatatgcttataatgtcattctttatgtttcagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcagtgagtgtccacgttggtgatacaaggggtgaaagtttgactggttcagcattagaagaaaacaattttggaggggctaatgtttagacttaataatcttgtaatcttggtagtttttttgagacagagtcttgctctgtcgcccaggctggagtgcagtggcgtgatctcggctcactgcacgtaacgtgcgcttcccaggttcaagcaattctcctgcctcagctttccaagtaactgggattacaggtgctcaccaacacacttggctaatttttgtattattagtagagatagagtttcgccacgttggccaggctggtcttgaactcctgacttcaggagatccgtccgcctgggcctcccaaaatgctgggattataggcatga

SEQ ID NO: 114696 - DNA, 1050 bp, Homo sapiens
aaatatttactattcattaagtggaagtgggtcatcatataaaggtcttcatcctcatcatcttcaagttgagtaggctgaggaagaagaggaggggttggtcttactctctcaggggtggcagagggagaagaaactcagcagcatagatgtaagtgtattcatatacttcaaacccctgttgttcaagggtcaaatgtaaagtaaaattaaatatccattagtttttctaaggatttcatgactttttgttggtcagcactaagttacatactttttacataatttttattaatgtattttgaatcttttctctgatttaccttaattatattgattttactctctagtgggaaacttgcaactaaaagcctccgtgattaaagaataagtgtaattgtatgattaaaaatacatgtagattgttttggggctgctgttttttaaatgtcttatttatattaatagaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgaggtaatatctttaacttttaatagcctggtaagtggttcagcctttcttaaaaacttagccattctgagcatgtgactcccattcaaagcaatccagatttatttacttccaattttcactcttgaggaagatcctaggtctaggaaagacatgcattaaaattgttactggctatactaatattttactgtggccttggtattagagttatatgtttaagtggcatcttttataaattaaacatatgaagaaatagtttcatattataaataagtgcctcggtttcaaacaagcaaaatagacatacatttcctgatagaagtataagatttgatagattctacatgttaataatgtccataaagaaactttagtggctacagggaaggagaattgagaaaacatatttcaaatatttgtttatatatatataaag

SEQ ID NO: 114697 - DNA, 1209 bp, Homo sapiens
cttttactttttcaaagggggttaggtaaaggtaacttcaaagttcgaaaacttttaagtgcattataagccttgcttatgtgctaataatacataaaggtgacatcaaataatcattgctaaaagagggaaagactggagacctgtctttaaattgaactaaaccatttatttcactaactgggaattgtcatgtgatcatttttaatgtagccaagtctgttcatctttctctacctcagtttcctcacctaatagtagatggaatatgtatgcatatttgcttcacagagattatcttgaaagtaatgagttttgtatatgtgtgtatatacaaaaacatatagcagaaaaaatacaacaaagaaaagcatggtttagattttcattttataatgttccaggcagacttttcaaaatctatttgagtttcctgacaaataagtgtgcttttgttttataggtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggcaagtactgatattctctgtccctgctgactctgtcaaagtgttgtttcttctccattgcagcactaacccttctccctgtgttcttggacctgcctcctcccttctctctgggaccttgtttcttcacatatctgcctagtgtgtgtgtatttttaatttttattccatcgtctactggtttcttcccttcagccatacagatatatctgtgtcttcctctagtcatttaaaaaaaaaagatctgcacacacaaagacccttttcccatttctctaatcttaaggtaacctgattggttttttttgtttttttttttttcatttttgagacagagccccactctgtcaccgaggctggagtgcagtagcacgatcttggctcactgcagcctcaatttccagggctcaagcgatccgcccacctcagtctcctgagtagctgggactatagc

SEQ ID NO: 114698 - DNA, 2162 bp, Homo sapiens
tccaatattaagcctaactgaagtagactgactagtgcgcgcgcgcgcgcgcgcacacacacacacacacacacacacacacactccttttcagaaaagtttgtttagtggtagcactgctatttcagttagttgtaagttttgccaaaataatcattttggaaatacatagaaagcatttggcagaagatagtatatttatttgtatattctattcatattggtaataagagttttatgccttttgctaaggagaaattgctggcataaaatttatagttaatgatgtttgtacctattctttccagctttttaaggatactggtacagtaactatagtggcttactcttctaattttctgatgtctctttcctacttcagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtaagactgataaactgtgtttaaatgagtaaacaaattaggaagagacttagtagaaactatcttgattgtctttgaaattaccttactcccaataataggaattaaattaattgatagacataaatataggtacataatgtgactgttctgtaaattgtatgcttttttgggggcgtggggaggagaagatcttagaagaatataatatgttcttgggggttttaaggctcattatgagtcttgggcttagcattgcaattaaaggaagtaacaccgagttttctacaggattgtttactttcctgcttttccaaatgaaattgaaaactcaaggttaatactcagggaataccacagacaaattatttctgtttattttggctctcgaagagctatttattatcagaaatagttcatcatggaaatgttgggtagccctttctaaacatccataagatggtggttatgtaacacaccttttttggaagaacagagtacctttattttccttaaataattatatatttctcccagagaggtacaatggctaaaacctttttgtgtccactgctgttgccaatttctagctgaggaagtttgcattttcacagtgattaagatcacacattgccttttttgtagagactcagcttttgtattcctcccagaagatatgctgtgaatgacactcttttatttctcagagatttcttatctcttactctagggtgctagggatacaatgatgaattaggaatgcacggagtgtttgagaactgcagttcattgtggctggaatacaggatacatggggtaaatgtcagtagatgaggctagaagtgccagagtatgtaaagccatgtgtgctctgctatggtgtgtgtctttatcttgtgggcagaaagggagctgcagaggctatattaagaaatggagcggtgtgagcagatttgtaagttaaccggacaaccaggtggaaatgaattgaatgaggagacattaacatctgagaactctggctggagtggtgaatgatgaggacctgctcatcattcaccagtatgaatgatggtagaaagacattttataatctattaaaggcatagtacaggagattccttatttaggaaagaaatcttttgttaagatctcaagaaaatactgaatttatgattcctagatctgtcatttaagatagataggactttactgtctctccctatttggttgactagctataattgtaactaggattatattacaatgaaatctgattagtcacattttttttaaatgtccacattagcttcaacaaaataggaagtaccagagtagcttttcctgttcattgtttctctcttatatgtgcttcctttcctttctctttctctggttgtctatacagtatgaagataatttttatttacatgagtaatatattattatttataaattagaaactatttttttagaaagagaaaaaaagttaaaccactagatttctactcctagacactaattgtcattaacattttagtgcacgtctctgtctactttt

SEQ ID NO: 114699 - DNA, 1106 bp, Homo sapiens
tgatgcttgaagtgtttcttggcttccttttttttttttttttttttttttgagacaggttttactctgtcatccaggctggagtgcagtggcacaatcatggttcaccgtagcctcaacctcctctgctcaagcgatcctcccacctcagcctcctgactagctgggactacaggcacacactaccatgtgtggctaatttttaaaaaattttctgtagagatgtggtctttctacgttgcccaggctggtctcaaactcctgacttcaagcagtcctgctgccttggcctcccaaagtgctgggattactggtgtgagccaccatgcccagccttcctcatgcttttggtagaagatatggttccagtccagatgatggttagagacctggctatacagagcagagttagacaatgccagggatgtgtaaatagcaattgctaaatctgctggcatctttttcatatttcatcttttcctgggactggtgactgtataatttattgttcaaactgagacatgtaggagagtgaaaagtactaaaagtaataattacaccggcagtaggcattaaccagaacatatggtcattccttcttgagtctcatggacatttagggtgacgatcagaggcagtataagttaaattggcttcctggttgactcaacattcccatcctattcccacctgctttttgtctaataggacatgttttggggacaaatactagataaggagcagtgggatgaatagaaacagtcttttatataaccaaaattactcttaggtggtttagtctggatgtatttaatcttatcctgttagtaaatgttaaatacaagtttcacagacctgttgtatttgtattttaaatagtatcttttttttcagttccaggaattttggaaaagtatgacctgttactggcattttcttacagatatggagttgttcctagaaaatgttattcccaaacaagtttttcactgttttaatgtaaacttttcctgtcatattggcatatatgtagaaaatgttagttttatatcaaaatatggaaacctcatccagatagaaattctatgagtttctttggactctgt

SEQ ID NO: 114700 - DNA, 1684 bp, Homo sapiens
tcatgcctttcttgagcagtttacatttcctgaattcattcattaccttttttctttttcttttttttttttttttgagacggagtctcgctctttcacccaggtgagactgcagtggcgcgcgatctcggctcactgcaagctccgccttctgggctcacgccattctcctgactcaacctcccgagtagccgggactacaggtgcccgccactgcgcccagctaatgttttgtatttttaatagagacgggctttcaccgtggtctctatctcctgacctcgtgatccacccacctcggcctcccaaagtgctgggattacaggcgtgagccaccacgcccagcctacctttttttcttaatcatgttgtcatttcttaaaatttgtctaggctccctgtctactggctctgtgccgagtcctctgtttttctggatatctttctctgagaggcttctgtccttcccctaattccaatctatactcacttctctctgggcctgctgccaccacagctgctgacctaggctttcatctgtttgcaggatcccatgttttcttggtttactttttgttttagctggaatatatcttcatgtagcttcctaagaaaaggttgtagtaggtaaactccttccatccttgagtggttaaaaaatctttattctgcctccatagtttggctgggtacaaaattctacattagtaatcattttcccttgaattttgaagataataccttatcttcttgctttagtgttaccagtaagaagtctagttttcatttagttgcaggtgcccagtttttccctctctggagacaggatctttttgtcttgaaaagtaaaatgctatgtctctaggtttgtttttttcactctgttttgctctctgtgagctttttgaatttgaaaacgtggttcacgtcaggagtgggaaattttatttcttaatttttttgatcttttttcttttctgtcattccttcaggcaggacattgggccttctagacttatcctttcttttgtatttttcatatatttatcttgtctatttctcaactttatcttctcttctaggtagtataaagttcttgttttatagatacaaattagagtttttgaaaattctcatctgtggccttcatatgttcatttcccacatggtcattcttacttgttttgcagtttatagtaggctttcttcagacatgtggtgatttgtgttgtctgttcattttttaaaaatttttttaaatttaaaaaaaattttttttgagacaggggtctcactctgttgctcaggcttgcagtggtatgatctcagctcactgcaacctctgcctcctgggctcaagtgatcctcctgtctcagccacccaaatacctgagactacagatgcatgccacgacacgcggctaatttttgtgttttttgtagtgatggagtctcactatgttgccaagtctggtctcaaactcaagatccagccttcttggcctcccaaagtgctgggattacaggtattccgtgcccagcttgactgttatttttttaagcagtaagattgcctggaagtcttgaaagtcttattttttgtagtgagtccctggctcactttttgttgttgttgataagtaggtaaggagctggccatttcttgagtaagaatatagagtgt

SEQ ID NO: 114701 - DNA, 1203 bp, Homo sapiens
ggtgcaatttcagctcactgcaccttcaacctcccgggctcaagcagtcctcccacctcagccccctgagtagctaggattacaggcacgccaccatgcctggctaatttttgtattttttagtagagacagagtttcactgtgatgcccaggctggtctcaaactcctggactcaagagatctgcctgcaatagcctcccaaagtgctgggattacaggtgtgaggcaccacaatcagcctgagagttttttgggttttttttcttcatcttaaaatatctttgattctacctccttgagtagtcatcacttaatctctgtaggcagttttttccctctggctgctcataagagtttttctttatctttcatgtttacagtttcacttagatatatcttactgtgaattcttctttactagggtttcttgggactcctgaatctgaacattgttatctttcattaattttagggaatctcttgacattttttttctatattctttcctagtctttctctccatttgtaattccaattagatgtaagttaaccactttttattttatcttccaagtattttaatctctttaatgtttttcatctcttcctctctctctgtgcattctgggtaatttttacagataattttctcattcaccagtttattgccagccatgtttaattagttatgcaataacctttctgagttcctgactataaatttgtcagatgatttagttttaaaagttcatttggttgtttttgacccatcttgttccttagtcttagttttgacaatctcttttacttcaagtgtgcttaaacattttgtatccaataattctaatgcctgtggtctcaaaaaaatttttttcttttaattctgtacacttttgcttatattagtgtatttcccttgggttttatcgtgattttttttttttttttttttttgaaatagggtctcactctgtcacccaggctacatcccaggcaacatcacccaggattgcggtggtgcagttgtagctcacagcagcctcaacctcctgggttcaagcagtcctcctgcctcagccttcaggaccccaccatacctggctaattaaaacaaaaaaaaatttttttttaaaggcagggcctccctttattacccagcctagtgtcaaactcctagcctcaagtgattctccccctttgac

SEQ ID NO: 114702 - DNA, 1054 bp, Homo sapiens
ataagtcctgtttatgtatagccaccaaatctattaagtaagcaggaataaaacaaatgaagtattcaaaacactttgaagagaaaatacaataggataaaaaagtcataaaagatgacaaagatggactgtgttcatgagtgaaaaaccaatgccatcaaattattatctcctatatatatttagcattactccaataaaaatctcataggatttttggtataacttgataaagggattttaatgtatatagtgaggagagtgttcagctaaaaatatcatgaaagtcttgcagaaatgataaggaaggacttgtaatatcagataccaaaatattattaatagaaaaatgtggtattggtacagggatagacagattattgagttaaaatagagatcccagagatagacatgcttatataagcagttggattagagtatatatctaatatatgtctgtttaaatagatgtatttgttaaaaaaaaaatcagctacatttttactcagagacatagatcatcaggttaatcagaagaccattcaggcttataaatgttgtaattgatgaagtatgttagtattatttggatggatctttagtctacttattaaaggttgcttgactattaattgtccatgacaccactctgtcagaatacaggattagagtgattgttctgagtatatcatttcttagtatttcatgaaagccatgtacagtacagcttttattcatacagagataaaatgaatgaaataaactttgggtttttttttgttttatttgaatattagtcttgtatacactttatattaaagtgcatttgtagggaataattcacttatttaatattttatgagcatctacaatatgcatagtccctgctttcagggagtttacacttctggggcatgagggtggagacagatgagtctacaaataactatgccattataattaagttttaatgaaatactaaaatgggaaattggaggattttgactatggagtttgaggtagacttcgtgttctttcattctgaaaatcaagg

SEQ ID NO: 114703 - DNA, 1047 bp, Homo sapiens
tgtcttgaattcaggaaagaataaaagtaacactagtaaggtagaaaaggattaaacactgagaaagtaaaaaaaccaggtgaacaggtttttgaaaccaaccttggtgatggaaatttactggctttacaagaaaaagaaatattgcaacgactaataacatcaatccttccattgttgaatcagagaccttaggatgtacactgcatggataagcttgaaataagataattttcattccaaaaggattgttgctattacactgatgataaaatggctattagtcttaatagagtagggtgagccagaatatccctgtatagaataggtatctgcttgagtatgcttttgtaaactgccttatagtacactatgaacaaaaggacataactttggaactatatagagtttgaatcccagctccatcccttcaggcaccctggccaagtatcagcttctctaagacttggtttcctcacctgacttgccttgaggtgaagtttaaatataaaattttctagcctagtgcctgattatcaataggcattcctatcaatgctgtttcctgtagagatttaagtaataatattataagggttttagaaggattccttggttaatatctatcatatatttatatagagagtttcataatctcacagtaaaatgttttaaaacatttggagtcctcattactaatagagaaagaaggaaagtttctatttacaggtaacatgattgttatgcttgtcaggcaagaatatgagaagtaataagagtacagcaagttttctggatctatgatcaggcaaaggccgggagcggtggctcatgcctgtaatccctgcactttgggaggccgaggtgggcagatcacttgaggttgggaattcgagaccagcctgaccaacatggagaaaccccgtctctactaaaactacaaaattagccaggcgtggtggtgcatgcctgtaatcccagctactcgggaggctgaggcaggagaatagcttgaatccaggaggtggaggttgcggtgagccaaga

SEQ ID NO: 114704 - DNA, 3650 bp, Homo sapiens
cgagcacaggcgcgcctgcgcagtgcggtcggaggcggcggtctgttctccgctgaggaggagcggggcagaggagggaggcagcgggtgagagttcagagttcagcagcagcagcccgagcccatgattcccatatgccctgtagtttctttcacctatggtgagtctaatgtggcccgcgaggcctctgcccggccccctccctggccccgggcagcggggagccgcgggggttggggcaggctccggggaggaggcggcggccgccacccgggcgtgcgagtgagtgagggagtgcgaggcgggagggggaggcggcgcggccgcggcctgggccccgccagggctgctctcacggcgcctctctctttctctccctgccctccctcggcgtctcggctcctctgtgtctcttgtcccgccatgggacccgactcttcgtgcccgccgcagtgcccagccggctgggggaagatgccaaaatggcgaccggcaactactttggattcacccacagcggggcggcggcggcggcggctgcggcccaatataggtaacggcatcctgccttctctctgttcgccccttgctctcccctcggtccggatcctgtcgatgcgacgcccccgcgcccgtccccagccatcccagagccccggcccgctgcaggcctggcccggcccagcccggcggcctctcccgccccgccccgccccgccccgccttgcccggcccggcccggcccgcggcggggagcggcccccagtaggggggaggtagagacggcggaggtgtagggacgtggaggcctcagggcccttcagcggccccttaactaaaatggcctcctgcggccgccgagcggagccgccaccgccgcccggcaggccccccagtccccgcctccgcgcgtccagcccccacctcccatcttcttcccacttgggggatggagagggtggctgaagggacctcacggggagtgccgtgtcgcaggtccactggcttctcgtgcgacgcctctctgcgtcgtcgcctggtgcttcaacccccggagcccagataacgtgtcgttgtctcgggtaccttttcctccgccgtggggcttcttccccagacgctccatcgctagcgagtcctgctgacaaactgcgggtgtcactgtgttcatcgggttcctttagtttttcctgcaaggagagagattcacataccaaccacctgtaaattgtgtagttcttagactggaaaagatgtgcgaagtttctagtgctgataaatgagtgcccagccttgtttgagctatggagtttaggccccaggtgggcctgtcattctccttgcgggggtctttcccctgcggggaatggtggggagggaagaagatgcaagtgagattgtactgagtcattgtaatgcaccggatgaaatccctgctttaagggaagctctcatttctgaagtctgtagttcattatacatcttaccaaagacaaacacaacagtggattgttaaattgttacttttgagtcaatctgagacttttgattcaggccataagcgcacacggctcctgcgtgatatgctttttatgtatgttagatgttggttaaacccaggcagtttttttcatttgatttacttcaggaggcacggtgtttaatggaaagggcatcattgggagccagaagacccgagttcagtctcttttgctcttgattttttttttttgaataaataatttttcttagagagaaaggacctatgttgcccaggctgatctcgaactcctgggcagagtcctgcctcggcctcccagagtgctaggattaccggcatgagccaccacacctggcctcttttgctcttgattttatgacgttgggaacatcatatagttgggttttcatgttcatcatctgtaaaatgagatgctgggcaaactatctttttgggctgaaacttgtggttttgagaaaccaagttactgttttccatggcatcctaagatgccatttgttgtaaaaggtaccattattgtatgtagcactaaaaaaaaatgctgccagttaagacactgcttaagactccattaagagatgtcaaaatgtataaatgtgcatcatattggtgaaactagattttactaattgttgaatgccatgtggcattttacaagtgttttttcatgaggcctgcattccagaaaaagcactgagatgacaaattattacagcaaaatcttgggggcatttcaagtattagcaaatcgtttgcttataatttttgataattagacaaaaaaagtttcagctactttgataaaactttttaggacttttaaaaaattcaacagctttttggggtacaagtggtttttggttacgtggactaattatatagtgaattctgagattttagtagggctaataattttcaaggagaggaaaaaaccatctttttctcagaagagatagctaatcagcatctgtgccataaatctgctggcaattactagtattccgtctagaaaagattgtgtttaaccattaaaattttacttgttttactcaggttttttctgttttcctcatatgggctgagtgataagatttgttgaattactaactttatttactgtaaagtggtgggttctttgtggcacttctgaaatgtttttcctaaatgcagacctacagatagaaatgaagaaaggaaatgctgatttaaagataattaataattttttgataaaatatttatgtgattgttttatcccagtatagggaactgtgacagaatttctgtttctaataattttttttttggccttgaaactgaaaagtttaaactgtaacaacaatccaggttactaaattgattaagtgtacatctgatgagaaaagactagtcttttgacattacttatattgctaaaacttaggcactcttgtacataaggccttgtatataaacatagtacatgaaaagtgtttgcatttaatggcaagaaatcaggcccaataatactgggaattttggcaaggaagatgaatgaataacattaataacaaaagcacatgcaaaaagtgtggtggtgatgctaatttttcttcctggctggaaataattataatggaacttttagagatggaagaccaaggtctactttactaatattttttcaaatttgaagatctcaaactcaggaaaatcttaagtacagttcacgcctgaaaacatatgcagtttttttttttttccaatcaaatttggatagaaaatagagtattcatggagggccaactttttgtattcgcaggttccacagggcctactgtgggactttatgtatggatttttgtatacgtagcggtcctggaaccaatcccctgcttatatggagggatgactgtatttatgtgtgaatgatgtgattgaattgcttcacctatcattgaatacagataaagtaaacatcctacacctaaatgtaattccagaggccaggcgtggtggctcacgcctgtaatcccagcacattgggaggctaaggcgggtgtatcacctgaggtcaggggtatgagatcagcctgaccaacatggcgaaacccggtctctactactaaaaatacaaaagttagctgg

SEQ ID NO: 114705 - DNA, 3987 bp, Homo sapiens
cactttctggaattaaacgctgtgactttagcttccttcctttggattttaggaggcagaggcatgtattgaggtgggtgaagtggggtaggaagaccatttctgggaaaatgggccagagtattgatctttttcattatgaccccttcgcttcattagagtaaacatttattgaacaaacgcaaagcttggcgcttgtcactcatgttttattggcgttttccttttttttaatttttttttaagctatctcctacaggaaggatattagctctttcattctctcaagggtcagatgtaatcttccaacatctgactttcgcgtcacccatttaggaagagacgcggtccctttaaggccctggaaagggtctaagtgttggtttctgtggggaggccacgccccatcacgtgaccgcagccccagcgcggcggggccggcgtctcctggctgccgtcacttccggttctctgtcagtcgcgagcgaacgaccaagagggtgttcgactgctagagccgagcgaagcgtgagtgcgcgggaccccctacccctactcctcggggcccccaccctcccagccgggccgtgagctgccttcggccctccactcctctcgccggcaatggccgcgggaaatggcggctctgccttacctcccccttcccctcggcgtccccggcccccttctccgtttctgactccacgcctgacgcgctgtgggcccttccgcggtagactcctgtccccggggagccgagtcgaggcggcgggcgctgcggcccggggcggtagattgagggcggccggggagtgaggagtcgcggggagagagtcgcggcgtccccgggacaatgcggcggcggcctgcctaggtggggcgcgtgcggttacctactcttcccccgcccctcgccctgagcggggcgctctggagactgggagagcggatgcgggcgggagggggccgggggaagaacggctgatgtgcagggggagggaacgcttcgagagaagaaaatggcgcttggtgcaaatcccgccccttcccacgccgtcttctccgcacttcgccgcctcccacgccccctccgaccaacctgtctcccctcgcccgagcggctgctagccacggggttctagcggcttgctggggccgcgcgaccccttccctggtcttgtgcttgtcaccttcctgttataccgaagtcgtgtgcccttcagtcctggttcattttcacctcgtttttttctgatctttccctcaatcagcaaaggctgaagatttcgtttctctttttaaagttgcgttttgtataaattctacaatagtggtttcagtatcagttacttgaattacaagctgcttctccccccacccccacattggaacaggctcattaaggtaaatatatatttgttaaaagtttagaggctggttttagttaccgttacctttcttctccagtggacttctttgggttgagtaccaggtggttctttgaaaaattcttaggcccccaggcagtttttgataacagacggtagttatgatcgacagtttcaaagtgaaaaattatgttcaatttaattacctttttaaaaaatatctttttgtcgtattaattagcataaaaaacttaactaaattgattttagagatgaggttgcaaaatggagcagaaacaggaaaaacggataaaacgtggtcatgaacattgcttttcccttctgaatttacccttgaagacattaccagttaaaatcagattgagctttttgaatttaatggctaggattggggtggcccacttctttttccttgacctcctattttggaacatatgcaatgtcagtgctaatgcaagtttcatctagagagctagattatttatgatttttttttaaggaggaattttaagtctttttttcttgtattaaacaaatacagtgtgtgatgtgtttattaggccctttaacgcatacagaaattagctaatttatgcctagtgttccattattggaacgctaagcatgtgggagttatttatgtgctactgctcaagatcatcgccaaggtctgcttgcataaattcaaaaaattgcaacctctggcataaatgggttaataggacctaatctcttctgagatggggagagcaaaagatattttgataatcagcgttttatgacctggtgttataagtgccttgaatagaggtatccacgtatcttggaattccttgaaatttggggcttaggcttactgatagtttgctttctgcaaacttgcactcaggcactcagtaaacacccacttgtaagcaaggcactaagttatctatgtctctggggggacctgggaagttaccagcatggtaggaatttgcgggaaggttttgcacctcccataaataggttttgcacctcccataaataggttcttcaaattttaattatgttccagagtagaaaaatctgtgtaaaatgtaatgaattgctgtgaattgtgtaagatttttttttttttttgagatggagtcttgctttgttgcccaggccggagtgcaatgatgtgaccttgtgtcactgcaacctctgcctccggtgttgaagcgattctcctgcctcagtctcccgaattgctgggactacaggtgtgccaccgtgccctgttaatttttgtatttttagtggagatagggtttcaccatgttggccaggctggtctcgaactcctgacctcaggtgatccgcctgctttggcctcctaaagttttgggattacaggcgtgaaccatcgttcccggcctgaattgcgtataattttgtgtactcttgaattagtacctgtcgttattttggtgatacggccaaaaagtcaaaatatgaataaaatattatgtaaaaattaattagatgtcacatttgcatagtacagctagttccctgttgtgtaaatgttggggtcagttccccatagtgaataattttacgttagttccaatctcgttgatgagaagtctaaagcagtaatagtagaattacatttcttctggttttaatagtaattgttgtctgctgccttcttgcagtttaccctacccatagtgtgtaatgccattaaaacgaagtatagaaagatccattggcctggagaaaggttagaggtgtaggagtgtatgacatttagttcattgttcttactgggttcagcacattgcaccctgcgtgttatttgcaacttaaaagggtatagattaaaacttgtgctcagtgtaacaactcagtaccacaaaaatggtagaatgaaccgtggaacttgtccttgatttttttctttgattgggggagagctaagttgaaagtagtagagtaccttattaattatttttgtaatgtatttttctttcaggatgcctaaatcaaaggaacttgtttcttcaagctcttctggcagtgattctgacagtgaggttgacaaaaaggtgactactgctgcaccaagtcattttggtgatactcaacaatattgtccatatcccattctgaaggatagtaaaaggtgtattaacatcttaaaatgaggatctagctgggcgcggtggctcatgcctgttatcctacttctttgggaggccgaggtggcaggattgcttgaggccaagagttcaagaccaaccaggctaacatagcaagaacctgtctctttaaaaaaataaataaataaaaaataaaaaataagaatgtgaatgggtatttctggaggtacggttggtctctggaccacttgactagaagtgcctaggatgctttttgcacattcatactcataggccctaaatcagacttaacaagtcttctgttgagcatcattaggaaccctaaagttgcagaaacactgccttgcatcctagggtcatagaattctaagtaggccaaagtcactatttgccgttatttagaaatttaccagatttttttttgt

SEQ ID NO: 114706 - DNA, 1047 bp, Homo sapiens
ctcactctgcggtcaagtcttccgtgcagaattgtcttttatcgcatagaactttacatatctgaagagatatttatatcctagaaatagaataagttggtcgtgtttttcctaattagtatatatcctttgtaaaatagtaagtaatgactagcactggtagacctgtgatttccgaaagtttattcaaaagaagcaggctccctatcttttttttttcctcctgaagcttagcaattttagctaaaagaaaaggggagagcgtatgggagattggagaagttgcaaccttaaagtataaatatagaatataacaacacatggaagggtaaaataaggcttcaaagactatacttgagtaaatttcttaattttaaaatttgcaccctatatagtatttgagtatgttgatgtaacacatgtgtattgagcttttatttgccagacatgcactattccacagggaatacttagagcctgatttatagaataattgctttctgcatattgagctaactttttgtttgtcccaaatagtaatattactcttgtaaacacttaaccttgtataccacatttttcatttcatgttttacatgtatataatatttttcctagcttcatctaatttggtaacattcaattaatttagtaacattaaaatatttatactattccatcaagaaggaacatgactgccctcttctgtttgggttgggtattgtagtggtttttatgggttagctctttttgagaatgcgactttctaataagcttttaaaataatgctgtttttaaaacaacgttgtgatttttgaaagctagtctaacacatagctgtctacaatgattttttttttttttgtaatgaggaagttcttgagttgctggctgtcagtgcccagtgcaaaatagctctctaaagatttgcctaattgtaaattcctttttttttaattttttattttgagatgaagttttgcttttgttgcccaggctggagtgtaatggcgcgatctcggctcactgcaaccttcgcgtcccggg

SEQ ID NO: 114707 - DNA, 2140 bp, Homo sapiens
ccggcccataaattccttaagccagcataaattccttttggaataggcaggacataaataaacatatcctggaaatggaataagttggttatattctttttaattagtatatctgcttcgtaaaataagtaactgactagccttagtagactgtggtttccaggtttattcagaagtagcaagatccctccatttttttttctaccaaagaaatcgtatgtgggatcccaaaccacaaaataaccgttcctgtggttaatactactataatgcctgaagtgtcttttgggatcctgagaacagagtttgaaaacattactagacagaaggattggttagattcatagttttgttgttgagtgaaacttgcttatgtatatatttatgatattttggatgtagtcttttgattgtttaaatcttaaaaagtaatgggatcttttgacactggggtatgttttatttttatgtgtgcaaattttaaccatattcttttctagttaaagaggaaaaagcaagttgctccagaaaaacctgtaaagaaacaaaagacaggtgagacttcgagagccctgtcatcttctaaacagagcagcagcagcagagatgataacatgtttcaggtaaagttggctattttttttttttttttttttgacatggagtcatgctctgtcacccaggctggagtgcagtggcgccatctcggctcactgcaacctcagcctcctgagttcaagcagttctctgcctcagcctcccgagtagctaggattacaggcatccgccaccagacctggctaatttttgtatttttagtagagatggggtttcaccatcttggccaggctggtcttgaactcctgaccttgtgatccaactgcctcagcctccaaaagtgctgggtttacaggtgtgagccaccatgccttgccaaagttggctgtttctttagattcagaggaattattatctggcttgatctgaagaatgttaaaagtactatgatctgataattgcctaatatgtatgttacaatcttcttaactagggacatttattaaaatagaacaaactagtaaaagtattttgtacgatgctggattattgttaaagtctctaaagtctagttttgctgtatttaaaccaatgcaaatttaattgagaactgcacattttgaaagcaacttggaggaggcaggtcaagtgttgggacagtaaagtatgaatagattattatgggacaggaagcagcaatgtgacatgcctaattttggcctgatgagcaacagaaaaggggaatgggttgaatagataaagtgaaggaagttcattagagggacttgatgaaatcacctagagaggactcgtatagctttttctcttgggtttcctgtcttgttttagggagacttgacactggcatctttgtacaagaaggatttgtgaggaagggatgttggggaataaatgaatgcaggtgagattgcttaggtaattgtaggctttaatctgtatgtgaggtgataagggcttagatggtttttcctaaagaagaaattatgccaattacaagatacaggttaggaagaatggaccagaggaattaggcagtcagtgaagatgtggacttgattgtggatgtgattgaaaaaaaaaatggtgttgcttctgtagcacctgaagggcttagttgggaaatgttcatgtgggattatcagcatggttgactaaagctgcctactgaagtattaaacagaggaagaacaggaagcagatgaggggatgtcttgggttatattcagatagagaatggaaggaaaaagaggatgtaggttaagagagagggtgaaggaaaattagaagagtgcagtaatgggagcaagaaaaggatgagtgtttccaggagctataagtattagttgaaaccaaaaagttgggtggaacgagactacaattttttttttgagacagggtctctgctctgtcacccaggctggagtgcagtggtgtgatctctgctcactgcaacttccgcttcctgggctcaaatgatcctcctgcctcagcctcctgagtaactgggactacaggcaatgctccatgacgcctggcaaattttctttgttgttggtagaaa

SEQ ID NO: 114708 - DNA, 1050 bp, Homo sapiens
atttgagtacactgagataacaggaagtggctatgaagttaacactagtacactactgtagttaattttatgcagttatgaattaatactccatctttgtttacatttctctctaacttcatataatagatttgtatgttttatgatagtaagtgataaaataacctcatatctaggtatgttttatgcattcatgacatacctaactttttcttaatgttttcgttatttctaggctatgcagttgttctgtgagttttttcaaattgtcaagtctgcaaaaatttttccagtatatttattgaaaaaaatatgcatataagtgggacctgcacagttcagagccatgttgttcaagggtcagcagtagtcattttcatgattagatgtagagtgagcatgcagcaagttgtgaatatgaatacaattgaaacagataccactcttgaaaggagcacctctttttatgtttgtttcttttgcagattgggaaaatgaggtacgttagtgttcgcgattttaaaggcaaagtgctaattgatattagagaatattggatggatcctgaaggtgaaatgaaaccaggaagaaaaggtgaggtctaattacttgaattttattacagtgttaggactaaacgacaacttttctgagtagcttacttgaaatgttggcaggacacacggggcaaggaagagtcttactcaattgattctctatcttctgtagttattttggacatgatacttaacatttttttaatgagatgtcttaatacagcttttgggaataaaacccagaaaagtaacacccctaatatcacttcagttggctgctaatttacttgaacaatttttaaaaaggtttatgcaattctgaagcagattaggcactatctgggaacttgtaaaatcaggaatggaaaatcttggtttacaatgcttccttttgattcagctcctaaaagctattctttagggcattactcttcaagcggatctctgctttccttccatttgtgcttcatccagtcccaagcctcttagcatt

SEQ ID NO: 114709 - DNA, 2977 bp, Homo sapiens
tgagattgataatgctcagtaaattgtgatgatatgtaattaacaaatgtaagagatatgattttcagtattgtagcattgtgtccaagtggcaattttttttttttttttagatggagtcttgctctcttgcccaggctggagtgcagtggcatgatcttggctcactgtaacttccacctcccaggttcgagcaattctcctgtctcagcctcttgagtagctgggattacaggtgcccaccaccatgcccggctaatttttgtatttttagtagagatggggtttcaccatgttgggccaggctggtcttgaactcctgacctcaagtgatccacccgccttggcctcccaaagtgctgggattacaggtgtgagccaccgcgcccagcctaaagtggcaattttgataaaacagtattctagttggaagtatgaaaatcctcaacgcttaaatagattttcacctttgaatttttaaactttgttttaggtatttctttaaatccagaacaatggagccagctgaaggaacagatttctgacattgatgatgcagtaagaaaactgtaaaattcgagccatataaataaaacctgtactgttctagttgttttaatctgtctttttacattggcttttgttttctaaatgttctccaagctattgtatgtttggattgcagaagaatttgtaagatgaatacttttttttaatgtgcattattaaaaatattgagtgaagctaattgtcaactttattaaggattactttgtctgcccaccacctagtgtaaaataaaatcaagtaatacaatcttaactgttgtggccttttttgatcataagagttggtactgtttaaggccaaaagtaacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaatggtttttcactctttttatttacttcattttcctttaataacttaatctcttcatgttcagtttttacttcactctttattcttttctttgattatggtatgcttatttggaaagtcagtgaaactgtcaaaatgttatctcaataagatacttatatgagaactacaatcaccgaatctactgtattcaatattagcagatctaatttgataaacaacatggcttgtgtgaaaactgagcaggtgtttgtttacccatagtgttctgtgtagttattgcttagtctgcagaaaataatgacttagatgagatgtctgacttgctttcacttattaaacatgttcaccatgggatgatgtctgtaacatcagatattgttcaactagactaggatttaataaaaattgtgaaagcttactggcctaacattttattttataatattgggtatgaattatatgtagccagagatgtcattaagctttactgttatagtaggtaatatggttagtttgtagggaaaagagcatatgagcacatgcttgtgtattttggcctttgccccagtagaacagaccaatggcattctagacttgatgatactaagttttagcagacactagtaagtggtttgtatttaaccatactgatgaagcagacagattgaggcacagattttagtggctttgtggcaataaatagggcatggtgtgccttaggaaaagaatgtttataaagggaattataactgaaattaaaggaggcggcagtgaagaggaaataattctcttctatctaaatgatatacatatgatattttgagatttttataacagcagtggaacacaattctaggtagagtagaaaaaggaaagttttaaagacatataaaagattcttgttgacaaattatttttggtagcaaatctcaaatggttacctgctattaaggtctgccatattagagttttgcactattttgctaccaagtttgattcatacatctaaaacattttgtagttacttgtcaaggacttaatttgaaaatcatttgccaggccacatagttatcaatttttttttctatcagctattctgttgtatttctaaaacattttttagatgactttttaaagtatatttagcagtaaccttatgaggttcaaattggtaaatctcttgtaatttagccttcatcgaataataggtaccagtgtattaaaaatgtgtattttttgcagccccttgaaccagagtaggttcagagaaactcccaaagtttgtactttagacacatcatgcttgattggtaacttccctccttttttggggaacatgtttgtgtcctattaacttaattggatagatttttaaatatttcttatttttggcacacggaaagggtagttcgagtacagaactttgatttttggtgtagatgcagagggaatgatgggtaaatttcctaggtttatgtgaatttagggggtgtatgcattttgaaacaatctactaacagatggtgctgaaatctattacctacatgttttctagttgttcagcattatgttaatgaagcctccatataaggagtgtttctctggcacagttggtaagttgactgctaacttcatttaaatgtgttactggatatgcagtatactgaaattattaatcagtttgtgtataggaaaagagaactgggttaaaagcaaattaacttgttctgaaaagaaagtatagattaattttgttttctgtttaaattttatctccttggtaaagatttttttttcctgggcagaaaacttggcatttttaggcgtagataccttaccttacaatgccaaaatgaatttaattccagtactcaggtttttccctttaacagactctatgtgtatcagggctttctaatgggtttttcctcttcgtttttaaaatgtga

SEQ ID NO: 114710 - DNA, 1079 bp, Homo sapiens
cttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaacctcttcctgtttataattcaaccagcatgcactgcacatatccatattctttgagggcttttgttctcctgggacttgtttaagtcaaagagcaataggtgggtccgatgaattgtaatatttgaatgatacccatgaaaaaacccaagaatttctgcctagcaaaggcaaatcgacagaattttaaaatgaggggcaaaccttgaatcagctggtaagggaaagaatcttcatgaagaataaccgtcatcttgagtcactacagctcgagagcacttcatggttgacttcatcgactcatgttattaagtcctttgccactttaaagaggtcctaag

SEQ ID NO: 114711 - DNA, 1096 bp, Homo sapiens
tataaaacctctaaaagaaaatatggcagaaaaatttaaaaatcatgaattaggcaaagatttattaagtaaaacacaagaagcataaactagaaaagaaaaaaattaatgttaccttttatcaaatttaataattttggttcttcaaaacattgttacaaaattaaaagccaatctaaatattggagaaaatatttgcaaaatatttacagatgctccttcacttacagttgagttacatcttgataaacccgtcataagtcaagaatattataagtcaaaagtgcatttaataccttggcaaacccactgtaacatgaaaaaatcataagtcaagccattataaggctagatgctccttgacttatgataggtttatatcttgataaaccaatcatcaactcaaaaaaatcttttttttgggggggggggaacaaaacaataaacacctttattacatgggtgaagacaaaacaaggatttatttgcctttccgggccttgattttcctaagatagaactccaaccctttgccctctagcacatagccatctgctcggccacactgtcccggccttgaagcgatgcatgcaagaagcttgccctgctggaactgctcttccaggagactgctgattttggcattctttttcctttcatcatatttcttctgaatttgtttaaatcgttttttgtttaaaatctcttcttcctcaggagtcagcttggctcccttcttgcggcccaggggcagcacgtagtgggacatcttaccactgtcggcacggtgtgctgtcgatgagcacgatgcaattcttcaccagggtcttggtacgaaccagctcattattagatgcattgtagacaacatcgatgatccttgttttacgagtacaacactctgagccccaggagaaattcccccacgtccaacctcagggcacggtatttcttgttacttccctgcacacggactgtgtggatgcggcgggggccaatcttggtgttggcagctgggcgctccaactcatacttccgcttcttgtggtagggctttctcttgcccccggttttgcggcgctggtgccagttgtcc

SEQ ID NO: 114712 - DNA, 1034 bp, Homo sapiens
atgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccagg

SEQ ID NO: 114713 - DNA, 1321 bp, Homo sapiens
aacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaatttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgata

SEQ ID NO: 114714 - DNA, 1037 bp, Homo sapiens
ttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgt

SEQ ID NO: 114715 - DNA, 1032 bp, Homo sapiens
aaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaa

SEQ ID NO: 114716 - DNA, 1031 bp, Homo sapiens
ctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggc

SEQ ID NO: 114717 - DNA, 1008 bp, Homo sapiens
acccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttc

SEQ ID NO: 114718 - DNA, 1777 bp, Homo sapiens
ctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttca

SEQ ID NO: 114719 - DNA, 1009 bp, Homo sapiens
ggtgtattagtttcctagggctgctttcacaaatcaccacaaagtgacataaaacaacacacatttattctcttccaatcctgggggtcagaagtcaaaaatcaaatgttgccatggctaccttccttttggagagtccaggggagaatctgttttcttgcctttttcattttctagaggtcaccttggctcctggctccttcatcacatcactccagcctcttgcccctgtcacttcatctcctacttgtgcagatcctcttgccttcctcttataagggcccttctgattacataggtcaactctgatggtgcaggacagtttccccatctcaagatttttaatgtaatcacatctgcaaactcccttctgctaagtaaagtaagatattggcaggttccagggattaggacgttgacagctttgggggactatattcagcctaccacaccaggcttgctttacaaattctgaatgctcaaacttcaacagtcccctttctgaccaccacttcctctgcatttgccttctttgtcatttcccttgacttgcttttcacaatatcagctaagccttcaacctggctgcataaaagatcagctccttctcccattcctcagagcagtttcccaaatgcccatctacttgccttaagcagatgatcttacctcctacttaaagagaaaaagaggttcctggtgtgtattgcttcagctcccgtcctctcttttctccctgtgctatcctggaaggagaacacagcactgctagtcactctgaagtaccagagaacaatgaatagtttactgaagatgtcataggtaaaaatggtaaagtagattatgttgtacatttcctatcatgctccagggaagaatccccattttcttcctgcaaatctttcactttggccaccagctgctgtatctccctccatggatttttcccttctggccttgtcatctccaggtcacccctttctctgtacgtgggttatttccaggcctc

SEQ ID NO: 114720 - DNA, 1053 bp, Homo sapiens
tatatatattgctatgcaatacatatatatatattgctatgcaatacatatatatatattgctatgcaatacatatatatattgctatgcaatacatatatatattgctatgcaatacatatatatatattgctatgcaatacatatatatattgctatgcaatacatatatatattgctatgcaatacatatatatatattgctatgcaatacatatatatatattgctatgcaatacatatatatatattgctatgcaatacatatatatatattgctatgcaatacatatatatagatgtctcttctcaacagcttagatgaaaacaccacgatatatatatatcatgtgtgtgtataatatatacacattaaagctacttaggtgattctggtgcagccaggtttgtaagctaataatctacgttctagattcatattttctcttctgcttctccaaggcctgccctcccacttctctttttcagtgctaatacttgcaatcaccctaggtgatagacactcaaaatacttctgctaagaatagaagcctgcttgcattttccctaggcaagttgtcattggggcaactgattcagaatacatctcaacaattccaacaacctcaagtaacctgtataaaagataggactctctgaagtccagttttgcaactaataccaatgagggaaacacaaatttgacttctcaggattggagagaaacatttctcatgatgtagacatgtgtatcataggaaacatcctacagacagttttcttaaaatcttgtatagatcttgttcttgtcttcaacatttcacattcacattcacagaagcttctgaaatccctccatctttcacctcactatgtcgcttgtttgtctatcctctgccctcatgttgacttcctgttgggtgacaactggcacttcaggttctggattctggctgagctgagacactccaaggtggctggtggtggtctgggcaactccaggtactcaggcatttccttgcttcacttttttttttttttaaacagagtctt

SEQ ID NO: 114721 - DNA, 1043 bp, Homo sapiens
ctggggtgctggagacattaggctcataaaaggcataaaggtcagaacatcatcttcttcaaatagtccagtgccttcagcctttgagtttgagccttgtgataattgtactttattgtgtaattacttcaggactcagtgggaaggtggcgtgatgagatgactttaggactcagtgggaaggtggcattcccaaaccagtttgcctggactcagaaaatgcacatacctgccatccatattgttagtttattttataactttctagtgattatgaaatacattaaatactcaaatacagttttcttgggattggaatcaagccagaataagccaaattttactcttatgtgatttacctttaaaatgtggtatggtttatacatctgtgtgtgtttataggtatggagatcagaagatggatttttaaaagctcttttaatttttaactttttatcttggcagtttttaacattataaaaagtagagagaatagtatagtgaccttccatgtaccctcacctagctaaatcactagcattttgccaatcttatttgaaatggaaagcaaaggtcatttcttctaagtcttatagtatttttggaactgaatagtgcagccaattgttattttaacacaaactgctctaactcactttctggaaataccagagaagttgtgtaattaggtagaatcttcgtatactctaagataagaatttttacgcaaattttttttaacttgaatgggaggaattattcatgctttgacacttgagttatctggatttgtcttgtattctgttttctcaaaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtaagtgaacttcacgcgtctcccccagttccccttttgct

SEQ ID NO: 114722 - DNA, 1046 bp, Homo sapiens
agagggagaagttgaggctggctcccaggtttctggcttagatgacctgctagtgtcttgagggaagactgctgaacacagtggtcagagcatagagtggcagctgactacctccgtcccagctctgccatttactagctctgtgatcttgggcaagttacttaacctctctgtgctgtagtttcctttgtaaaatggagataataatgacatccacctcatagcattgttagttgctatgagaattcaatgagttcatccattgttcagtgtgggaacagtgcctggcgtacagtgggccctctgtaaaagtttgtcattgtggttatttttactagaagaaaaggaactcagttttggtcttttcagttttaaagtgcctttcagatatccaggtgggatacttgaggttagggactagaaacagatttcggagttatttgggagccatatgagactatgtgatccactaggaaaggggatagaacaccggcatttaaggaatgcgtgggcagaaaagagaagcaagggctgaggacagctaaggagagaagcagaatggagtgttgtcatggaaaccaaagaaaggagtggtcagagggtcaaatgttggtggatacctcaagagtttagagactgagagtgtcaactggattgggtcctggctgatcttcacaaaatccattttctaccagaaaccccctcatctccaaagcttcagcctgcgcttccttctcctgttcatggtgaatcatgaccagccctgtactgagtgtgtgcctgtgggacactgtcatcagggcacatctcacactttccagtgtgccctctctgaagtgtgtaccagcagcaggggagtgtggtttatcttttgtgggccagctcttggcgtactcatggcatagtcgctgcatgagatagcagcaccggatttataccagtacccgccaaactcaagaccggtaccttccacagggcttctgtgatccacacagttccctgagggagacgtgctactatcattggcattgaagacttgaaggctt

SEQ ID NO: 114723 - DNA, 1047 bp, Homo sapiens
ctgtgaaaatgtgcttgactatactgtgacatgccagaacatggaaccagaaaagaggagagggatggaactgtgggagtcagggagaccgctgtgaaaatattccttccacatgaatagcattccttctaaatgattagagtttagagtggaaggtcccagaagccaccagaagcaggaagagaggccatgcgacttccacttgtggattcctggaaggctgagaacacaaaagccaagaagacatactgacttcaggataatagaccacaaaagtggggagggaagattctggtgttaaggatatccaggtcacttttggccaaccagagggaagtttgtcctttcagattatgtaacagggaagggaattttggaagcccttggagagaaccagaaaacaaagtaaggtggcaccgagtgagcctgggaaacttgccaccaaaagactcagggatcaaggtcaaagagagggttgtagaggtctgagtgggtctcgtgtttgctttgtgggtttctgggaagcattttgaaatatttttacttaaactgtgtgtcttaagaggacgctctccatttacatccaacataacatgctcatatgaacaaatgtaaattatgagaacatcctgtgtgctccttctcatctggattctcccttcctgaccacactgccttctgctccaagtctggccaagctgatttgcatgtttgtttgagagggatggaaaatcattagagtttagagtggtattttggataaatttttgaatggtgtgagtgagaccagttctgcagatggtcagtgagaacaaagaaggcacacccaggcaggggttctcctagcatggcctcaagagtgggcttctacacccccaagcagttgtcagctactgggcagcattcatggtgaaaatcacttttattttctctttttaaaaatattgtatttatttattagtattgttattatttaccttgtgggactttgtttgtttgtttctatagagatagggtctcactttgttgcccaggcttatctcgaac

SEQ ID NO: 114724 - DNA, 1068 bp, Homo sapiens
atgccatgtatatattaactatgatgactgtctacttaattgtctaatctgggacaattttgagagtgaaagaggatgggtaacttctaagccagccagaacactaggactaaaggcagaaactggaactgtcctaagcaaactgggatgtcaggtcgtcctaatgttaggtcatttaatcatgacatcagccctgtaggtataattatccctttggggcacaagagggaactggagcacagagagattaagtaacttgcccaaagccactcagctagtgagtagcaatgctgggatttaaacgagggtaagctgactccagaggcatcattcttaactgctgtgcaacactctctgctaagagctaacataggattgaaattttagtaggtgggagatttttcttaatcctcacagcaacttggatgtagtattaccctgttttcacaggtgcagaaactgagtttcaagtagatccagcaacttgcccaagtcgtaaaaccagaaagagtggagccgagaatcaaagcttggatgcctgaccagagtggacctttgaaacactcctctgtatattgtcttcaggctgcctgtatttacaaactctgatattgacctcattacttctccccgttctgcaggcagaagactgctatgagagcacttaggacccaagcgacatcagccttggaacaggcaaataaaaatggaaagctaatcttggtggccttctcttcttcaaaaggacatttttaagatccaaatagccatcagtatggccaagttggttgttcggctatgcatatcagaaattccataaaatattctccaattacggtgctggaggagggtattatgaggagttcatgaacatcaagaaggcagttaatgggttatcagaagactaagagaagtggtttccacaaagcacagagtcagaagcaataatgtggtgtttggagccacaagtacaccaggtgcagcttttcttgcttcctctacagtggatcacaatcttggcagcccatttagaatcacctgcttttaaaagtcaccaactgccttggc

SEQ ID NO: 114725 - DNA, 1062 bp, Homo sapiens
gccggcccaagggcgggggcgagacccctctgggcctgcccctgccccctaccttgttttccccgccgcagctcggggagaacggatgctggagttggggcagactcggggccgccgggacttcgggagtaaggaggacgtggagccaccagaaaggcgcccgccatctcccgcgacccctgcctggtggggggtggggggtggggtgtcgtcctcaaccaccttcgctgccttcttgggcaggttggtgtcggtttagtttctgcggtttgcagggttgacatcctaactcctttgagtttcgcatcccccttttgtggagggggctcagagcctggagaagcaacagacggggaattaaggcagatgcagcccagcacagcgtggaggggtccgaagtggcctcacgggggcctgagcatggctgtctttccaggctcctctttatttgccaggagcccagctaagcccaactttactcccagaaatgttgaggggaatctgcggactcgaggcccctcgcctcgggaccagcggcttctcttcgccgcagctcacgcatgatcggggtgggattccgtcttccttccgggagaggagaatgcccagctgcctgggatggggaaacgttgccggatctctggggaatgtggtctcaaggctgcaggggcctggcagagaggaactgtccatcactaggacatagccgaagctcgccttagcgaagagagtctcacctcctcgggctttgcacagagttggagaagaggtcgggaatcacagggaggctggattttggctgctctgtccccagcctgcaggtccctgttcgccctgtggctcggaattttattactgatgtatataatctgataatcttttcttaatgatgcctaacaagtgtgatttttttcccccttgggtttgtaagacagttgattttatgtgaggagattgatccagttcttatattttagccagtgcttgtctaacagagattgggagagctatcccgtgctgggctgttgcacagttttcatctccattcactgagatgcttca

SEQ ID NO: 114726 - DNA, 1049 bp, Homo sapiens
cctgtaatcccagcactttgggaggccgaggcaggcggatcatgaggtcaggagatcgagaccatcctggccaacacagtgaaaccccgtctctactaaaaatacaaaaaataaaaattagctgggcgtggtggcacgcacttgtaatcccagctacttgagaggctgaggcaggagaatcgcttgaacccgggaggtggaggttgcagtgagctgggattgcgccactgcactccaacctggcgacagagcaagactctgtctcaaataaataaataaataaataagtatgaaatatttctaacatacataaaaacagagtatagtaagccattttgtcttctacttcctaggtttaatagttgctaatattttcatatttgatccatacctctccccccccggaaaaataaactataacttaaatatttgatctattcctactcctttgcctccatcctcaggtaacctctaatgtgaagttagcgcacacagttctcaagcatgtttggaactacactgtatccacaaaaaaatacatgtgagtttgtgtttaacattttacataaatggcataattctacctatgtatagcttgcatttttaacttactatgtttttgagatacatgtgttaatagatctttattcactttagctgttacagagaatcccagtgtatgaaaaaagtatagtatatttactcccttgccaagagtaagttagggtttctggtttttcactgttttttgtttgagctgcggtctcgctctgtcacccaggctggagtgcagtatcgtgatcactgctcactacagcctcaatctcctgggctcaagcagtcctcctgcctcatcctccaaagtggctgggaccacaggcacatgccaccatgcctggctaatttttttcatttttgtagagacagggtcttactatgttgctcaggctggccttgaactctcagcctcaagtgagccttctacctcagccttccacagtgcatgagccactgtgcctggcctagtttttcactgttacactttttct

SEQ ID NO: 114727 - DNA, 1025 bp, Homo sapiens
ctgtcttgatggggacctgaagaagacagggccacacttttagttgaggaactgaccctcagctggaagcctgctcttctggaggaaaacatgcttctgtgggaagtattgtgcatgggggaagggactgccacgtcagctgtactcagaactgctaatatcagcattcaccttgggtgacgtcctcaagccatttcagtcaaaaaccaagcaaaaagggctgtggatctgcctgtaacaggctgcctgcctgacctgacagaagctcttcagatgggtcattgtaattgacttgagcaccttctctgccataggcactttgctgctggactgtcctcgaataaggtcagggctggccgtagtcattgtcaggtttcccattaccagtatgtgttgatgggataattgggtattagaagatctctggatgaatgacaagccctgccctcggggacttaagagttttagccaggttagatatggtcgcaatctgccacagtacaaggcgactgttagtggtgggaatggggtggcggtggtgggagggaattcttttcacagatgaggctgaggcctagagaaatggccccttggaaagggacagttaatgagaggcagagatggatgagaccctggtactggctgctcagcactgcacttctacacattatacttttctgtttctctcacaggtcaacagtgaccttgagactcctgtatgtagctaattataattgttatttggaattgatatcatttttctattttgagaaaatgttcacgtttctctttttttctgagacaggatctcgctctgtcccttaggctggagtgcagtggtgcaatcttagctcaccgcagccttgacctcctgggctcaagcagtcctcccaccttagcctccctggagctggcactacaggtgtgtaccaccactcctggtgaatttttgtatttttgtagagacagggtttcatcatgttacccgggctggtctcaaactcctgagctcaagcaatccgcct

SEQ ID NO: 114728 - DNA, 2475 bp, Homo sapiens
tacaccattgcactccagcctaggcaacagagcgagactctgtctcaaaaaaaaaaaaaaaaggtgggccccacgaagggttcagtgtcctttatttaacatgttaggaggccatagcaccaggcaaggtgctgagtatttcatctttctgtctccaagcacaggcccacttcagacccagtttctatttatcatgggtgcaagttgattcaaatgctctcacaaccttcttgggtctttgtttaaagaaataaaaaaatttcttagattttctttggagttgatatcatttttctcttttgagaaaaacatttcacattttttatgagcttttttaaattgggaaaaaaaaactatttaaaatatcggcatggaaactgtcatcaatatccatatacttaccatccaagattttcttggagtgtgttttttgaggaaaaactcatgtctgccgctaacttcatgatgtatacagccactcagcaatcttgataaattcctaggtaattaggttcttttttttttcttgagatagagtctcgctctgtccccaggccagagtgcaatggcatcatctcggctcactgcaacctctgcctctcaggtttaagcgattctcctgcttcagcctcctgagtagctgggactacaggcgtgtgccaccacgtccagctaatttttgtattttcagtagagacggggtttcactatgttggccaggatggtcttgatctcctgaactcgtgatcctcccgccttggcctcccaaagtgctgggattacaggcgtgagccaccacacccagccagtaattaggttctttctgtgctatacaacttttcacagtgttgggtgtgctatttgtttccttttgcaactgcttttcttctacagtctctaaaagcctaatgagacaggcacacgatgcactgatttcctccaggtgatacctatctcaagcctgtctcccggccaatctgttgatggctttgttactgtttgtgccttgtttggcaacaggctttctttctgtctcttgtttaaaccaacccctgattatttttaagtgcatagtccctacaacaaagggtatttgattctatgcctctttgaccaaataaattgaaagtaggtgtttatatccactgtggcaaaagaaacaaggagcagctcaccctgtcctggtgataagtgctacaggctcgggtggcaggccgctggctgtgggcgcttttgtgtgtggcttcccgaacagtagcactgtgcacctctgccccattcttgtctcactgggtgatgtttttcaggattccatttgtataatatcagtgtttagattgtcctgaagaattgcagtattttcttttttatagggtagagagagttgtgcaggatggaataatttcttaaggaacagaaatgtcctaatgttagagaagtacataagtatctaaacgttctgcttttccaaattgttgccaagacatggaaacctccatctcagtctgctgtcagcccaggcgaacgtaaaaatagccacttcacttgtctataattctctttatattttctctgttattgactttgtatctttagcaaagctatatggaagaggatttgttgactccgtgaatttaataaagttattccttaagcatatgctctacatgtgagaacaaagaaataaagatgctactccattccagtgaggcaggggtgcgtgaggacacacagccagaaggaatggaatgccttttgcaaattggtccattcgtatttcctagagggacctctatgtgccagcagtaattctgaggactcgttccgtctttgaaggcaactgaattttttctattaagtactaaaaagattggtcagttggccagacttttaaaaattactggtgttgtctcacgtgcagcccagtgtcacgtgttgggcttggaacttgaaccttagtttaatctagcctcctctatttataagctatgcccctttggctaaataaactttctctgctgcaatttcctagtctggaagctgagaataataacagtagaatttaattctgaagtgcttgtgggcattaaatgagatgacattcatttataataaaataatttaaaaaataaaattttgcaaagtaatctttaaggatagctattgtggctgttattatcattgctaatgtcatcatgctctttatcaccctgcctttaaggaactgctgatatattggccaacatgattattcctgccattataatctatagcaataaagagaggttgccccatatgttattgttaacacatctgccttgcatcttctgttcaatttgcaactgtttctctgtattagcattctccctatttacctttctattattatgtcattgtgtaatgtgaacgatgtaaagatgtagttcttttattagtccccagtcttatcttattccagattgcattaacaaggtc

SEQ ID NO: 114729 - DNA, 1595 bp, Homo sapiens
gatctcagctcactgcaacctccacctcctgggttcaagtgattctcctgcctcagcttcccaagtagctgggactacaggcatgtaccaccacacccagctaatttttgtatttttagtagagatggggtttcaccatgttggccaggatggtctccatctcttgaccttgtgatccacccacccctgcctcccaaagtgctgggattataggcgtgagcctcccgtgcccaggccactggatctttttaagaacaacttcactgagttagaacttactttctgtaaaattcactaattttagtatacaattcaacaacttttagtaaattaacagaattttactgtcatcaccaccatctagttttagaacatttccctcaccccagaaagatcctttatggcatttgcaattacttcctgttagcgttcccagccctggacaaccaccaatctactttttgtctttataaatttaccttttctggatgtgtcttagaaatagaatcctggccaggcgtggtggctcatgcctgtaatcccagcactttgggaggcacaggccggaggaacgtttgaggccagcagtgcaagaccagcctgggcaacacagagactctgtttctacaagaaatacaaaaattagttgggtgtggtgatgcacacctgtagtcccagctactcaggaggctgaggtgggaggatcacttgagcccaggagtttgaggctgcagagagctatgatggtgccactacactccagcctgggcaacagagaaagactctgtctcttaaaaaaaagaaaaaaaaaaaggaatggaatcatataatgtgtggtcttttctgtctgactttcacttaacaaaatgtgtttgagcttcatccatgcttcaccatggatcagcttgctattcctttttattgctgggtagtattccattatatggaattgccacagattatttacctagttgacaaacatttctgttttactttttccacaattacaaatgctacttctataaatattcggtctttgtgtggacatatgttttcatttctctcgtaggtgggaatagcattgctgagtcatgtggtaaatgtacatttaactttgtaagaaattgtcacactgcatttcacaatgactataccattttacattttcaccaataatgtttgaggattggatctctatgtttaaacttgatgggcccttttgggtttcaagataggtgaaacttaaggaatggactttggaggaagatgtgaaggggcttacccatacacggtcacttggggtcagttgctgggcactctgtgaggtggtttttctcttcagaggtgaacacggtggtgtgtttagacggtggtattgtaatgaacatcaaaagataagtaacacagaacaggacaagcattttagagatcatcttaaaaataacctcgatttaagggataattgcatggagtttcttagtcctagagtgatttttatattccagaggtagcttgttttgattaagccatgctttttaaattgaatggagttagggcaggaggtaaccttgggacttttctttggtaggcttatt

SEQ ID NO: 114730 - DNA, 1040 bp, Homo sapiens
ttttgacgtgaaaaaaacaacccaactttggtttatgaaccagcccaactctgacaagtgtgttcctgttccgcctacatcagttctaggttctctaacttcagtgtgcagaagattcaaccaaggaagttcctgggctctaccccttgagattcagttttaataggacaggggctaaaagattgcatttagtccccaggtccttctgatgtggattaactaggggctgactttgagaaacactgccctggaatgtgcacttgctattcaggtaccagcccagccttttctgtgactaaatgcttggcagttaacaatgtataattatggtgtgtgtcgtttccaaggcaacatgcatctgtcactcccgctgaggctgggaagattgaaaggggccatggagaggctgcagtcacaatgaggcctccagattcatgtcatcaaagtgcttcatgatgactggattttcacaccatttatccaagggccctagtcaatggcagcagcaagaatgaaagtagacacattggaagctagagagtcactgggtgacttttggaggtagcaacaagctcatgaagaaggcattcagtggcttgcactccccacccatcctctcaagtcagttttgtttagaataattaggatgtgggggaatgtgagaggacctggcaaggcttctgaaaacagtggttaactgtggtaaacgtgtgcctgctattcctcagttctcctctgggatggtgctgttaaaggtcacctgttctcacttgcagtgggcttgacgtgacatttatttagcacttactatgtgatggaaactttcacatagattatcttgcctttttgacctaagtgtattttcatttttttttagctacatgcgaagttttcacatcttgtacatttccaaatttaatgaaaaaggtagagtctgtacatgtttgctgggcacagtggctcatgcctgtaatcccagcttttagggagggagaggccagaggatagcttgagcccaggaattcgtgacctgcctgggc

SEQ ID NO: 114731 - DNA, 1061 bp, Homo sapiens
ttggtcaaaggatgcagcgtttcagttaagaggaatagatgaagagatctattgtacaacatggtaattatagttagtgtattgtatacttgaaaaattcctgagagtagatttagagtgttctcatcacagtgaaataataagtatgtgaggcaatgcatatgttaattagctcaatttagccattctacaatatatgcatatttcaaaagtcatgttttacaccataaaagtatatacaatttttatttgtcaattaaaataaatattaataagaaggaaaaaattaaggttttggttaatttgaaaatgtcagaagcttctaggaagtatatcgtaagtggaaatatgttatttaccactcctcagctgttaactgaccaccttcccaacgcaaccctgctctgtctccttcccatgacccaagttgtaatccaatcaggagagaataccttatttggaaacctacatatgtcctttttttctctgcttaggtgttgaaaagtctcctctagagctttggaaggctgaatgcactaaacatgaagagcttgaaagcgaagttcaggaagagtgacgtgagtatgcggtgactcacagtctggctgttccttcttctccatggagctgcagaaacgctcctccccaccttgataaggcgctgttgggttaataaactacagacactcaagtgctcttggccccagctcagggtagcttctgtagatggcatgctctaggttccttgctgtttgtgtgcatagctttcaaaaacaatgtttttttatttttatttttaattttggggatctgtgccttgtagagaaaggaaccgtcacattaaacatcttcaaaggaagaatcagtaaaaacctcaacatttctaaagttgccagaaatcctgattcagaatgtcgtttttagaagaagctagtctctctcatgcgggtggtttaggaatgacatattagcatggttcatctttggctttaggaaacgtgttcaactctctgttaagggttttgtggtaaaatggtatctactgctgcccgtacctttcc

SEQ ID NO: 114732 - DNA, 1038 bp, Homo sapiens
gagtagctttaaaagcgacttaaactcggacctaggtttgtggctctggacaagtctcttactcttctgaacctcagattcctcactagaaaagtggaggaaatgatattagccccgtaagactggggtgacagttaaatgcattaaatgaatgttggccgggtgtggtgactcacacctgtaatcccagctacttgggaggctgaggcagaaggatcacctgaggttgagagtttgagaccaccctggccaacatggagaaaccccgtctgtactaaaaatacaaaattagccgggtgtggtggtgcatgcctgtaatcccagctacttgggaggctgaggcaggagaatagcttgaacccagaaggcggaggttgtggtgagcaagagatcacgccattgcactccagcctgggcaacaagagtgaaactccatctcaaaacaaaacaaaacaaaaaaacaaacaaaaaaagaatgtcaaaaatcttatggcctggtgctcaggagatgcttagtaaatatttgtttcttcctcctaattagcaacccgtaataaaaagtaggattcaaaaagtttacacggtctggagggtagaatactctggtaacagttgctgctgccgaacagggaaactgagagctggggaagagaggcttgtttttcaatgtatgcctttgattttgaagtttttgatacacgtacatgtgtatcatgcatatatatgtattgttaaggaaaagcaagcttacaaacatttacattcagttgaatgaagcaaattataatttttttttaacctgaaatgtgtggtctgtctcaaaatattttaaaccattgggcatcatattcctgcttgtctttgtgtgagggaaaaggaagaagaaaggattctttgtatttctggggggtaggaagaagataatagcagatcaggttctcgcgcttgcataaagaagacaggtgacccactggtgtgatcgcatttcagccagcctgtgtctgggaggtctgtggccaaattggtttgtggccactg

SEQ ID NO: 114733 - DNA, 2966 bp, Homo sapiens
ccttcaggtcactctgtgacccgagaaccatcacttgggtaaagattgaatgggagtgtcgtttccggaagacttgacaactggcactgtgtcaaaggcagatgtgagtttggtagggaatgagcctgactctgcgggctgtggttagacagtgacattgtccggtggttttgattcttaaatctatttgggaccctgcagataacccacagagaataaacagcattatggaatttctatggtggataaccttttttacttcgcatttataactttattttgggagttcttaaacttgagttgttagatagtagataggatacaggagaaatgcaaatatggttgttgtctttaaaaggttgataaacctcggtgggaggagaaaaaaacatataggaaataactagagcaaaatacaagcagtatagaatatagatactcaaggtatctttaagatgatatagctaactagttgttaagttataaggcctggtgataaatgctgcagattttgagatggctgaatcactgggaatgggagaatttggggagctttatggaggtggagcttcatgcaggccttgagggataggtaggagttggaaggatggttgggaagagggggaaaggtcagaaggtcaatcaggggagacagcttgcagcacagcgggttaactcagtctcaaaaatggcccttgacatagaaaatagtaatattaatagttcaggagcccaggagagtacctgtggcatggccctgagtatttaaagaagaatactatataaagttttcatcctagttttaaaaatggatagattgacttttatgcttattaagcgagcgcagagttctcagtcatcattatttgtatcttttatgaccatagcttgaaaaagtggcttctttacctctttaaatatttgcagcagctagtatgtggttccacatggaaaaatgagctgtcgtcatgaaaaatgaggccaaaaaggctgggatttccctttgctaataaaatgctcaggcttctggaatttctttgtagatgccaatttttagtgacttgagtgaaatgggtggaggttgagggatgggaaatggggttgaaagatctttgtaacacatcttgagaaatgccactcaaacgtgatcgagggcttcacggtttactttgagggtgtgtgcttaattttacgaaagatttattcccaattatatatttcattgtaatagggaagtagcggacattccattaaaaaaatcaaaacagccagtttaaagtgacagtctccatgagagattaaattgatggtatacctttacatagcatctactaactactgtagctttcagccaaggaaatgcacacaccccatgaatcttaaagaaccaggcatatcctgctcagacagaggtttgagtttcttgcctattaagataacagttggcggtggggtgtggtggctcacacctgtaatcctagcactttgggaggccaaggtgggtggatcacctgatgtcaggagttcgagaccagcctggccaacatggcaaaaccccatctctactaaaaatacaaaaattagccaggcatggtggtgcatgctcgtaatcccagctactcgggaggctgaggcaggagaatcgcttgaacccagggggtggaggttgcagtgagctgagatcacaccacttcacttcagcctgggcgacagagcgaaactccgtctgttaaaaaaaaaataataataaaagataacagctctcatgaggatcaacaaccaactctaccaacgtatttttttcaaggagtttttagtcatttataataagtttttacaattgctcactcctcctttcgtcaccacacatacatgcacatacacacaatgggagtatttaaaatccaagtctctggcgtgaacctgggaagcggagcttgcagtgagccgagatcacgccactgcactccagcctgggcgatagagcgagactccatctcaaaaaatataaaataaaataaaatccaagtctctctgtagacataggaactatggccaaatctattttaagctaagccttttttttttttaatagacataattttaaaaaaatcagcaatgaccccactgggtggaggtaggagactttactaaagttctagagagaaatttggtcaaatttgtgccgtgctacgtgttttctaggtcttttcagcctgatttaaatggagaatctgctcactgcctgattttgcctggtattagtttgctaggactgccataacaaagggtaccacaaaccaggtggctgaaactaaagaaatgtattgtctcagagtttgggaggctagaagcccaagatccaggtactggcacggttggttccttgtgagggctgcgagggcgaatctgttccatgctctgacctagattctggtggttggctggcagtgtttttggcttgcagaagccttgccccgatctctgctttcatcttcaggtggcattctccctctgtgcatgtgtctgtgcccagattcctcctttacataaagacgccactcatactggattagggctcgctataatgacctcattttagcttgattacctctgtgaaaaccctatctccaaataaggtcaccttctgaggttagggggagaattaggactccaacgtatgaatttttgggaggacacaagtcaacccttaacacaactccatgcccttccatcctagaacagttacactgaagccctggcatccccccactgagctggcactgtcatagaccttagctccactgttcatccttgggactgttttcagcatctaagagagtgaggctggagcatcacagtttttcagtgggtgccactgcataatattaatagcaagagtgaacacgtatggatggctgaccttctattacaggaataaggagttctcatgtactgaatgctca

SEQ ID NO: 114734 - DNA, 1048 bp, Homo sapiens
gctgaggcaggagaattgcttgaacccgggaggcagaggttgtggtgacccaagatcgtgccattgcactccagcctgggcaacaagagtaaaactctgtctcaaaaaaaaaaaagaaaaaaaaaaaaagaaatggaaactgctcttgaatgttaacagctggtgacattaggtaaccagtcaggcttttccttttatgtcctgtaatatattggtgacctgatctgataaggtgtgggatgaacaagggtttgtttttaagtacaccattttaccgtcataatcttgaggttgcttacacagatagggactatcatgacctgatctcacagcttcattgaaaagtttgggaatggtgtcagcctgtaagtttatgttataagcttagctttaagttactctttaaagcagtgtattcagtcaatatgtaatttataaaattgtgcaatatgaggattcttcattatattgattagtttaatctgaacctacatgacatctgactctcaaattttaggcctagaattctgagcaaaactttagaacaaatctaaaagaatattaaaaatggtagaatgtccacttcctagacatgtaactttattaatataacctgtgatcttattcacatttttggttgccatattgtccttttggttcatattgggtttattgctgattcttttctcccagtgttgcttgtaaagcctcccttccccacccctcccctttctccctccctttcctcctcccctcctccccttccctccctttctcccccctcccctccccctcccctcccccctcccctctctgcctcccttcctccctcccctcctcccttcccctcctcccttcccctccctctctcccttcccctccatctcctcccctccctttagttttctcacctgtaaactgaggctgaggccagcacttccctttaaagcatcatcatgaggattaggataaaatctggcacaaagaaacttctcaataaatggcagctgctgatattggttacccctggtgcctagcacagtgcctg

SEQ ID NO: 114735 - DNA, 1786 bp, Homo sapiens
agaaatctggcgtggccttagcatttcattaggcaacttggtgggaagacacactagaaaacatgaaaggtgagatctctttgattaaacaagaatgtttgggtacaactatttaccactaaaatacacttagctactaggcatcattctaagcaacttaacaaactgtgatttatttatacctctcattagagaagtgctgtatgtattcccagtttacagatgagaaaactgcaacatggtatcttgctatgttggtttccaaaagtggctgtaacaaagtaccctaaagggagtggcttaaaccagaggtcagcagcctcagctccttctggggctgtgaggaagaatcagccgtgtctctccccagcttctggtggtttgctggcaatctttggtgtttcttggcttataggagcatcatcctgatctctgcctcatctttgtatagcgttttccctgtttgcatgtttgttaccaaatttcccctttaataaggacctcagttgtatgggagtaggggcccaccttattcttaactaattacagctgcagtccccctatttctaaacaaggttacattctgagacattgggggttagggcttcaacatatggattttgggggaaacacgattcagccataactcttgtccaaatcacaaagctaaagtagggtgcagaacttgcacctgggaactctgggtgcggagccagtgtcctgccactgctggtgcacacgggtgtttgctgtcaggagaacaaaatatgatgattccagccggccaagtaaaggcctggacttgaatttcaaattcctcattccaatttccagtggaaactgacagatagtaatcatgggtaatctttgaccaaaacatgcttcagtgacagggacgcctaggagccaggtactggattagctttctgaaagcttctggtgctagagataaggagggtggggagaggggcggagaatatggaaatcaaagcggtcagacttgttttgagctgggtggggcctggagaagaggcccaaagcgcaaattgggaactgagacttcaggtaggtatgttttaaaataacaaaaagtacattttttgttttaaaataacaaagggtatgatttagcctaggttggctgtgcttgtgaaggtttggtgcacagttttcccctgggtggtggtttctgatgctgggttcaggtctttgggagttgtaggtgcctggtgaataactggagggcggactgttttgtaagctctggtcagtgttcagtgagttaagtccagcagtcattggagtctattgctgtagactcttgcctttttaggtgcatttggaaaatccacctaagccctttccccatggtgaacaagtggctttaggtggcaagtggcagtcttggacacagtaggacatgtgggatacttgtccttgctctccctgcagttccagcccagttcctacactagtcattgtgttgaatgaatgagtgactaaatgtaaaatggaaatactgacagtttatcgtcaacaccctgtggcccctctctgttcagcatttaccactttatccatgtaatggacagaaataaaaggtcagtagggttttctggatgtgtttcctttaggatgctctgcatgccctcttggccatgtctgtgctgtgtgaaattaacaagtatcattggaggccttggcttgttacctacaatctacctgtgtgcttattttgtacccagactgtgaaattattttgtatctatagctcattagctcaagt

SEQ ID NO: 114736 - DNA, 1738 bp, Homo sapiens
taattttgtatttttagtagagatggggtttctccatgttggtcaggctggtctcgaactcctgacctcagatgatctgcccaccttggcctcccaaagtgctgggattacaggcatgcgccaccacgcccagcccactttctgtttttctttaggtttatgcaaacatcccctgtatttgctctctgtcctctgaagctgctgatttaacatcactgattttccgtatggagcatctcaatgaaatgcatttttaaatgctgtgattttggactttctgtgttttttttctgtgaaggttttcctggcataggaatgtaattgttctgccctagtgttattctctgtccatagaagggagttaccattcttggaactcagatttataaccactttcttattttcgtaatgcctcctaatatactttttaaaagggacttaaccttcatataattcagttttccttaaaatgtttaatcacccactttagcagccttggctttgtgtgactcatggaatatgtgtatcattttatttttaaaacttactcattaaactgaggacaatgaagatttcttaaaaggtaaatataaatagaatgtcacttaaggattattttctgcttttatatggtttttcccatattttgagggttcttgctcaaaatatctcaggctgactaatgaattttaggctgatacttagacattcatgttaacatttgaaaatgatactcgaacccggagtttgggacttaatggaagaaatgttttatttcggaactttattacattgatgttgggcctattgtgtgattatactgtatcacaggagattgcaggctttttattcctgatctgtatagtttattctttgttgctgcctcctattactgcaggaggggttttctctgcttgaaacaccaagttatctggaccattttaagggcacagaaataatacttgtgccctttttgtatatgcctcatgtgactccttgaccttgaactttgtatgatggatggcatttcatgaaaaatagcccttttctaccccagaaaagtttttcatcttccttaacaagaggcaataactgagtcaagaccatcaaaacttgcagctcttgccctaccccgcatcaaattgcagcatattgagagatgataaatatgtaaaacatgaagccagagaggcaaagacgtcagctcaacattttactgttactttcagatagcatcaaaacttggcacatgatgttgtggacagaaccgcaggctatatttactgatcttggttctgccaattacttgtgtgtgactcctgcaagtcagttagcctccctgggtttccacatgggtgaaataagatgctcttggctgggcacggtggctcacgcctgtaatcccagcactttgggataccaaggcaggcagatcacctgaggtcaggagttcgagactagcctggccaacatggtaaaaccacatctctactaaaaatacagaaattagcccgacgtggtgtcaggtgcctgtagtcccagctatttgggaggctgaggcaggagaatctcttgaacctgggaggcgggaggttgcagtgagccaagatcacgctactgcactccagcctggcgacagagcgagactccgtctcaaaaaaaatgctctcaaaagtctcattaagctttaaaattctgtatttcctgttcaggtctctttccaagtccctctgctcct

SEQ ID NO: 114737 - DNA, 1052 bp, Homo sapiens
aacgggtttgggaaatgtcatgtcaggtctctttattacaggacttctcagtgcctttaacgtattaatgtacattgtgagtatcaaagaaaaaggaaggttgtggggaaggggatatgccatgcggtattattttttaatattaaaaatatgggtgtcttgaagaatagaacaaccttggagaaaggcagctttaggaagaattatgtaaagatgtaagaatacatatttagtacctactagatgcaaggttccagagcatacataaaatgagacacattgtccttgaattctgaaaacaaacactttttatgggttggtggggcgcaaaacatttacatgtggaagaataatatttaggatagaatctaagtgccacttgtacccaacattgtacccaataggtaacttttcaaccttcattcagtccctgtcttctgagagcttatgatgtagggctggtgaggatggtggataaggatgaggccaaggataacatggagtgggattagagaacacaggcagtggtgaagaggttcaaagaagacaattgtcacacccaagagagggattacggaggggaaggagagactcactaaagggaggatctcacaagataggcagaatttcaagagagatgggattgaggtcattttgtgggctgaagctatcctcctacttcagcctcctgagtagccggtcttgaacttctggactcaacagtactttctaatactggagttattagaaaaaaaaacaaacccaaaacttaaaaaggaagacccttatccttcactgaggatctgtttcttttttaaaaaaattttaaacattgttttataaagataatgtctcactgtgttactcaagctggtcttgaactcttggtctcaattgaccttccttcctcttgactcccaaagtattgggattacaggcgtgagccgccgtacttggctgaggagctttttaatgggaaattcttagatggcttcattgtctatgggtgtaatttcctgagacagtcctactatcctggtctttattgctgt

SEQ ID NO: 114738 - DNA, 1004 bp, Homo sapiens
tggtgaaaccccgtttctactaaaaatacaaaaatgtataaataaattaaaaaaaatacaaaaattagccaggcatggtggtatgcacttataattgcagctactcaggaggctgaggcaggagaatcgcttgaaactgggaggcagaggttgcagtgagccaagattgcaccactgcactccagcctgggcgacagagtgagaccctgtctcaaaaaaaaaaaaaaaaaaacccacttcatcttattttatggatccactgtggagtgatggtgagggtatatattagagttctccagagaaacacaaccaataggatgtttatctatatacctatatatagatgtgtatataggatgtttatttatctatagagagaaaaaaaaaggagattgattgattctaaggaattggctcatgtgattgtgggctggcagaatcggaatctgtagggcagcctgacaggctggagacttcaaagaagagttggtatttcaagtcaaaatgcagtttggagacagaataccttttttgtgtgagatctaagtcttttggtcttcaactattcggatgaagcccacgtacattatggaaggtgctcctctttactcaaagtttaccgatttaagtgttaatcatatctaaaaagtacattcacagcaatatctagactggtgtttgaccaaataactgcaccgtagtttagccaccttgacacataacattaaccgtcgcatagtggagatgaggaagtggtagtctgggcctacgttatataagaatagtgaaatttcacctgatttaaggaaagctaaatgttaaatgttaacaatgtgtttttacatgtataacatcacttaattatttgaatcaaccttttgttttaatacatgagtgagttgaccatatatttagttttaatatactcatcacccataaatttctgttgatgatataagcattacgtgtgatataggctgtggactggtatttacatatgcttc

SEQ ID NO: 114739 - DNA, 1057 bp, Homo sapiens
tgggactttgcaccacaatcctactcagctaccgtgggaattcttgcttgaaagtaaatctaggactatagttgtggtaatatttgagctttacttttcttctgttactcttgtccatttgattgaggctaagaaaactggccctctgttaaattgaagttgcttttctaaggcaataggctctgggagaatggagaggtggggtctcctaggttaccaagcttgtgcactcccatgaaaaagcctgggtctctgtaaaatatgttggtaacagttaaagcagaagccattggagagagagagagggaaaaaaaaaaccaacttcattatgatttaaattaatctctactttttattcttagatagaactaattaaagttctaattattttgagtgctttaaaactaggtgacagggtttccctttctctaaaagggattggaatttttctttaggaacaaaattgatgggtagtctgcaaaaggattcaaattgtttagaaatatatgaccattatgaagcattattttctgtcagtgtctatgatttaggggtcgtagaagacctgaatgtaattagtgatgtggtgactttgtgaagctagaaaaaaaagaattgaattttcattctatctttgaaggaagaaagacattgtgagcttagaagcaatagaagaagtcacaaagtacacttaaattagaaagcttaagtttattgtgtagtggatagtcaagagggaagactctcccacccccttccctcttggtaggcaaataccagacagaaaatatttgtagccaaaatggctaccagtctttattgtaagcgcatcaactcaaagataaaacaagcagaggacatcagaagacaactcacagctactaactgaacatgaagaatacgtcaccgataaccaagtgctgcaattaaaataagatgctggccaggcatggtggctcatgcctgtaatcccagcactttgggaggctgaggtgggtggatcacttgaggtcaggagtttgagaccagcctgaccaacatggtgaaaccctgtttc

SEQ ID NO: 114740 - DNA, 1057 bp, Homo sapiens
ggtgtgagccaccacacccaaccatctcatttatccttgaagtcacactatactacacagacatgaaggttgaaagatgctagaggtggagctgcttataatgaaaacctggtggcaacctagatgtttaatatcgtttagctttaaagaatgttgatgcagctctttattgataggaagaaagttcagcatatgttacttggtgagaaaactgggctgttgagcaaaatatttgctatatgcatagaaaaaatatggactgatagaaaaaatgggcagggtaattcttgagtgataggactgatagtggtttcatttttatttttaaattttctgtatctttgaaacttgtttacggtgaatcttgtttatatatgcaaaagttttgtaaagaaattatactatcaaacttaatgaaaagctagaatatatacttacaccaggtctttagcattttaggtgtcctatgtccttaattactgaagatttttttacatttttcatcatctctgagtgttaaagtctctgtacgtaaaagcttttagtaagtttcacaatctggcttatatttcaacaactgaatgcactaaatattacttggcatttacaaatgcatgtggtaatttggaaaagtgcctttcttacaacataaatcttccaagtaactttgaaagttgttgtagtcatcatcttgaaaactagaaaatgtgaacactctaacttgtataaagaaattccaaatgttattcatcttatggtctattttgtaatttgttggaatcattgaagtgcttcagggaaattaattcggcagggtttatttaagtgcctagagcttgataaattagagtggagttttagcatgcagagaaatggtgccgtcataggactgcatctttttgtctgtacaattccagtatcagcctataagctctgcgagttaggaaacttggctgtggttttcctgtggtactcataggacctcacagagtgcagaatacgtgatacaagtgatcatgacaaaatagtgaacttttactcagcagttaatatgtgc

SEQ ID NO: 114741 - DNA, 1108 bp, Homo sapiens
gataccatcttaccacagtttcctatgcagatacaagttttcccttaattgtatattctgcagtttattttgatgggacatcgatacattgctcaagatatggatgaattttcccctaagttcaaacctccttagtagcttaaaaatcagttattctctggataagtatggtggcagctgaagcttctgggcttgtatacagcctgcggtatatctcatctgtgctgtagacagtctgtaaatctgggtttggccatgaaagtatattgtgaatatgaacatcagctaattctagagaaaaagaagcgctattcaaaataacggagtggaatttcccatgggtctttgaataataaccataccagctaacacttactgaatgtttaccctgtgccagacatggttttcaatattttataaatatttgattcatttaattctcacaacaaccctctgatagaggctactcttattatctcgtgtcttgcagttgaggcacacaggggcaactaacttgcccgagataataagtggtagagcgaggctgtgcacccaggtggtctggcttctgggttcttgcttttaagcactatattatactgcatttcaaaaggcgggactgagattagagatctgtggtcttctaatgctagtataaagagtttggatttgctagaatagacagaagggagccagtttattctcagtagtagagaggtgtcaagatgaaactgtcaagataataacattcaaatagttgcaatggagacataaaaaggatattttgggggcagttggggcaaaaggaaaagttgtgaaagctggctacttcctcagtgttttagtagcaatattatctgttaagcccagtgttctgcttgagtcttttcctcaggcaagcattcattcactcagtaaacatttattcatcactagccttgtgtcagcccttgtgccagatgcctgggatacagacgtaaaagccatggtccctggccaggtgtggtggctcatgcctgtaatcccagcactttgggaggccgaggcgggcggatcacctgaggtcaggagttcaagaccagcctgaccaacatggtgaaagcccatc

SEQ ID NO: 114742 - DNA, 1384 bp, Homo sapiens
aaaattcagggcctggtaaacagaccagaaagagaggcaataaaagcagatgaaaaattatgtgtctgtaaacctcgggtaaccttgagctgctggtttggttctgtaacacggtggacagagtgagctgtggatgaggtcaaaggccaacgtgctgaggagcagctgtctagttcagcgagaaattagctaatgtgtaaactggccttgaggtctttttacgttgcttcatattcctagtgttagttaaaagaagtaaattttatctcagagtttggtgactagccgtgatttcattgcactatttatgttttcttttgggaaagcggccttcttgggtgtctccatggtgaaggggaaggtattttaaaacacactcattcgggagcaggctttaatttgagtgacaggagggtgggggctgcgaggactgcagccctgctggtcagtgcggctgtggccagtgttgttcatgacctctgtttcttctctttctctacagaccaatgagtggaacaagaatgatgaccggctactgcaggccgtggagaatggagatgcggagaaggtggcctcactgctcggcaagaagggggccagtgccaccaaacacgacagtgagggcaagaccgcgtaagctgaaacactggtttgcagatatgctggttctgggtttttggggtgttctctggaatccttagtatccataggggaatttcacacgtgctccctctccactcccatgttgaaatatgtaagaagatattttaatctagtgcctttctctccaaattccaagtcacatatggagctctaccttgaatgggtatacatgttcccaagtataagcaaaggttttacctcctaagattgcaaccaattgtagatgagacatgaattctctcttcgataagaaatagcataaaagagaaaaaagtattttcctataaccctcaaaccttactgtgtatttatcttaaactacttgtttatttatttgatcttccttaacatagatcattaagtacatgagtagtatgattttgctttatggtttgctgtatgtagtactcttccttgccataattaaagctgtatatttgattaagtatttgtgtgtgtttgtgcatgagcatgtatttgtttatatccattcttacgttggcagtgttgtggagagagcactgactttggagccagatagacatctcacaggaactctatcacttacgagttgtgtaatctctgaacctcagtttccttactataaaatggagatggtattagttaactgttagagtagttatgagtataaaatgaaataataatgtaggttgggtgccctcagaagcaggctctgagacaaggatttaagtgcaagtag

SEQ ID NO: 114743 - DNA, 1001 bp, Homo sapiens
aacctttaccacctagagagccaggcagtctagaaagtcccaacaatgtggcaacaaaggcagccatctccacagacgttctccagaagcctccataacccaaggtcaataaccagatgggtggttgggtaatgccttagacttttgagtttctttctggagtattttctttcagggaaagatgagaatgcatgccaggaaattttcttcctctaagactgatcaaagaggggttaaaaaaaaagtaaaagcaattgaatgactggaattcatttaggaaaagaataaaggaagggtggtgtcttgggtaggaagggaacaaaatagagcagagccaagagttatagctgcagcctgtgtttatggagtcaggcctggcgtgcctctgcccagctgttctctttccatggtggatgtgaggaagtgggaggaggtcaatgtcctcaaacctcttaccgtagaagagtctaattgtttcaagatgggttccctacatttggatgtgcatttaattaaagttatgtgtgtttgtcttacgaacaaccagactaaataaaatcactgccggcactgtagtatttgaacaaataccacctgggcatgtgtgtgtagatataaggagtgtgtgcatgtgtgtgtgtgtgtgtgtgtgtgtgtgtgtgtgtgtgtgtgtgtgtatgtgtctgtatcattttatgttgcccacttttcagaaacctgatctttttggctatgaaagcaagaatttgtgagagtatttttagatgactctgtggagcttgactataaagtgggagaggcaggccttgaactttagaaatcactataataagggcttctctggctggtggtttgttgcacattctcccttcctgttttctcagtatagggatgtattagatattttacaccagcagttcagtcttggaaatcgagttataccacctgatcagctctctccagttcttctcacgtacagctgccaaattaatttacctaaa

SEQ ID NO: 114744 - DNA, 1002 bp, Homo sapiens
gcttttgattcagtagatttggagtggtgcctgagagtctgcatttctaacatgctcctgttccccaggccactctttaagttagccaagacttaggctgtcaaagtgttatttcagctacatcagaatctggatagtaccctggccgggcatggtggctcacgcctgtaatcccaacactttgggaggctgagatgggaggattgctagagtccaggagttggagaatctggttagtacctgctatcccaggtagtgaccagcatccctgtcactgggcttgagttaggaagtagataaaatgtttttatactcttcgcatctccacagctccactgcattcttgacctatctaaatgaagatgtaggcgggtttggtggctcacacctgtaaccccagtttgggagaatcgcttgaggccaggaatttgagaccaggctgggcaacacagtgagaccccgtttctgtgatttttttttttttaaagaaaggaaaaaaaaaaactatcttaatggtataaatatattggcatatagacttttgaatgacatttcgtgtctttgaaaggaaagcccacacttcttaatccgtaactcattttatgaggccagcatcatcctgataccaaagcctggcagagacacaacaaaaaaagagaattttagaccaatatccctgatgaacatcgatgcaaaaatcctcagtaaaatactggcaaaccgaatacagcaacacatcaaaaagcttatccaccaagatcaagtgggcttcatccctgggatgcaaggctggttcaacatacacaaatcaataaatgtaatccatcatataaacagaaccaaggacaaaaaccacatgattatctcaatagatgcagaaaaggcctttgaaaaaatcaacagcccttcatgctaaaaactctcaataaattaggtattgatgggatgtatctcaaaataataagagctatttatgacaaacccacagccaatatcatactg

SEQ ID NO: 114745 - DNA, 3018 bp, Homo sapiens
gccaggagttcaaggccagactggccaatatggttaaaacccatctctactaaaaatacaaaaaaatttagccaggcatggtggcatgcacctgtaatcccagctactcaggaggctgagacatgagaatcactggaatcctggaggcggaggttgcagtgagccgagattgtgccactgcactccagcctgggcaacagagcgagactctgtctcaaaaaaaaaaaaaaaattagagtctacagataaaatttagagtccaaaagaagaaaagagaatcacctccaatagcaagactctgacatggttttgttgtatagccatacttctgagttttcatctttcatgtggttagtcaactagagactgtatgcttcttatcctcattttttatattattttctaagattatatgtacagaccaagcaatagtccctaatttttgtttttatgaatcattgtgtgaggtgatgagtgagttactcaggagctcatttcatcaactgagataggctctgtagatggaagccttgaacttcatctggaccagctgcccacgattctcaccccttgctgtacttcagggcatccagttcacctgggaacttgaaggaagggaaaagagaagaataaacagtacacacacacacaaacacacacacacatacacacacacacaaatatatatacctacactttaccctctgagattcagattccattgtctggaagttgccagtcaactggtatttttttaaagctcgctgggtgattctaatgtgaagccagtgttgacaaaagatgaacaaggcaaatggagagaaaaggtagcgtagtcttaccttgtataaaacactgtcctataagaaggagcccctggggtctccagcctgggattctgcccctgctggccaccccaaaagaccaaagcaaccactgatggcttttcatttttcgattgtactcgagaatttttggcttctaataggtttctattagtgtttactgggatacaaaattagcctaactccattgcctttatctaggcttttcgtgaatccgtaatggatccctttcttttctcccatccccaaaattggcctcttcagactagtcatcttgagggatcagccaggtattgcaggaatgctattattactcaaaatatggttgggaacaggtttagaattgttttcattgtgtgaggacttaaaaaaaagaatctcagtggttgggaatctttatcctttgagaatagggtttttttttagggcaaacctaagagccctaaaaaaatttgatgtcaagtcaggtgaatgatgtttcaaactggtaaaaccatttttggtcaaaaatagggagtgattgaaataacagaatgatttttctgagcagttccacagaaagttccaaaaatattttgagaaatggcaacaccaatatagggggataaatggtttccttaagtgactgccttgagggaaatactaatttatgtttttccaattaaagtcatctttaaactcaagacccaattattgtgtttgtttttaaagttcattgtcattgctcttaaagttatgccataaaaccacatggtgcagtatgatttgctaaaatacccctaatgagatgtatgtcctcttaagtaggagaagtttccctctaagaaacccataatctgaaagcattagctcagagtgaataaactggtgccgtcacacggttttgtttcattgtacttgatattaagaaatagattagacaggactgtagttattttcagcataaccaaaatcttccctcacgtctttttattgtagggaaaaataagttggttttttgtgtgtgtttttttgtttgtttgtttttgagacggagtcttgctctgttgcccaggctggagtgcactggcacgatctctgctcactgcaacctccgcatcccaggttcaagtgactctcctgcctcagcctcctgagtaactcagattacaggcacccaccaccaccacgcccggctaatttttgtatttttagtagaggcggggtttcaccatcttggccaggctggtcttgaactcctgacctcaggtgatccacccgccttggcatcccaaagtgctggaattacaggcgtgagccaccaagcccggccagaataagtttttttttttttttaatacatgcttattgtagaaaagttgagaaatatagtaaactataaagaagaagataactcaagttcctactcctatcagaaagaaaaaaaatatttctattttgttgtatttccttccagattgtcccaatacatttttacatgcctgagatcacattatataataaattctatatcctgcattttaatttattaaatatcccgccagtttcatttcccccattaaaggctcttaagaagcatagttcttggtggcctcataacaccctgtgggtagagctcatatttaccaccagagccctaacccagttcctgagaggctggtgcagtgctgagcaggaagacctggatgccccaaggcagtgcccacttcctgcagactgagatggtaccactctctaagaagcaacactggagggagtgctgtggacacagcctggatatttcccaggattcgccagtgggaaccaattgaaattggtggaatccacagcactttggggccacaggacattgtccaaacattccatgggttgaagatgtctcagagctcccgtcacttccttctcacctgatatttttagccatgattccagcacttccctccttgggcttcatcgttttattttggcctgaaggaggtaccagcttcttcccatgatttcttgaaagcatgcaaagagaacacgggaacaaaagaagaacactgcatggaaaaaagtgcatctagaaaaacacttctcatttttttctgtcccaataaacaggttaaattgtaatggctttgattgcccatgcctgtgtcttacctgttggctataatacccacctattcac

SEQ ID NO: 114746 - DNA, 1042 bp, Homo sapiens
aattttgcatttggagagagaatttggtgttaatagtagcaatgagagacatcttacttcagtgttatagtgttcagggaatgatgcgtcattcggattttgagactatttttagtgaaaaatacttttctgctgctcgttagaaaaacatcacagggctggggaataaaagaatttttgcttctatagaaacccggcacttccaggtatgactagaacacttactcaaagtaaaaagaaaacctgttattttatagtaagttgtttacatctcccaaccatcttgtctttggagaaccaggtctttttccagtgggtgttgcttatgcagaacagcttttgttcacagcagggacaagttaatgcattgcgtacacgacataaacggtctccatcttacaatcaggatgtgttccaaaccttcatttgtaaggcatttgtttaaaactcagaatgtgcttgtccacagaaacagtggtataagtgatggttggagggccaagctactccaccaaagcctatttaatgcatcatgtaactaaactcatacacagttatgcttcatacactctggaaggagggatctcatataatataacaggaggaggaggaagagaaaatctttgtcttcttacttccaagaatctctcttccttcatttttaaattttgttcatcctcctccttttgggaggggacagagggattcctgtctctcagtatcctatgctgatgaaacaactctcccccacacctaccctaaaaatctctccgtacagctgaattcaaaatagaaggaatcggatcatttgactttacacatttttatgccattcaccatagccctatggcccactagtttttaaatacagtgtttcctagctatatgattctctaattagtgaatttctggtcagtgttacagactgaagactgatttagaaagaaaaatggggccgggcgcagtggctcatgcctgtaatccacactttgggaggccaaggtgggtggatcacctgagatcaggagttcgagaccagcct

SEQ ID NO: 114747 - DNA, 2123 bp, Homo sapiens
agccttttgagattcttcaaataagctctctcaggctgggtgcagtggctcacgcctgtaatcctagcactttgggaggctgaggcgggtggatcacctgaggccaggagttcgtgaccagcctggccaacatggtgaaaccccatctcttctaaaaaatacaaaaattagccgggcgtggtggtgcatgcctgtaatcccagctactcgagaggctgaggcaggagaatcacttgaacctgggaggtggaggttgcagagagccaagatttcgccactacacttcagcctgggtgacagggcgagactccatctcaaaaacaaacaaacaaaaacaacaaaaaacaaatgagctctctcccttcccgaaccctcagctattcctcccgccctttctcatactgtgtttcttgggcactgtgcaccgtgtcaagcagtgacaaacagcagcccctatcccagtggagctcccagtctggtaaacaatccacaaataaacattacagattgcacagcagtaaaaaggaagctaacgggttactgtaagagaggaatcagaggtggaggttcatggaaggcctcgtgaaggaggtgatatttaagctgagacctcccaaggatgcaaagagccacaaggaaagcattctaagcaaatggtacaatgtgtgcaaaggacctgaggtcacaaaggtgctggccagggagggaagaatgccaatgtgtgggcctggggcagagcaagtaaggaggaaagcagcacaggatgtagggccttttgtatgtcatgatgggcttgactgcagttcatcctaagtacagcatggaagtgtgaggggcttttaagtagacagtgagagtcacagttttaaaagagaattctgtttctttagagaattgataaaaaggggaaaaatgcagaactggggagacgtgccaggaggctaccttagctgttcaggtgagaagacgctgtcctagaaaagggtgtcgggaacaagaaagggaagagggtagagtggaggcgagttttggagaaaaaagttgacagggcatggtggtccactacatgtggggtgaggaagaggggtcggggaagggggtggaggatgaggaggaatcaaagctgaatcgctggtttctggctcaatgtctagactgatgatgatgctgttgatggagaaggcagtcagggaggagcaggtggggcacgggggaggggaagccagagattttggctgggcctttgagatgctaataagacatcagagcagagatgtgaagtaggcagtgggttatcaagcctagcgcttgaagatgacaacttttgtgtatgagtaagaatacaggccctagcccagcctgtctgagtttgaatcttggctctgccatttactgcgacttgagcaaattatcaacttttttgtgcctccgtttcttcatctgaaagtggaagtaatgatagtatccacctcgtgttgttaggggacataaagcagttctttgaacagtgcctggcacgtgagagctaatacttacatagcacttattgttgtcactgttaggacctccgcatttgggagtcactagcgttcattcttctagatgatatttcaggttgtgggtgtggaggagcttaccagggaaaagagcttagaggaagaacactgaggagccctgaggttttctgtttggctagaggaggagccgcaagaggaaaagcagaataagatgagccaagcagggctctaggagctgagaggttggagagaggaggacagaaatgtttatcgtcattggaaacatgaaggtttttggtgaccttgaccaaggccatctccttggactcgagaggggacacccaactgcagtggttttgggagtgaatggaggtgagggtgcgtggactgcatgtgggtaatccttaagagaaagctggtttcgtgaagggggacagaaagggcaggagatgggggaaaagaaaggattaagatgagagagcctagagtatgtctattagctggtggggtgctggagtgatgagggaaggagaggaacagataggtgaagcagcaaagaggggagagtttgcccatcccaaagacatgagtctccttccccatagg

SEQ ID NO: 114748 - DNA, 1948 bp, Homo sapiens
tgtggtgttacacaaagtagaaattgagtttgccctgttattgtgtagttttttctaaaaatatattgtcactatctgtttttttgatgaacagtatatgtttggttgtttatttatttacacatctacgttcttgaagaaatcataaacagcaaatactcaatactaaatttatgtgctaactgtattacttaccagtaaccttcaaaaatgaagttatccctttccctcatatttatagtctttaaaaaaaggaatggaagtaatgcagacgtgtgggaaataccattgcttttcattaatacagaaagctggctgtgattgtattctggattctaagttgtagtagacctcaacctctactttcccagttctccacaccaacctaatctggttttgtctcatgtgtttttattttcttgctattaaagcatgggctgctaggagaatacttgtgcatgcatattatttatttttatgttggtagcagatttcagattttgataaagtaagaaatgtatgaacttttgaggtttttctcatgtgtttgataaagctacttgcccagactttactaaccaaactaacccacctccattctttggactgtgataactttcagcatgaccaagtctctaaaataagctcagaaagaagtggaactccaaaaaaacgcaaagctccaccacctcctatcagtcctacccaggtaaaaacaaaagcaaaccaacaatcaataaacgcaccacaagaaagccataaatttgtcattttgtttaggccaaaaaggaatgttttagaactgacctttaagtgcatatttaaaattttccttagcagttttaaattacaaattgtggtaagaaggattgatgattagtatggaaataatgttgattcttatctatttttaaaaaaacagtagaatcgaatagcctctttttgaaaagtctcaaggaaatttctcaaaatcttatcacagaaactttcccttaagataagttcaatttatttttagttccttatgttaaaagatctagtaaggactgggagaatgagtagccattgaggcaattagttgaaaatgaatttcagttcgtttcttaaaacattgctgcaatacatttgcctttttaattgcttttaaggttggctaatattaaaagtagttttcatttctgagctttatagtgacggttgcatagaggaggaagctcagtaatctatgtaatggcaggtaaaaacacatcgaaatttgttatttaaaaattcataggccataaagagaataatccatatttaaatagtagagaggaatagctcatctcataagtattttttaaatgtatgttagcatacttattaatattcttaacctgcaatagaagttttatagatttttaaaaaagtgattctaatataggagcacagttatattctgtaaactttcagaaagtatttgaagtagctgaattgcactgaaaatattctacccgtgaattaattgatgccaaggatacttactgttagatttcattgcattggttaaacaggttgattcttcggcactggagaagaggagtttgaagatacattctttattaatgattttcattttgtttcttttttagttgagtgatgtctcttccccaagatcaataacttcgactccactatcgggaaaggaatcggtattttttgctgaaccacccttcaaggtatttcctttctgtattcagttttgttactgtattttaagatacatgatagacttgctttaagttatataacactgggaaaaacagaatatacttctgaatcattggttcacaaccttttcaccatgaagtaccccttgattattttttctggcatggaccccataaagcaagaatgtgtacagctagtttgtatccataataatttaaaatttttaaaaaatcattga

SEQ ID NO: 114749 - DNA, 1041 bp, Homo sapiens
tttaaaaagagacaaagataagaacttactagataagcagtcttcttacccaattaagtttatattaattccaatcaaagagacagaaacttgtgttattctctgttgtcttactgagaattgtatagttaatttttttcctgactataaaagtaatatgtatttattttacaaatgttagaaaatccattaggttttatccacctggttctgtagatttgtggttgcaaaacattttaaggaagtgggaggatatttccatttaatatctgtttaatatactgagaaattgtactcaagggggaaataaaatttataattgttaacatgaaatttcgatattttatatttacttactttcccttatttagaattattaaagatgtttttttttaacttggatacacattaatctgaaacagattctatcaacctatcatttccctcactttagactttactaataaactcttcagatgaatttctatgtaagacaaggcaactatactcttatagttagtacgataatatcttctgatatgactgtgcctcaaagaagcagtgcaatccgaagaatatcacaaattatgatttttcagaggtagagtataagactgtcatttctgaaaaaacaacaacaaaaaaaaacaagataaaaagtgacatttattcctacgttagcttagggaggagacaaaagtgatatctaggccaggctcggtggctcacagctcatgcctgtaatcccagcacttcgggaggccaaagcgggtggatcatgaggtcaggagatcgagaccgtcctggctaacacagtgaaaccccgtctctactaaaaatacaaaaaattagtcaggtgtggtggcgggcacctgtagtcccagctactgggaaggctgaggcaggagaatcgcttgaacctgggaggcagaggttgcagtgaaccaacattgtgccactgcactccagtctgggcgacagacactccatctcaaaaaaaaaaaaaaaaagaaaaagtgatatctatttaaaatggctaaa

SEQ ID NO: 114750 - DNA, 1113 bp, Homo sapiens
ctgatggggggaaggaagaatgggtattatggacttttgtacatttttgaagtaatccatatatgatggtctcaattttcatgatgaattaggaggacaggttcttagaacaagagtttcagagataagacccttgaaacagccactgagaggaactggagtaatagctcaacaaggagaaatagaagcatcagcggctgtattgaggaaccactggagattggggccaccaccctctttgccttcttagtacactgatagctaaataattgagctccccaaggattatacaatgctggccatatagtgggtaatcaataattcccttaaaaataataggctttaaaaattaaattagtacatatttggtcattgtagaaaagttgaaaaataaagaaaactctaacaagttcctataaataaaaattttccataattcaataactctgagataatcactttttacatttgatatatttccttgcagtatttacatttaatgtagctgtatttgcataagtatatgtacatatatacacacacatatatacatatatacacacatatatagacacacatacacacacacacacatacacacacacatatatatatatattttgagacagagttttgctctgtcacccacgctggagtgcagtggcgtgatctcggctcactacaacctctgcctcctaggttcaagcgattctcttgcctcagcctcctgagtagctgggattacaggtactgactactacgcctggctaatttttgtatttttagtagagacggggtttcaccatgttgtccaggctggtctcaaactcctgacctcaagtgatccacccacctcagccgcccaaagagcatatatttttaaaaccaaatgtggggtgataataactcctttttatacagttttttctagagttgacataccaagacttttttccctaagatgattgacaagtattcagaaatacacaagccagtaaggccacaacaattttagaagcttccagtgctagcataaagtggaggggaccacttgggtagcatttggctgcagctttctcatagttttttgtttttgttctttaaagatctctt

SEQ ID NO: 114751 - DNA, 1026 bp, Homo sapiens
aagctaaaaaccctgatatggtaatattatggtgcatagcagaggtctcggaaaaaaaatatttctgttcactttactttcaggttaaaaatgtttctaacacgcttgcaacttcccttatggcattaatcttgttgagggagagagacagaatcctggactctccaaagtatttaactgaaagtagggcctgctctgacagggcccatgtcccacaaggctgcttggcctcagtgggtgcttggctgtgctggatgatatgttgatctgtattggataaggaccaatgacagcaaagcaaaaatggctttaaagcttggtgttacttttcttaagttgtttaattatagttaagcaatttcaaaaatgctccaaagaaatgtgaaaggaccttttgtcacagcacttcagaaaatacacaacagccccttctgcccccgcacagaaatgctgcagagtatataaaacttgagacatttttgtaggatgcctgacgaggtgtagccttttatcttgtttccggatgcatatttattacgagtactctggttaaatattgaaaagttatatgctgtagtttttagtattttgtctttgtaatttacagaagttattggagaaaataaacttgtttcattttgcatttctggtgttgatttttggtgtattcagaagcatatctgcgtggcttctgaagatcagttcaatagcatttcagtgtaataggttttctagtctgtgctatgctcagctggtatgagttgtccgcactgtctcacacaaagtctcacatcatttccttttcccagctcttggattcgccctgagctctgccctgagtatcagccgctttggggcagttgaatcacagttgcctttaattcacaattgcctctcatttaatctgcagtctgtttaactgtttggaagcctccgctggattttttttccctcttgcttcttgctttttttgaaaaagtaatacatacatatgtaaaaaaaaaatccagatacattttcctgccc

SEQ ID NO: 114752 - DNA, 1033 bp, Homo sapiens
aatcattttctataggttatctacttttggaaatgcaggaagttcccaccttgactatcccaaagattctgatttgatggaagcatttcattgtaatcagacccaagtcaacaggtcagttcttaatatagaggttgtcattggtgataaagaggaggttaaataccagatttctgttaaataaaaacactttcaatctgttaattaaaatgcacagcattttataaaaatgaatagtagagtgctggacttactaggggatgtagggttctaacagtgaatgaattttaaaacagaaaatattagcaaattggataagtacttgattttattcttagatttgctactttttatcctttacttgggagttctgagcagtgttcactgtgttgatataacagcgttttattttttcttctacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaatt

SEQ ID NO: 114753 - DNA, 1899 bp, Homo sapiens
actgacgttacagtacagatgacagcaatccactgttacacacattgaaccttcaaggaatagcataccctgttctgcagcaatttagttacttgctgtgttgatccatatagattctctaccctgaaattgtacatatataaaatcaacaagctatttctgaggtgtgtatgacaacctgaaaatgattccaaagaattatgttacattttgttctggttcccaattttcttgtagttttggaattctctacacacaactgtcatcagggaagatgtcatccctttttatgaggagatacatatatgtgagaaattgggcggaataaattattcttgagaaattttatgtatcatttcgaggagaagctgaacccagaactataaagctaaggccaagtatgacttctttccattgcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggtacttgagagcagtgcagttatagttaatgtggtctgtactccatcttcccacttagacatttgcttaggatgcaaaatttttattatccacatttttagagttttcacaactttagacagcttgtactcttacctcataattttatggatcaagaaacttaagacccaggaagattaactcactatttcatatttaggtggtggtggcatctagatgagaagcccagtcctctaatttataaactggtggtgttttcattgtactactccttactttcatagatcaggttacatcatgaggaaaattgggtttaagtgtttggaaagggtgtttgtattatggtatctttttcaagttagttcaggatgcagaagaagatgttttctacacgtggctcattcattcactaagtatctgttgatcacctaccgtgtgcttattcatcttattaagcattgtgggaagaacagcttaaaaccaaggtgaagccaagaaaatgtgaaacagcaaaccattaagtaccaagatagcacacacagatacctgggaaatgctgtataaggatttagggaggattgctcaaggctggcttcccaagggagggcagttttcagcaggagtacaatgtcaaaaaagctgttcttgatagtttaacacaagtctcttttcaggattagactcagagattctagcaatttagagagaggatctaaatattctctttttgaaatatttcagaatattaaagcccctaaatacatatggaataaaaggaataaggtattctttttgtaactactttagaagaattacaggcccggctgtaaaagtgctgtggcagacacctgtaatcccagcactttgggaggccgaagtgggcagatcacttgaggtcaggagttcaagaccagcctggccaatgtggtgaaaccctgtctctactaaaaatagaaaaattagttgggcgtggtggcacgtgcctataatcccagctacttgggaggctgaggtgggagaatcacttgaacccaggaagtggaggttgcggtgagctgagattgcgccactgcactccagcctgggtgacagagtgagaatctgtctcaaaaaaaaaaaaagaaaagaaaaagaatcacaggcccttgtcatgactttggggagttaaaaatttggctcaaggtctgagaaagttaaccaaaatggaaattggaaacctt

SEQ ID NO: 114754 - DNA, 1035 bp, Homo sapiens
gcccgcgccaccagccccgcctccaacaaaacaggcgatggcggggcgggcccggagtgtccagataatcctccaagagtcccagacaaccccattcaccagcccgcccgcgggacagcatcgcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaaggtaggaggggatgtccccgggctacacctgcggcggcggctctgtgcgccttttcttgggttacttacttgactacagccttgcttaatttcagagtagcccgggtgttaacggtaggtcggttttagcaattctcccggccagactgggcacggagtttgcagctaatccttgtgcacgtggccgtcttcctggaggcggcgggttttaaaacctttacccggcccacggggaagcgacttacagggtgctcagatccagcgttctttcttactagttgttcagttgttttttttttttaatgtttttggagagtagtgcttttccttggttatttctcgctattatttctccagtgattagtatgcccatatactgccatagtcagccac

SEQ ID NO: 114755 - DNA, 1056 bp, Homo sapiens
tgagattgcaaagatgactagaatgtgacctcttcctcctgaaatgttggagtttaggaggaaacttaagaattcaaataagttgatggtttttattcaaaagaagtgcacacaagttgttagaattagctttcattcaactaagaactcttcttaagctagacagaatactgtgaacaaggattatctttgacattaatttttgcgtcctccgcacttagcatagtactctagcgcggagtaggtgataagtaaatgaccccgtgtggtgtgatggcaagctctaagaaagaagtgagctctgtggaatgaaagataagtgtaaattctagccccgttattaacagcaacattctgtgctcttttctgacctgcagattggggggcagggggagggaatatttactttttatgaaaaataagctggacttgtacacttccagtaaatgttagtgttctcactcttcccttgagctaggtagtatctataatctgagccatacttcgatacattctatggaagtgcaggagatatagattatttttaccctagtataataagataaagaatcatgaaggatttagcccgtaagctgcatatcagaggaagtgtagaattttgacattcaaaaaatgagagggaacactccaagggagaaaaaaaaaccgatgaaagactttgaagtagggaaatgctgaaaaatgtaaaaaatagagccagattggattgcattaggcttcatttggggcaataatgatgtagacgtgaaaatctattttaaaattcagtgtcaaagctatgtcatttgaactttgtttagaaaactctgggaagtaaggatgtgatggaagtattactttaaaaatggtccagcgtggtggctcacgcctgtaatcccagcactttgggaggccgaggcgggtggatcactaggtcaggagttcaagaccagcctggccaagatggtgaaaccccgtctctactaacactacaaaaaaaaaaaaatcagccaggtgcagtggcgggcacctgtaatcccagctactcgggagtct

SEQ ID NO: 114756 - DNA, 1080 bp, Homo sapiens
tggaacagtggagtggcagcgccatcatatggctgttgttgtgcttatgttgagaggtgctttggggtttttttgttttttgttttttatttttaaaattttaacttattttagattcaaggagtatatgtgcaggtttgttacacgggcataaagtcagttttctttgacacctaagattaaaaagtgaaagatattttcattgaaactggtttcctttaacacagtctttggtttgtgagaattttcccatttttgaaaaggattcctagaatacctaaatattgagaaacactgcttacactataatttctaattcttacagactatattttacttattttctttacatttacaaagagtcaagatttttgagcgattgtttccagctcttgttttgaaaattagtaataaaatctcctttaaactgaagagtgtaaaaacactttattttctggatagcatatgtggtttgattgaaataactttgaaatcacctttaatttacttgctttttcttttttttctttttctagatactaaaatggatcgtaaggataagctatttgtgattaacgaggtaattttggaaagtaattgcaacaaaatatttttaaaatgttaacagtggcttatttcaaaactaagtcattcagtgactttaaaaattattttgtaaaaactattcagacacattttattaactcttcaataactggtcttccaaatttttatctctcacagtttagtgcttcattcatttctgtttgttttgtctgaacaagcatattgaaatttcctcaggagaaggattatgtcccattttttaaccctgtagtgtctagtattatgctaaatccatagtaggtactcaaaaaattatcagtcaacatatataaagtaaaataagtccattaaacatatatatatataaaacccacatggtaaaaagtgttttgccagtattaaaagtgatttgtgtggaactggctattaaggtattacaaactgaataggttacattttcaaagtattgtttaagatactacacttaggtattttttttaacctctggaagca

SEQ ID NO: 114757 - DNA, 1006 bp, Homo sapiens
ccaacatggagaaaccccatctctactaaaaatacaaaattagcggggtgtgatggcacaggcctgtaatatcccggctactccggaggctgaagcaggagaatcatttgaacctgggaggtggaggttgcggcgagccgagatcgtgccattgcactccagcctgggcaacaagagcgaaactgcatcgcaaaaaaaaaaaaaaaaaaaaggagggaggtttccagtaatcagaagtgagaccattttagatgctaggcccaaaaatatgatagataatttcacccaagatatgggcagagcatctagtttaccttgggtagaatacctaagaggaactttaaaggttccttctgtgaataaatacatgtttaggcctttgtagcctattagcctggttaggtatttttgagataatctggatgatattaatcacatataattactttagttctcatttatattatctacttcattttcctatactttgcttcctttaggtttgtgaaatgaagaactgtaataaatgcatctattttgaagctaagaaaaaacaggatctctatatgtggtaagagaatgtattaagattttggttaaactcatttaagtggatttgttctttgtaccttttatgttatagactcctagtgtttcatgttaagggttgagaatgaagcaaacttttgatttcacgaaacttgatacctttaaagaaaattaaatgtataaatattataagcatattatttatggtgaataggtggtaagcattgactacatttgctaattagttgaaaaagcttactccatatctttcaggctttcaaattcacctcacggaccatctgctaaattccttgttcaaaatagtaagttgactcaataaatttttttagatgaggaaattaaaagtaatcttttgaaatagttgtgcaaaagttacaactatttttgtttttgttgtaatttttctagttcataccctcgctgaactgaagatgac

SEQ ID NO: 114758 - DNA, 1003 bp, Homo sapiens
aaggatatacagggtttgcatacacaaaaaatgcaaataattcttttgttttaaatagcttccttttccctaaagagattgctgcaagtaactatgtactgtcttatatcttaagtgagctctacctacttctattcatgactgttagttgatacagagtatggatttcctaataagccattatatatttaactttatagaaagggaataacttgaagatccatgagatacttgggttcctaatttgtagaaagtgctgtaaaggatacagtaaaatagaagtttctctctcaaagcttagaagtttctctctcaaagcacctcaaaggttaagacctagcaaaatgtaattgctctagaaggcattcaatggcagcggttagatgatgagtcacacagtgactcattcaggagaaaagaggaggtgactctagaaatcttgaagcaggagtttggcacgataagtgcagaaagatgaagaggtggaagagaacagcaagaacaaaattttagacagtatatgacataaactgagctcttttctgcatattttatattggatacctggcatgtgagttgaacacatcatcctaacctctgagggtagacatgcctgaactaatagataacataaatatttgttgttcggaagttgccttttaattccataatcagtagctattaaataaatttgactacatatccttttaatctaacttgaattagatttataaaaacaatttagggattgatttaagtttcaagagttcccccataatgtgctttaatacattttgttaatagtggttactgttttaaaatcctgtttaaccagtttttcaaggatatatgcattgtgacaagcaagatgtgaaccaaaatctaattactcaattttaaaagaactcactgaaaaaacatttttccatgacaacttcctataagtactaatagatttcagaaaatattgatgatttgccatttaccaagtttcacccccacc

SEQ ID NO: 114759 - DNA, 1080 bp, Homo sapiens
aagatgctgctcttgtagaaataggacctcgttttgtcttaaatctcataaagattttccagggaagttttggaggaccaactttatatgaaaatcctcactaccagtcaccaaacatggtaagcggttgtgtcattcagtagtcttcaatgtaccagaaccctttggccaaaatgattctgtgaagtaattgctgttttattacctgtgaaactgaatttggtttttgctgcatagaaacttggaaattactcccttttttcatgacactggctgaaaggatatatggttcataactgaaagtctttgccttatataaaatgtttatttttatttcaaaagcatctaatcttttttttttttttttagcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatcagttaatttctgatttctttttgaagtttgtgttgctaaaaatgtagcacacttaatgtagcctgttctcttgggttggaatttttggtttagcaaagctgaaattcagacatttattaggtcatattatttgtaaaagcattcaacacttcaagagcatcggttgtggatggtaaagtaggagtagactggtagaaaggaaggcatctcactgaagtttactcagtcatcagttaatgaagccatggaagaaccaaccc

SEQ ID NO: 114760 - DNA, 1052 bp, Homo sapiens
ggcagcatattggggaagagaaggataaccttactaaaccgcttgggtacgccaaccctgtgcaatagatattagcaacatagctaaccatacatggttagtaaatacaacccacacctaactgatgcatgtaaacattccacattacagtgaaatatattggtgtattaatgcattttaataattatggtattattttgatacctttcaaagtgtttggaataattgtgcagatagtcagatcaaccaaaacctaccagttaaatactatcctttaactgctttcttaacctaaaccaatcttggaaaggtaggattagaggccagaaagttaggattaaagtgtgttggatggatagatcagcacaatttcatccatgttggtggtaaggcttttcattaagtgtgttgatgcttcccttttaaattgtttccgcttaaataatctaactgtcctttctcaagcatattggtcaagatgatcaataccagatatcttaagtggcagctgaagagaattaaagagattaaaaaaaaaacctgatattcagtccaaccgaattctgctactgtattagctgaggaggcttgagccaaccacttgaccacttggagtctgaatcgccttatctataaaaacggggatccattgagaaattataatcagatattttccagaatcctctcccatcccagctcctatctcccccttcagccctcaggtcggctgccactcacactgaccgccatctgtgcccctcacaatgacaccagcgtggccctgcctcccttccgcgcggccccgcctctcgccccgccgaggccccgcctctcacaccaaggtcccgccttcctcctgttcttcccggccaaggcctaccttcctcccacgcggcccgcctctttccccgccaagctcccgcctttctcctgcgcggcccgcctctctcctcgccaaggccccgccttccttcctcggggcctcgcctctcaccccgccgaggccccaccccctcccgcgcggccctttccggcacagagcccacccctag

SEQ ID NO: 114761 - DNA, 1093 bp, Homo sapiens
gcctttacagagttattatgagaagcaattgtgtgtgtgtgaagctcctagattaagttgacataaatttaggaagattcttattccagtgcatcttggtaaatttccaaatcacagatgtgtaatgattctgtgggccagatttcctatgtcctgttttatgtttctttcctgtggaagtacgggactcagagacagtcatggaaattccttggctttttaaattcccctgttcatgtgggctagcattgtataatgtatcagaagttgcaggcctagttataattaacagttctgtgaaagattatgaactcttttcatgttaatatttcattaaaaatttttggttatggattggacatatcaacaaccaaaaatgtacaataataatattcaaaaggagcaagaaatccttttgaattcttacttattcagccttcacaatgatgctaatttttgtttttcaggtatgataatcatagagaggccctacttaaaggtgggtttgatggcgaatatcaagatgacagcttagatttgctacgctatttcaccgttacctgttattctggttatggagatgatgaaaaggtaagataaatgaactcacccttgatttctcatcaagtacttcattaagactcacatacaaagagaattcttaaaactattctgtaatagaaagtgaagcagtgttcattttgaaaactgaagatgcattgccttcatgtttaagctgtcagtgtataaaaacctctagttgaaatctaaatgtattgcagggactgaactttgtcccaaaattcttcaacattaaaatttttcattttgtattttaaaatctttttctgtgatcaggctgcaaaagtattaagaatttgtttttgttactgttttttagggattttacacggtgtatcgtaatgtttttgaaatgattgccaaggaagaactagaatctgtgttagaggaagaggttgatgatttcccaacttttggagactcccagagtgactatgatacggtaaaataaaaatgcattgttctataattagtatttatcactgtgtcatttttaaattttattttactt

SEQ ID NO: 114762 - DNA, 1028 bp, Homo sapiens
caggcgtgagccaccatgcctacttttcccttttaatttactaattgtttactgattatttactaatcaccatggtcccatctagtgattagtaaggctatttttattttctcattaagtttattttgaagagtgattttttctggaaagccttaaaagtactgtcttctccagagattattagaagtgttatatacatgaaaaaagaaaggtaaaagatgtttcgcatcagtaatatttactgcttttctaaaaaaaaatcttaaagcgcagaagttaatctgttttctttgtcactaggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaagtgcgtagcgtgcgtggggccctcttctcagtatcggtgggggtcagaggcagcaccagaggtaccttacatgttcatgttgggttcagtcatcagcctggctttatcctgctttttcttcttttttaaattgtggcattggatagtgttttttcatctactgtgtaaaaattattattatttttgggacagtgtcattctgtcacccaggctggagtgcaatggtgcgatctcggctcactgcaacctccgcctccaggttcaagtgattctcctgtctcagcctcccaagtagctgggattgcaggtgtaatatgccaccatgcccagctaatttttgtatttttagtagtgacgaggtttcaccctgttggccagtctggtctcgtactcttggcctcaagcgatctgcccgcctcagcc

SEQ ID NO: 114763 - DNA, 1034 bp, Homo sapiens
gtttcaccttgttagccaggatggtctcgatctcctgacctcgtgatccacccgcctcgacctcccaaagtgctgggattacaggcgtgagccaccgcgcccggccaagtgtgactattaaagaaaattcaactaagtgataggtcaagttttaatagtaactatttctagaaaagctgatattgcatgagaatctatgtgttgtgtataaattcttcctctcccttgtgactttatagaagggctcctcttggtgtgccaaaatgttgttttttttttgccgctatcattagagcacaggtatttgactaccttaaaaggcaaggattaggcatttttgagaatagctgtatatctgattttccccactgtctctataaaattgacccagttttaccttatctacaaatgtgatttttcagattcgtagcccaaataataaaatgataaacttttatttattcaaaatgactaggaagtgaagcgttttattaatgaatcagaagtaatacttttgaaagtactttgaaaattataaatcactctataaatgtgaggtggcctaatttccatcgagttttacaatttataaagtcctttcacgtacaagctctcactggatcgtcacacaatcccccttacatggaggttttgctcatggaatcgtctctgttttgccgttgtggaaactaggactctgagaagctatgagatgtgcctgagaatgtatgaccatttttagatccagagtttttgcttcaaatccagtattgttaactattcgattaattaaaatttcacatacatgatatattgaaagtctacaataccataatggaaaattaacaccatatattaaacattaacactagatagggtatattttgatcatttatgatttcaatgagacagtccttcaaaatcatactgacatcacttataaataaccaacatgtagaatatggaagataccttgagatatttattggtcctataataaatcccaaatgacagtttacatgtttgtttcttca

SEQ ID NO: 114764 - DNA, 1082 bp, Homo sapiens
tccttttaacattaaaatgtgtgtcttctaatttcccagtgatccctccaagtctgtgggatggcctggaatgtaaaaacacttagcaaatacttagtgattaaaagaaaacaatggcggaagctttaagaattgaaaaatcaaaataataagtagagaatttgtccaaacctccccctgccgacattcccccatccccagaaaggaagaaaatgtatgtagataaaaggacagagaaagacagggaaagctgtggtacggaaagaaagagtgtggccacgagcttccagtatgctcactgccaaggaatcctgacacgttctgtttctctgtataaaatcatgaacaaataaaaaaaaagaaaaaaataaatagaatcagaaacgttttgcttagtgggaaaaaagctaattttatcttggttgcagttatccagcaacattatctggacacgtgaactaattttagcgcagctgctcacgtcagattgctctttcagcatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagtacttctaaatattaaatgtcactagaaatacttatcacattcagagattgcattaaaaggttttttttgagatggagaatcactctgttgcccaggctggggtgcagtggcgcagtctcagctcactgcaacctccaacttgtgggttcaagtgattctcctccctcagcctcccaagtagctgggactacaggcacacaccaccacgcccagctaatttttgtgtttttagttgagacagagtttcaccatgttggctaggctggtcttgaactcctgatctcaggtaattcacctgcctcagcctcccagagtgctggggttacaggtgtgagccactgcgcccggccttaaaggctgttttatcccaaggaagttattctaactagaaaagattgtctccatattttctagttaatgga

SEQ ID NO: 114765 - DNA, 1041 bp, Homo sapiens
ttgccaggcgtctttcttttataatgcctgtttgttgttgccattgtttgtgactgtagaagaatagttgctcattgcttatcatttggaatatggaaaagtatcatccttaattttacctgtagagattacttaataaagaattaaattgtgattacactatgtataattttctttcttctacttttgctaatatgttgtaagtattttttcacataattgagtatctttggaaacatgatacttaagcacttcagaatttttcttcatatattcagccattcactttttgaacatttggattcttttcagatttcccttaatttactatcactgtaatgagcatccatgttcttaacttacctgcttctcctttttatttcccgaaggtatataactatttggcaacataacataaaaagctagtagtagtattatatttattttgtaacggcacatatgttttattacctagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaaggtaagtcaaagttgcatattatttgtaaattactgaatattgatagtaaggatgtagcttttcatatatcaaataaaatcttctttcccatgactgaccaggtaatttagatgtatctgtacatatttatgtatagatacacacacacatatgtatacagatgaagagcgttgagaagaggatgctagaggaatgtgcccacacacatctcagcagcatggccaaaatcagaaagatgtcactttgatccagttcttgtttaccttatcctgctgtggcgctgattttgtcgtggatcattaacacttgacactcacatgagaacaagactcctgctgcgtccctggagtgtcactaagcaaatctccatgctcacgacagcagcctgtgttg

SEQ ID NO: 114766 - DNA, 1883 bp, Homo sapiens
gtaaagattatttaaattgcctttaaaattaatgaattaacttttaaagtgcagttcacttttttgagtgttctagagagcactcaaataatgatggttaaaaggagtatgttatttttggattatgctgaattatttattttccagtgttcctaaacccaaaggaaagaaaaccaaagatatgaaaaaacctgtcagagtacctgctgaaccacaaacaatggtaggtcaaaatcatattcatatctctttagcatatcttgctgtttaagcagtataatgatctaaagatggaaatgtgtatttggtgagccattccgcaaagagcctgcaaagatgtggatccatcaacagttttgtttgatataatgtatctttttttttcattaaaataaaaagaagcacattggaaatgctagactgtaccagaacagttactgttgttttctattacttttcaatctaaagccttggtgataagaattacatgtgtcaagttctggagattaattgtgaagcataaactcttcctcttttttagtccatgaggtacatgctattgaaagtctcaggacccttaaagttaatcgtgttgattagtgggatttaacctccaagaacatctgcctttgttgaacgtgtttattacctgtccactctgttaaaacatctttattttacaattgtttgatgcttaatcttgatattaaaacctaaaacactactttcaagtgataacgcttacttttatttatgattttttgcccttctcagagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaagaagagatgtggtgttcttcattgagtttttttcttcactattttcagaagtttttgttcttttttttttttccatcactcagtggagaaaagctttgttaatgaaagattttgtgatagagctgatgcttatacatctattctataacagtgatgaatattaacacaaaggaaata

SEQ ID NO: 114767 - DNA, 1035 bp, Homo sapiens
atgtgtcatgttggtgtgatgcacccattaactcatcatttacattagttatatctcctactgctttccctcccccctccccccaccccacgacaggccccagtgtgtgatgttccccttcctatgtcccagtgttctcattgttcaattcccacctatgagtgagaacatgcagtgtttggttttttgtccttgcgatagtttgctgagaatgatggtttccagcttcatccatgtccctacaaaggacatgaactcatccttttttatggctgcatagtattccgtggtgtatatgtgccacattttcttaatccagtctatcattgatggacatttgggttggttccaagtctttgctattgtgaatagagctgcaataaacatacctgtgcatgtgtctttatagcagcatgatttataatcctttgggtatatacccggtaatgggatggctgggtggcaatttttaatttttgaacataagcccccacatcttcattttgctttgaactttgtaaatttcatagctagtcttgcttgtaggcgaaaccactcagtttctctataaggaggtgtaacaaattctgccctcatagttcaaaataccttagctagcacacaataaaatttggggcaataaatttgagttttgttttttttccagtttgttggctttttttaaaatttcaataggtttttggggaacaggtagtgtttggttacataaataagttctttagtggtgatttctgagattttggtgtacccatcgcctcagcagtgtacaatttacccggtgagtagtcttctatccctcacccccctcccaccctttcccccaatcaccccaaagtccattatatctttttttttttttttttttgagacggagtctcactctgtcacccaggctgaagtgcagtggcacgaccttggctcattgcagcctccgactcctggattcaagtgtttcttgagcctcggcctcctgagtagctgggattataggcgcacaccaccacacccagctaa

SEQ ID NO: 114768 - DNA, 1037 bp, Homo sapiens
tgacgaaagtctcatgtgttcttgagtgaacaaatttccttttcttcctttttggctcaagcacaataatgctgtcactgagacagtgactgagcactcaatgtccaagactaaatcacatcaccacgactaagtaggcactatgtcctgggatgagtcttttaaactctggccatcaggttccttacttgttaaataagtaggttggcctaaaaggtttctaagacctctcatgatctaggtaaaatccagggtttcaggtcagtgtccctggtgcagtgcaagaaagccttgctgacacacccttggcctgaagcagtgagcacatgagattgtgtgacaacgcttcagagaaaaacagagatctgttcctccaactcagattgatttaacatccttgcttctccttttccttcctggctttacatatttgtagggtttttactccttctccagagcctactattttcctaagagttagtagcaaccataggatccacaagaaatgaaattattcatcaacaatgactttggcactgcaaaagactgagtcaaaggttaaatcagtcacacagatatccaaggccaagttgaagatcacaagtatatcccatttagagatttgcatacttagagattaagcccatgttcattaattatttagttaattcaaaagccattaataaatccatgcccagcctacgcaacatagtaagacccagtctctacaaaaattttaaaaattagccagccatggtgacacgtacctgtagtcctagacacttgggaaggtgaagccagaggattgcttgagcccaggaggtcgaggctgcagtgaaccgtgattgtgtcactgcactccagcctgggtgagagagcaagaccttgtctcaataaataaacccaagttacttcgatgactagatactggaggtctgaaggagaagctttaaaaatacagattgattgcttcagagaaatcctatttataattatgatctgaacttattctatgattagcaaatatatcatctgaa

SEQ ID NO: 114769 - DNA, 1023 bp, Homo sapiens
ttagaatctaaaatttttttaaacagaaaatttggtgtcactgcaccctatggagaaaaatgagtggctcctaagaaacgtgccccagacatctgtgtcagaggctctggatccaacagaccccttattatcaaatgccttggggctggctgtcttatgctcagatggcccttgtcacatggtagcctctgattgtaaagacttccaggctcttgattgatcatgccaacagcagcaatgttgagaaagtggtgtgtgtgtgtgtgtgtgtgtgtgtgtgagagagagagagagaggttgtcaatggcatgagggtgctagtggccaaccacagcttcctgccagtcacctcctcctctgtccattgagtcagcatggaggatattcagcactggcttcctcaaggaataatcctgaagattctggattttgaagacttagaaaaagcattattttgtctgctactctggttagattatttgcctttgcttggaatgggcaagacaaaactggacattaaattatgaattgctgttcatatatatcgaagcccattttaaaaagtagctgtaggttgggcatggtggttcacacctataatcccagcactttgggagtacgaggcaggcagatcattgacgccaggagtttgagaccagcctggccaacatggcaaaaccccatctctactaaaaatacaaaaacttcgccaggtgtaatgacatgtgcctgtagtcccagctacttggggcagggggcgggtgaaatgggagaatcacctgagcctggggaggttgaagttgcagtgagctgtgattgcgccgttgcactccagcctgggagacacagtaagaccctgtcaaaaaaaaaaaagatccatacctctaacagttgtcccttcatgcctccgagactcaggctagtcagtccccagagtctgaaagttcttatacaaaacccagaattccagttcatctataactatgtcagaatttgttaagaaatttcattaaagtctccagg

SEQ ID NO: 114770 - DNA, 1109 bp, Homo sapiens
tgttttcaactattcaaaaatgtcaaaatcatttttagcttggtggtggactggatttggtccagagcagtagtttgcctgcctctgttatagagtaacacatctgagcccatgagagaattgatcctgtaccttgggtaatgctcttcctctctggctcctttctacacctcagtcacttttcccctgcaagagtgttgtcacattagactgtaaaattggatcacttttatatttcatctctaacatgccttatttaataaaagtcattctaggtatgactaaagttccagggctaacttagaaaaggactgaagagaagaattccttctgacaaatgcggacccagccacaaatgccagtgatattgtcccaagtattggtggcttgggttgcacttgataacagagggcaaaagaaagtataaattttgcttgttaacatagctttagtggaaaatacagaaaatgcccccaaactccatgctaagatcatgaactaaactgttacaatgaaaggaattacttgggtttctataaaaacagctgcctcaaggaatttgccacattccttgggtctgcctgagctctggtggcccactgcttggataggcctggtttgtttgctaacttaacatgcttgcttaacggccaaacattcccttgaaattcaaggactttctgtcccgctgacactgtttatttgtatcagtagagtggagggctctctggtgacactctagttttttctgggttataagcagatgcaggtctgtagtttttctgacttggatggggccaatgggtctaagccaagaggaaaatgcttttttctttttcgtgtttatttcctttttttttttttttttcctatcttgattggagtacccttagaaggaaaaggagagccataatcgttctctggaggccaaaagaaggccgaaggatgccaaaaattgtcacagtggtgacttttggctggagccagtgcagaatgaggggctatgagtgtgtcactagaactgtaatccagatctcttccatgaggtcaggaaccctgattcgtattgctttttccatgctgtagaacatgacaccccactcaatcac

SEQ ID NO: 114771 - DNA, 1017 bp, Homo sapiens
tttcttgcttctgttcctagcagattaaggtaatctctaaggttttaccatatagaagggtattaactgccatgtcggggatggaagatggactttttctaaaatcaacaaagtctttaaaactaccttagccactggtacctgaagccacaaagccttacacatggatttccacttcactacttgaggttccctgtactccatttataagacgggaatcttaagaagacaactgtaaaaactgaaataaagcagtatcatctgtgaccaactgcaggctccatgtctgaccagcaaaggaggtgctctctaaggaaggggtctcaggcagtgagcaaaggtcttggcaggggttctccttccctaaatgcaggagagcagaccaggtttcctgagctttgaggagagcttataggaagggcaagatatctgcataaaatggaagaatttgaaatggaagatatgtcaaatatttcctgagtttttttatgaaaagtgatagaaggagaaatggggactggaaactgggaagtcatctaaacaaggaggatgaagttgtcagagtcctgtgtctaggaaaagggagaaaggaggaggcagggctggcaggtgaaaatttgtatctgagctggggtttcaagtcacaaggggcaagtcaagaagcctcagtggtgcgtgaagatttctaaacagaggcagagaatagaaagaagcaagttgcaggatcagtggcaggtggagctgaagagagaacagaggggtggcgtgtgctggggtggggagaaccttcaaaggaccagggatgccctcccctcacccaaggctacacctagcctcatgtcttcttcaccttcctggccccacgcagccacctggccaccacacccagcagcttcccacaaagccacatagtgcccagagtgagccccagcagaaacacaaagacatcaatgaggtactgctcatgccaaggctgctggaaggcatagggcttgaggtgcgtcgctcccccagtct

SEQ ID NO: 114772 - DNA, 3041 bp, Homo sapiens
taaatcaaaagattcaagggttttccctttataaagaatagatcagaaaatttgacaatccagacattcaaaaaaacattctgccagttgatttttttggactactatttgattagatgatcagttctgaaatttaagctgcatgtatgcccaaattaaattagcataggaaagtcaatgtgtgtggttttttaaaagtatattttagcatattaatggagcaatttaatttacattcagttacaaacctcattcttattaataggtttagggaatgttcttgctggtgtgctgattaccatattagagaaaaaataaactctccatattataattcacctgtttagtaaggtgagtttcttacttgtgatttgagtggattatgcctaaaaattacaagtatatttgcactaagcgacaaaatatgtccctgaaaaatcttagcgtacttgaatcatcaaatgtaatggattgtattgaattctaaatgttaagaagtaagtggatttagggttttgtctttcttttcttatgtcctctctcattcctttatacctttcttcctttctgaggcctatgtttatagcatgacttttaatgtgctgaaagattttccttctgttttgtgtacagagttgtttttgatgagtggtacgctcagaaggaactagttctgactacaaatcccactacttgaaatagcaatattgtacctaaagtagtcaaacagattttgctagacaactaagcaacatctgaatacaaatgtaaagtatgctggctcagtgtatcttttaggtcactaaagaggacacatcagtaaataaattgttttcagtgtaatatttttacataaaaatagatttcccccccaaaatttaagatttatttagattcttgagacatctttttatgaaaaggaattaataacatacatcatcaaaacttttcttaggagcgttgaaacaatataagaaggttacagaaggccttctaaaatatgaattcccatctgtatgaggtacttctttccaactcagtgactttttgcccagagacttggaagactgggcaatgttttctttcccctttcccaactcctggagacaaggccctaggagcaatttcctccagtagggcaggccgtagtcctgctctgtcttacttcccactgcagcaggaacatgtcctcgcctctgattccttctgtaccaagccattggtccattgaggtcaattgaggactcactgtaaattttaaatctgttaataaagcaaggatattggcatgttcctcttctcatcaatatcctaaaagacatttattttttacacactccttgggaaaaattaactttttttcactgaaaatatttccttttttggttatcttgatctcagattattttgtgaaagaattttactgtacttagttcaaaagagtagaaagaatgatttactattgcagacatatgtagggtaaaatcataatttatttaaactgactgtacaacaccatttagagttgatattgacataaatgttattagcctactaatttggaactgcatttctcaacaatgctggcaagcatcttccgtacttagcataccaagttgtaggggagagactgtgtatatattttttaaaagcaatccaatggatttgtttttgttcatattttgaaaacaactcgaaggatttttcttattttagaaggtagaaaatatgtggacctgtgttttaaattaatatgtatttataaattataacattgaatgatacaacagagctctaatattgatgttctcactttctgatatttaatttttataaatgtttttgtaagtaactaattgtagtattgcttttaaatagttttaaaatctatctcaaataagttctgcccagacctatttccttaggacagtattctaaagttcagtagtccagtgtgagcttgaaatactcctagatcccgtcagtgatttttatatataccaatacacaagcaaattattaatataccaaaaacctaatttctgcattgcattaataaaatacttgttattttgcctttatccaattcagttgattaggtgaaatagaaaattaatcttttcaaatgtgcatatgatcataatttttcaaaatgttactgtggtcatttttggtgcatgatgccaagtttatctttagttagccattgccacctgatatgtaatgacaaatgttttactatctgatcattgggttgtagattaaactattttttttctctgtagattctcactacattttcaaatatgtacttggaaaaagctgcaaagtgctacctataagcaaattagtaactttggccttatctatgcatagtgttcgctcagtttggttttgataaattgattgacttgcagttcctttgtagtattttaacttattgtgatgtaatgaattttttgaaatgtttatttgattagctgttaaaatataggaaagaatgtagctttgcatgaaataaattacatttctacaagttaataagaattttgctgattgtttatatattttacttcatttgagattaaggttcttttaagtagattcaggcgttctttgttccttatcaatttattagcaaatatgacaaatgttttaaaataaatatgtgtactttagttttcacattactttttcttatgtttgaaagtaattatatatgtattgaaacatactgtaccccataaatatggacacttatgtatcaatttaaaacttattttaaaaatttttaaaaagagaagtaaccccctcactacaaaatgtttaaagaaaattagatcagaaaccagtgaaattgaaaatgggagaacagtggagaaaatcaacaacaccaaaagctgggacttcaaaaaaaaaaaaaggtcaataaatttgatgaaattttaaccaggctaaccaagaagacagagtaggctgctttcctgtataccaaaaatgaacaattggaaattgaaatttaaaacacaacattatttaca

SEQ ID NO: 114773 - DNA, 4065 bp, Homo sapiens
taattaaatatcggctagtgccgatgttggctagtgctacccatactcttgccttatggtaaaaagacacacctttttttaagagtttgagctgattacacattaaagtcctagccaagaaatgaggtttactgtaaaaccaactcaaactacttttgttaataaacagtttcaccattgtgataccatagttaaatgttaattctgagttacactaatgaaatgtttgcactgtgtctgcttctgagcttagagagcttcttagctaactacaagcctagagaacttttccttgctatattctattatactgcttataattttaatctgattttaaggaaccatgtagttatcttttcttatgttctttgtcttcagattccttggaattttgatttttctttctgtacctccatagactgtgacccataagttaaaagacagtagggaagtagacatttttcccccttcctttgcagctgcattcaaatataccagggctaataacaggactgaaagggaccggatagaacttctccaagatgcagaacctttggattttaatgcagaaacattcactgatgatcctcttgaatctgaatcaggaaggtaagttctggctgtgacattttagctctagcattcctctacacttttaataacacattgacttgacaagattgaaaataagtaagtaaaggtgaaagtaaacaagtgataagtaaaggaaaatgttcattttcactaacaataaaaaatatattaagtaacttttgatacctttttagactttctaatgcttttatatcatccagtaatggtaactaaaattgttatcttcatacaatactagtggtattataaataagaaagaataattgaaatatatagcaaaggatcacaacaatatttatatgcctatttctgattgtcccatttgtgaaatttattatatttagtaactgctgcatagcagtgtctagatgccagacactattctaagtcctttagcaaaaatattgtaattgtatggttgcaaattcagctggatttaaatccagagaggctcagtaaagtgcccagagtcacacaacttgtaaatggcaagtcaggcattcaaagtccagtattctggctacagagtctgtacttttagccattatgctataagcacataattaaataaaagcaaaatatcatgtgcacgaaaatgtttactatagtattgcctatatgcagtaaaaacctaggttatatttatttgcaacaattgagagtggttattgaattgattaatctcccagatgtgtcttacatcccctgcccccttctttttacatctctcactctgtcatgcatatattctagggtctaaaaccgttgctggttgatttataattaagtccttttggataatatacttggagggtaagtttctgctttcagctactgactagattttacagtacttacaaattatatggccactcccttttaatgtattcttgttttcctctcttcctttattatttttgatgcctcagatcatttctttatgttccctttttaggtatcagcctggtggacgatatctctcgatgtctcgcagtgacatatttaatgatgtttaaagtctgaaaaagtttgtgggaccactaaccaaggtcaacacatcagttcagtcttgatgaacatctgtgtaccctagaatttcctctatacacagtgaaaagtgtcaagataacaaaaaaggcactgagaattaattatatcttaggaataatagtttaatgtgcattgaatagagtatcacctttttcaacaagatttattacatatcatttcctaagcatctgccttagaaatacagttacagtggaaggactttaagaaagatcaacatatgttaagaacatgcagttcagtttgtttcagattaattttttttcaagagagttattttaaagattcaaggaagccataagtcatactaaataatattatatacagttttgttattgtgacttacatttttgttacttctaaaaagtatattcaacctgtatttcccaaagaaatgtaagtgaatggagacctcaaataataactgtattcataaaactcgtgtcttaaaacaaggcttacttactagacataactgaatgtaaaaagtgctttttcaaatctgtttgcaaactcgtgggggatttttgcatgtataagattaagattatacttcaagtgatgcgtgtctgtgtatttagcatgtgtactataatcaggtgatatagtattccttcagtctttgtagtaactggatttttttatgcttctggtattgctttataaaagattttcatttcagaaagctatgttcacatttatcatttaacatattgatttaaatgttgattatgatattcaaggataaatcctaggcattaatgaaaaatagtttttttttaagtagtcaaagagtccaacaaaatccttcagtatttaaaggtacctgcttatactttttgagaaaaaaactggttattcaaaggtaaaaagtgaatccatttactgttattactgatacttaaatcgtggtttatagaaaacaaaactatattagaatggaaatgtgtaataacttgttggttaaacattcttactaaatagactgtttttaacctttgtgtttaagataaatttatgtattatattttaaagcactagtgttttattgaaaagtgaacatgtttgattgcagcatgcttgcagagagttttcttatgtccctagaatatttgcaactcttactgaatccatgctacatttggtgaccatacttcagcttgcctaatacagtctcagtgtaacacctagtatcctgtttattactagtgattactttcaccctcaagtatcccacccagtttgaagatgaattatatggttcccctaacttgaagttaatctttccccaagacataaatttaaaatttttatttttatttttaataaatattatcatgtaagtttttttttaaaacacagctctatgcagatattgaaaggaatagagcatcatcctcattatctgaaaattttgatctttgagtttttatgatctttgcaattagatcccttttaaaataattatcagtggatagacttactctgaattgaaggtcatatagactacacttaagaacacacacatacagtcttttcatgtgaagtgtggccagaaagcaataagccaggagcagagataatttgatcctctttgtaatttaatgattgactaattgaatacctttggcaaatcatgtagctcttcagtgcctcaagtgcttcattctgcactttcatttgcagaatgaagatgatacttgctatttacctgctgatctaccttacaaagccattgtgaggaagttgaattggtgtttatgtactggagtttataactgtgctatttttcctagtgatacttgaaggtattggatggggaaatgatcatcccagaaatgggtccagtttcttattattacagaaaagtttacaagtacttaaagcaaaaacgcttttggactaattcatcaaaagtcctgtgaaagtagtgttgttttatttagtctttgggtttactttggaataatttcttaagtataatgtttctcatcaggttttgtcatgaaattaagatgctgttgttgaaacagaagcagaaaaggaaaagaaattagccaattacttttataactaacttttataatgccctaagataaattggtaggaacgtgtaaggtaatgttaccactttcctttagtattaaattttttatggttataataattgaagtgtatacgtgcatacacttcacaaccggtatagattcctttatgactttcaagttatatttaaaatatttggttgtttcagtgattcagaatattcaactttaagcagaatttgtcttacagaatgttatatacaatcatataaaaatgttattttgttggataaatttgagttcagaaggcaatgacttgaccctggaagactcagtt

SEQ ID NO: 114774 - DNA, 1039 bp, Homo sapiens
ggaggaatagaaacatggagaagactccctctgtggcatatccatatccatgcagggactactgaaatctgagagtggaaaaagaatactgagagaaaccatctgacacttgaggccctactaagtacaaggtcataggatttcattactagagaaatgtgaagtctttggggacttaaggaaactaaagcaacaaccaaatccaaactcagatcaactataggttgagtgattcaagccatcagcaatgatgatctaatagaagaggtgtgcccattctgggcataaaactatgatttctctccatcttttccttcttttacacataatgtctagcttttaacccaaaattatgagatatacaagaaagtaagataatatgagccattttcaaaacataaaatagtgaacataaccagacccagaggtggctcaaatgttgaaattatcagacagtgcagtgactttgaaataaccaattgatatgttaaatgatctgatggaaaggttggacaatgtgcatgaacagataggggggaatttcaccagagagatggaaactatacaaaagagctaaatagaaatgttaaaaatattttaattacagactatgtatgatattgtagatttctcatgacagctctgatagaaggatgcacaccagatgcagaaggaattcagcttggggattgaaaaagagggcttatcttaggaaagagtttttataatgaagaaatatttctgtaataaggacatgtttagctgagtatttaagaaggaatagtacctagccaggtgaagggtattttaattagaagggagactaagtgcaggacgttgtggcatgagagaacctttgggaaaatgcatgtttttctctaactaaagcctaagcatggggaggctaataagagaggaggccacagagtagttggggaacagatattgtcattctccaatgtttggatttggggccaggcgcggtggcttatgcctgtgaagctgaggtgggtggatcacctaaggttaggagttcgag

SEQ ID NO: 114775 - DNA, 2064 bp, Homo sapiens
tcatttccttccttgtgttccatattttcagtattcttgtcttgtacaacaatcaaatttaaagtaaatagcaaataagatataaggtagtagtcttcagataagatatagtaatcaatttgtagtgtataaaagctatttaaatagttaactagatcagaggaaaaaaattgctcttacattattacagttatcattttagcatcttggtataattgttttctgaaggtatgctgataacttgacttaactgacatctataagaaacctgaatatagtgcataccctaatcagtgaagtacagggcatacacttcttagaaagggagataagtggtacttcctgaagcatgtcagatgtgacagtagataactatatgataacagataatgaagcatagtcttcttttggagtgacaatgctaaagaacaattcatctaaatatttacaatgtgaaataatgtttgtctttttaaaaaatctgcttttattagtttgggaacccgttgtttgaatctgctcggtttccagcagtttatgggagatgatgatatgacatcagacttagttaatgaaggaaaagaattaatcagaaaaggtaagatttgtcttttaaaataaatgaagggaaaatactaagtgctaagactcaaaatacaaaattaatatttgtgtagtttgtgaatattttttaatctattctaagaaattatgaattaatgcacatttttagctaaaaatgtacaatggcctttctagcaaaaataatttgaaaacatgaataattgttttatcggtctttaagaaattctgaagcttaaattattagtatgtctgcagcgagataacacccttgtatggtcttggaatcattttcatgtttaccttgaaacatatttgcgaagctctgtacaactataaaactcattaatttaaagaatcatcggtttgatactgcatgggaaatcattcaaacaaaggctacttttttagaacgtgatcattaacagcctgttagaatacatggtactctagtagaatcaaatcacaaaactgagtgtattaaatttactgatgttcaaagtgatgatagcatggagggaaaaaaacttgacttttgggacattggttcttagacattctccctacttgagtctggggcttttgtgtaattatgagttgaatgtaagacaaaatgtattgcagctccaaaataagccagtgtagccttcacgtgctctcctattagacctcatatggcatagcacatccagtcctgggtaagatttttaagaataagactgataaattagaaggtatttagagaaggacagctagaattgtgagtctgtagggcatatcctgggggaaaaaaagtgaaaacatcttgtctgtaacctaaagagagtaacaaggaaagcgactcatacagaaagaaaagaagtatgaacttaacttagaagacaggaataaaagaatagaatttacagagaaacaaatttcaggtcattgtgagaaagaaatctttcttccctaaagttatttaagcggagactacagggccatctgcaacaaaaatagagaaggcattcactactgagtaaggtaacctctcaaattccttccagcaataacctataacatttgattttgtgataatttaaaagaaatactggtcattgcccgctatctttacttcagttgcactatgtctgattaaaccatgttatgccatatttgagatcatttttctgtctttagagaagagaaaaaggcaaaggcaagaagaaggtgaaaatcgaagaagagtaagtacagtattaatttctgtaatctgaagattaatttgaaatttaatttcttaagaatcttactaatttggaataattagctaaagacagaaaaaaacagtggaaaaatgttataagatatatttttaaagaaagggaattttaatactttcaggtatatacgctaagtatcctgacagacctgttctaaaagtcattagtaataaatttctttgtgtttagcatcgagcagcttcttgctaaagtaggtgct

SEQ ID NO: 114776 - DNA, 1624 bp, Homo sapiens
tttttatttggacagaattgaacaactttatatctgtgcttgtcagaatgacatatgttgatacaacttcagttcttttatgtactgaatacaattcaccttgaggatgttactgtccttgtcatgctgtgagatggattttacggatggcttagttgtaggagatgatacaaaggcactccacaacttgtggggataaagcaatggcagaaaccataaaagcaaggagcttgaggctgtagtcacgtaggcattgatgtggcaattttcagaatatctcccaagtaagtgagggcaggtcacattaagaattcaatatatatataaagcaaatagatgaaaattttagctataattatctgaaatgtttttaatacatctcagtatactataaaatgtattttgctgctttactttttatatacatatttttaaatgtttgttgcaggctattttgccgtttgacacctcctttatgtcttaatttcttgggtttgacccatatggattcatctatctctcacaagaatactcaaccaactgcttatacatctgtaagtacggtcagaaaatagaattccttaggttcactatctatatgaggtgctgttattgtgaaatttcttttaatgccagcagaaaagttctatagtgttattggtaaaattttctcttaaagattgtatacgtattactattgactagataaaagtgattttccttcttttatgataaaaatgttttttttggttcatatatgttgtctagctgaccagtatcaaaagaactgacctatactaatattaactttatatttgtagtcaatgtatgtgataattttgagtaataattatattaattttctttaagagaaaacctcaataaaaagcagattttaaaaaataagtccatttactgctttttttctactttttaaaaagttcaaatggattgatataactggttataggcaaattttctaatgatggaaaggaatggaaattatagagctattccaatttaacttacttttttcttgctcttcagattatgggttccatgaaagttttatcctttattgcagatggattctatatatattatcctatgttggtggtaattctctgcattgctacttattttaggtaagaaacttaacattgttttttcttttgctcttaaatctggatatcctttctctttaaagctcttttaaatatttactgattgagtttcagtttgtttcattgtagctttggagaagctggggatagtttgaagggactacttgagtgatcaggtgcgagtctccctctaaaaaatttaaagaaaaaagaggtagagttattattctattataataaataatactattttaacattattctatttaggctaaaaaatgataggattaattacagaatgttaactctaagtcctggcctttgacactgacagctatcgtagcctgcaaaacacccttatgtccagcttttttctaatgacataaattagccttagagctttccaataattattgctgggtgtctaaatgcttcagaccatggccagcacaaagggtcaggtgaggaccgattgtaatcaagctgtacattaagattag

SEQ ID NO: 114777 - DNA, 1003 bp, Homo sapiens
tagtagtatggaagatgactttaaatgcatgtatttatttctctgtgctatgcctttcaaaaattcagcatcttggatttgtcatgattttgcttcattctttagctagaaaaataatttatcctacttagaataatcttctcaaatactagttgcttcctgcaggtaagctcccctgcctatagccatctatacctatctggtatatatgaacacaaagattaatattataaaggtgagaagaaactcagtacatcttttaagacattttcaagaaaatatcagcaaatgaagtctaactagagatgacaataaagtaggaagatgtttttgagaaaattagaactgctcaagaatgaaagatttttaataaaaataaatttttatctttttacaattaagatttttaaaaatctacttttttttttttttagtgccctacagagtatcaggaaaaaatgggtaggaacatggatgattatgaagattttgatgaaaagcatagtatctatccaagtgaaaaaagtctggtaaaactgcataaacaggtaactttgttaattataagtattttacttaatgatgattttaattagacttctaatcattgctcataaaaaaaggaatttttagtgaatgtgtatttaaaacttcctttaatcccgtccttatcattctttgaaatattttatctctgtgtataccagcaggggtattattggcgtttggggagggagaattcttcactgagcataactgttacattatataaaactgttacatcattttggaacattaatattctcagcctgacccagtaaatgccctagcactttcccattgttatgacaatccaaacatgctccctagtggagagttgaaccactgttggatcagaacactgccaggtctacccccattctcttttttaggtgatttattcagttcagagacaccgtcgaactcaagtacaatggcagattcttttggaacaagcatttta

SEQ ID NO: 114778 - DNA, 1613 bp, Homo sapiens
gattagtttttgcctgtttatgaactttataagcatagaattatacattgtgaacttttttgcatctctctttgctcacatatttgggaaattcatctatgctgtgctgtatgtatcagtattctgttcttttccatttctgtaacataccccattatatgtatatgccatagtttatcctacccagccaaacttcttaaataaattctctatatttgatatctccacttgctcattgtttacttatttcttaaccatagtactctgctttctattctcctccacttatacatacaggttcttaatttacttcacctcttggcggcatttgattctctctctccactttaactttcctctcctagttcctaatccatatgctccttggttttcttccttgccccactattgttctgtctcagtctcttttgctggtctaccctccttctgttctctacctctcttaaaagttgatatttctcagagttctgtctcagttctttccttcacattctccatactcattcttacagttgagtatctactgatgttatttcactgccattgatacagtgatgacttcggaagctatccatatttttagtccgctctcctgaaccctgaagctgggtttgtgtgcagctcctcttggatgtctcctaggtactacttcaaagtcagtatgctgtcaactgaccttctccctttttgcttcttaccaccatcatcacccttccccctcccaactagttccaattttgttccccttttatccattctccgtgtgaagccttaggaaactaaaatttgatcaaaaatgttttctttgaatgtagtccagactcttcataaaggctttaaagacccatttgctttccctaaaattttatattacaaaaatactcagtcatctattatagttattaagtattcatgattacttataaacatttattaatgagaagacctattcattaaaattgagattcatatatttctggcactttgagattatacagacatatcaattatttgggtttttaatcatattttttctatccatctaggattctcttaccttttatgcagtcatatgcaagatcaggagggttttccatcactggaaagatcaaaactgcactaattgagaatgcaatctactatggcacctatttgctgatttttggagcatttttaatttatgtagctgtaaacccacatttacatttagaatggtaagaaaagtagtcttcttaacattgctttaatgtatgtttgcatttttaaaaaatcatttttaatttcatatgtgcaggtaaaaagacatttcattgagaaatatattgttacatattttatggatttccccaaaagaatatgtgaataatccatattactaagaaaatatggaatgacatctttaaatatagattttaggcaaaagattaatgattagtctaatggctatatattaaaagtaataacccttatgatttttggatagaatttcaaaatttttatgataaaataactggttttatttttcattggaacttgtgattttttttgttttgattataatttgaaggcatatttgttcttaatgttacctt

SEQ ID NO: 114779 - DNA, 2634 bp, Homo sapiens
tacttttaaatggtctctttccgttttttccttcctctcttttagaaaatcttaaattatagaggatgaataatcttagtaaaatgtattttactaagtatctaatttcctaggatttagttaacagcttatttgcataaactattctgttaggacttataatattaagaaacaaactccagatgacactgtattaaaactgttcacatctaaaataagaacttcttaatttgtaatattgtaagaactaataatttttgttaagtttttgaaaatacaaggtacgtgaaattttttaagtgtgctttaaaaataaaatataagtacttgaggataggaattacccttttaatcttattcatagtccaatgtgaagcatgacatttctccaaagagttgattaatgtattaatgtactaataaatattcagatgaaatttccaaatgtcatttcctgtgttaatgatgcattttaaccttctttttactttatagatatggtccagacctgtacatgaataactttggttagtcagagtgaaatattcaataatgagtggtgcagctttgggacttgagattgtttttgtcttttttctggcattatttctgcttcatcgatatggagactttaagaaacagcatagacttgtgattattggaacactgcttgcttggtatctctgctttcttattgtcttcatactgcctctggatgttagtacggtaaggagtgaaatttattttcacaatttaaaagacaaattttaatcatacagcatgttggaaataatgttatttcttaagacagctaagttatgtcagttttgaattaaaagattatatggccatttgatcattaaaaagcatagccaagggccgggcgtggtggctcacgcctgtaattttagcactttgggaggcccagactggcggatcacaaggtcaggagatcgagactatcctggctaacacggtgaaacaccgtctctactaaaaatacaaaaaaaatagccggacgtggtggcggacgcctgtagtcccagctactcgggaggctgaggcaggagaatggcgtgaatccgggaggcggagcttgcagtaagccgagatcgcgccactgcactccagcctgggcgacagagtgagactctgtctcacacaaaaagaaaaaaaaaaaaaaaagaataaagcatagccaagaaggtaagtttagatagatagatttataaactctgatgtcctttaagtacttggtaaccttttgattctcatttttaaaccatacattcgttgctttagacaatatacaaccggtgcaagcatgctgctgcaaattcaagccctcctgagaatagcaacattacaggattgtacgcaactgctaaccctgttccaaggtatttccttttttaaaaaaaatatataaacattgtaggggacacattgtttaaaaattgaaagtttttaccatccagactttatatttatgtaagttatcctcattctctactaattctccccacctctattctttcctagtagacttttcattacatcatattctaattaaatctaatttttaatatttattggtccacaaagcccttcagtagacggtagtgagaaacttgaagaagtcctgattttttagtcctggttcttctttaccaagtatgtaatttctaaaacctgtttttcctctcagcctatctcagatttaaaaacgtgggatgtattttcacttttgcctaatttacaaggttataataaagacaagtatttctgaacttatggtattcctttcatattgcacatccttcaaaagcattatagatttacataaaaaattaataaagttcaaattgtccaaagattatattgaattcatatcgaacttttaagtaaaaagcttatatatgttgactatagcctttatgaatgctttcagtagtatttgcatgcttctttatgcatatttttaaaaaatctaacttcagaaaaggtaaatttaaaatgcaggtgttacttccatttgaagcactattaaaaaaactggataaagatcagcagcagctacagattgttgcaagttcttgggatatccttctagcttaggaatatggctccatggcagaatttatgatcagagactcatcatgtcttcaaaaatttaaacagaattatgtataattgctagcatgcatctccatagaagctatgttatagtgagtgatttaattagcattacaattttcaggaattaattacctaatgttttcccctcccaacccctataacctgaaaaaaaaaaaacccaacctataaatggattgtgtattttaaaggtaatcattagaaattttatttcataatacatttgcttttaatgattgttgcacttttagtctattagttgaacattaagttttctttttacccaatgactaaaaatacactgaaagttgaaaacttaaatgacattttcagaacaatctattttgttgcttttgtgtgtttttttagtttggcagtcagctttgaattttaaaatttctttgaaattttatgggttattgattattagagtcagtaatttaaaatctgaatgtaaattaacttggccacatgcaa

SEQ ID NO: 114780 - DNA, 1038 bp, Homo sapiens
gcgatattcgcggcctaaaagaattattaagagggtccatttcatgctcttcccctttttgcaatccgtttacctgtgcatagcgtccgcaggcccgggagtttaaaatacgtgcattaactgcagagctgctcgcctcccagattcccgctttggcgcgcggcggctccgagcgtgctgctcgggcccccagcagccagacccgctaagcctagcaacgttccatccccactgcgcgcgcaaggctctacagcccgctctgcttcgcggccgcactgaggcccaaggcctgctgggaattgtagtttccgtcccgcttcgtagtccgacgggctcgcccttacttccttcccttgcagctttacccgccttcgagatacccacaaccccccgcgggagcgggactggtcggcccacggggtaggcggggaggcggaagcgggcggcgctacggctgactgggaaatgtcagccgctggactgtagacggattttcctttctcgggagcccgcaggccttctggtgatcgccagcgctgtcgtctctgagcgtggatcccagaacctggacagctgtggcggccgccgtttcccggtcccgtccagacgctgtctggcgagatcggacggtgagcctaaggcggaacgcgtgaggcgcttttgagtctggggtccggggccgagagcaggcggaaagagaggggacccggcagaccccgagtggccgccgctgcggggcccaagtccttggctgctgagtggtgacagtagcccagcccgccggccaggtgagaggctgcgaactgctggcgtcgcacctgttcgtccttttgccaggaagcttcttcctccgtcggggagaaggcggccctaagaattgggtctgtggacgggatccttcctttatctgtaaaataacgcacaacagctaaacacgccgttggaacgagagacaatggtttaattttaggggagccggagaccccagcgggtcctgtgtggtgggaaggctgcgcatgcccttgcagccttgacagg

SEQ ID NO: 114781 - DNA, 1060 bp, Homo sapiens
gcagctctgcagttaatgcacgtattttaaactcccgggcctgcggacgctatgcacaggtaaacggattgcaaaaaggggaagagcatgaaatggaccctcttaataattcttttaggccgcgaatatcgctactggctaatattgttagtaatgctgttaagtgaatggttgcttagccccttcttggggaaagtgtgaatggatggatgccttagtgcggggatcagcgtgtggttttatttggcttccctaattgggcttttctgccaccgttttcaatcagtgtatgattgccctgtctctctccttgtctgttccctccactgggagaaattcttgaggccttctgcaggatcgtaagtcaaaaagccttctcgatttgttcttttcatttcttcgttttcttggtaactcgccgcaggcacataaaaaatgcgattctgttagctgctgtgaaggtttcctacaatgcataaactgcagcttctttaattgccttgaaattatttatgggtgtgttttcgaaaggaaccgggggtattgtgcacttctgcaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtaaggacatgagggtaaaaatgtcagttatgcaaagggtggatttagctatgttgttgggaaacctttgttcagagatctttagcatgggttccttttaagattgcctaattctgaagctatttttcaacaaaatagggcaagtcgtcaagtatgcaggaatcttggtagatatatatatatatatatatatatatatatgtatgttctggtgcataatcaccttgaa

SEQ ID NO: 114782 - DNA, 1018 bp, Homo sapiens
tattccagaattcttactcttaatcactaagttttactaacacagggcatttggggatgtattagagaagatggcaaatttgagagatgtataatcaaaagaacctggtgattttacaagtagatgtttgcaagctaattctaattatgggtgaaatggatatatgtttattccattgtctttttaattcaaaaagtacattgattgatattcttgtgtatttgcttcatagtaagtcttttattacattatatcatttaatcttcttaataactctgccaagaagtttgataataccatttcacaaatgagtaaactgaggcaaattatcctgtttgatgtctgagagatagtgatatacattttaaactcactgactcaaagacctgtgagcttaactacactcgcctgctttcatctaaatgttgttgatgaatagtgtcttactggtctttttcttctgacgtttttctctttttccagtactctcgcaaaaaactcaaatttagtgcgacttaacctttctgggtgttctggattctctgaatttgccctgcagactttgctaagcagctgttccaggtatgaaagatgtgagacttgattatagactcttatgtcaaacgtaaaattatccctcacatctgtataaaatgggatgaactttttgagctttttgtactttccaggctcttgatttggtgaatgcaaaatcttttgccctcctaactttctgtccaaactcaggagccaagtcaattgagtttgcaagtgatacttgtatagtgatctcttttttgtttatttggaactgttaaaataagggaagtgtagtagtgtctatcaacagtatggttgtaagaaatttgctcacacttaactgtacattcaggttttttcccctatggtatctgtagacctaacttacaattttttatcaaatttggtgttttataaatatagaccgtaaatttgggcaattctattaacaatatctttcataataatgtcagcacat

SEQ ID NO: 114783 - DNA, 1006 bp, Homo sapiens
tcctgcccagggaggacagagcttaagtgtgggccagaggaaactaaccctttatcccccaatgtttcgttctttctccagtggtgtcaaagtatgattgcatcagattttgctgatggctagttggctggctagatgattggtccctcaaaattttattgtgtacttttttcattttttggtcatttattaaatatttattgagcacctacagtgattgaacaaaacagagccttgaacaaaacagagaaagtcactcttatgaagattactttctagtgggggagccagaaagtgaacatatttcataaatgttatgaaaggaggtaaaaatgcaaggacgaagagcaaagcagagtaaccagatagaatgtggcagaaagaggactacttttagatggaatggttaaagacagggcctctctgaggagactgtactggacccagagaactgactgagtgaagaaggaatccatatgcatatgtgagagaagaacattcaagaacaaaggaccagtgagtgcaaataccttgatatggaaccaatgtgtgagagggagcagggagaacagtgagaggagaaagatggccaagggctgtctaagccaaggcaaaagctttgaatttttcctaagtgacatgggatatgggaagccattggagtatttcgagcagagcaatatgactgacttcattttaaaagactcacgctagtgctgtgttgagaaaaggctgtagcggggaagtatgaagcagggagaccagttagcagactaggctggtgacacttaaggtggtaagaaatgatcagatttgggcacattttaaaaaccaacatcatgagatttggtgacacaatgaacgtgggatgtgagaaaaatagtccactatgatttcaagggttttggctgaagccactggattcgtgaaattatcacttgctgagatgggaaagagtttagggaaggaggaaatttgggggagaaattgagtatttgattttaga

SEQ ID NO: 114784 - DNA, 2032 bp, Homo sapiens
attaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagttgtattccttttttctttctctttttttaagtgctgtggttaaaatttgaaagcatttagtgtggtatgccatttggcttagatacctctaaataagactcttcaaaacagagccctgagatggtcctttttgacccatctacttcatatgcttgtcacattaaaaaaaaaagtttataatgcctttataaaaggggctaatacagtcttgttatctttttttttaaattatactttaagttctagggtacatgtgcacaacgtgcaggtttgttacatatgtatacatgtgccatgttggtgtgctgcacccattaacttgtcatttacattaggtatatctcctaatgctat

SEQ ID NO: 114785 - DNA, 1050 bp, Homo sapiens
catgttctcactcataggtgggaattgaacaacgagaacacctggacacaggaaggggaacatcacacaccaggacgtgtcatggggtgggggcagaggggagggatagcattaggagatatacctaatgtaaatgacaagttaatgggtgcagcacaccaacatggcacatgtatacatatgtaacaaacctgcacgttgtgcacatgtaccctagaacttaaagtataatttaaaaaaaaagataacaagactgtattagccccttttataaaggcattataaacttttttttttaatgtgacaagcatatgaagtagatgggtcaaaaaggaccatctcagggctctgttttgaagagtcttatttagaggtatctaagccaaatggcataccacactaaatgctttcaaattttaaccacagcacttaaaaaaagagaaagaaaaaaggaatacaacttagtttaagcactcatttttataaaaatgtgttttattgttttaaaacaagtctataaaagtagaaatcacatacaaaaatacagattactctgacatgttggcaaaatagcttatggctggacttgagtttggaagttctgtatgtttgagggcatccgatgtcagagtccaaccggatcctaaccccagctcttgtcactaatctgtaaacaataatttcaagtagtatttagcactttttaactattaagaaattgaagcatcatcatttcctgtgcaacccaactttaaaatcttccttaggtctaagcagataaaggcacttcatagtatgtttctaacattaacaatttttgatttaaaaaaaaaaagttaatataaatgactggtgttagctttttttgttgttacattttgaacatacgaacaagtcatcaatttaaactagtttttgtgatttttaagaagtagaatttggctgggcgcagttgctcatgcctgtaatcccagcactttgggaggccaagacgggcggatcatgaggtcaggagattgagaccatcctggctaacatggtgaaaccccg

SEQ ID NO: 114786 - DNA, 2477 bp, Homo sapiens
agcaagctgggtaagagttgattcctgagttgggtgatcataagtgtgttcactgaactgtacattaataatttgggtgtatacctgtatacataattacatgtacccaactcttctgtatatgtgttatacttaagtaaaaattttaagtacaaattttacatgaaaatagttaacactcttattcaatacttaatatttgtaatgttagtaattcagcatttaatcatatgaaaacagcctgtgagttcagtcaggtctgcacttctttactgctaaatgcttgagcgaatggtgccatcctgaacgttttgagaccttcataatatacccatatatttacatagtgactaattttctcataccagagaacaacttgatttttaaaatggaggccaaatgatctgctaggttaaaattcaggattaaaataacctattaagaaaactattactatttaatgagatatttccttctgcctagggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggctttttttttttgatatacataagataccactttataaagaagctccatactatagaacctcccctaacaggcttaaaataccttctttttttttttttttttttttgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgt

SEQ ID NO: 114787 - DNA, 1015 bp, Homo sapiens
attggagaaaggatattgcctgtcattgtttgagactgcattttatatcaagctgtttgcttattatcatcgttatgagctctttgacatggtattttggaaagaacttggtagggccatatggcaactcaagttccttttttgagtgcatctatctaattcctctattgtttaattacaagttttgaagctagtgttttttatttttttctttttccccagttgtacctattcctactgtattgtgggtgatgtatgtttctgtgggcaaatcatggtacctaattcttatttataaggttttttgttactgtgttttaatggaatatgtgttacgagtttcaagaaacttgttcccaaatatacttttggaacagaatttaaatgggggatggcatctattttttgttttgcccttctcagaagtgaccatcttttattgagtgtgctaatttttttttctttgtagtaacaaatgaatataatgaatcactgctctacagtccggaagaaccaaaaatacttttcagtattcgagaaccaatagcaaatagagttttctcaagcagtcgtcagcgttgtttctcctcaaagtaagcatcctcaatctgacttctgactgttttcatccctttcattgttacaaagcccacttggtttgaaaactatttaatttcattaaatttgctcattcaaacttaatctagcaggaaaagtagaacctgtgaaagtaacaaggtatcatgctaacccggctaaaatcatattttcttttacactcattgtgccattttagagaagctaaaacttaagtgactagaaagggtacagttatttatttcagtgatttgttggtttttaaaaaatgaacgaagacacaataattgtaaaagaagctgaatagaaagccccttctttttcataagctgtagaataaaaacacaataaacactgatagaaaacttagattgcatagcaataaacctttagaatagtattcatttcttctaggttt

SEQ ID NO: 114788 - DNA, 1047 bp, Homo sapiens
tctacagcttatgaaaaagaaggggctttctattcagcttcttttacaattattgtgtcttcgttcattttttaaaaaccaacaaatcactgaaataaataactgtaccctttctagtcacttaagttttagcttctctaaaatggcacaatgagtgtaaaagaaaatatgattttagccgggttagcatgataccttgttactttcacaggttctacttttcctgctagattaagtttgaatgagcaaatttaatgaaattaaatagttttcaaaccaagtgggctttgtaacaatgaaagggatgaaaacagtcagaagtcagattgaggatgcttactttgaggagaaacaacgctgacgactgcttgagaaaactctatttgctattggttctcgaatactgaaaagtatttttggttcttccggactgtagagcagtgattcattatattcatttgttactacaaagaaaaaaaaattagcacactcaataaaagatggtcacttctgagaagggcaaaacaaaaaatagatgccatcccccatttaaattctgttccaaaagtatatttgggaacaagtttcttgaaactcgtaacacatattccattaaaacacagtaacaaaaaaccttataaataagaattaggtaccatgatttgcccacagaaacatacatcacccacaatacagtaggaataggtacaactggggaaaaagaaaaaaataaaaaacactagcttcaaaacttgtaattaaacaatagaggaattagatagatgcactcaaaaaaggaacttgagttgccatatggccctaccaagttctttccaaaataccatgtcaaagagctcataacgatgataataagcaaacagcttgatataaaatgcagtctcaaacaatgacaggcaatatcctttctccaatacacccccattactcaacatattttctagaaatctttgggacctgctttctctctaatcaagaggtacaggagggctggaatacaaagcacaaattggttgagaaaactacaaa

SEQ ID NO: 114789 - DNA, 1686 bp, Homo sapiens
aaataatttccctgaaacaaaaattctatgaactgactaatcttgataaatcttgcatgtgagaatgacactaaatttgctcattattttgggctgagcatctctcacctgactgtacttgtctttctctctgcctctgcttcttttctacccatgcccccttacctctaatctcttttgtttctacttgattctggcatagtagcagccacttctatggatttggctggcttgtctgtacataataggctcctaatgtgtgttttctaggaagacataacaaagctatgaaatagattaaatgtgaatattaggcctgctatcttttatttttaataagaaattctgactatagagaaaaaagtgaaaaggagttgtattatgcaaaacccttacaaattaagagcttacaggataaactgtaaaggttagaataagagataaattatccatagtgttagtgtttgcaagcatgtccagtaattattttgaaaagttgtattttattacggttttatcgtaacttttttatttgctggagaaaaaaattcagtgttgatcagtgacaccattattttaagatagagtttacaaaataggcttttagacattgcaaaagttctttgaatagttacaaatcatttatgtgttcatggagttaaagaatagtgccatttttgctggtgccagaaaacccatttgatttcatattaatgaaatattttaagaaatgtaaatcccaagaaatttatagttctggtttatttctagttttgtccactaatccagtattggttgagaattttctttacagctttattatctaatctctgttagcttactaccaattcaaaaggtacattagcatgtaacttaagaaacaagagtttagtagaaactattaataactttaagaattagaatcagctttaaaatatatcaaggactagctaccaagaatgaaactcacttaagaatagtattttctttttttggattcagaaatgaggctctgtatatgttagattccataagagcaaaagcacaatgctagctaaaaatttgcaagaagctcctatttgaaatattaaagtattgacagaaaggaatatataaatcagacaggcatgcagacatgtagtttttttttttttaatttcttctaactttttcacttaatcagtattggaattagcatcatgatgtgtgtgcctactaagtcaagtatttcttgggtaagctgacttacttaagatttccttagttctgaagaagactctcttatttaccttgaaccataagctcagcaaacagttttatattctcaattcacagggcttcctactatgagatttcagttgatgatggtccatgggaaaaacagaagagttcagggctcaatttgtgtactggaacaggatcaaaggcctggtgagtaacttgggatgttgcttatcaagttttgtgaaatacttttagtaatgtaatattttggcccatctaaggcctgtaatatgcaagaggtgtcctggtggtgttatgtaggtaggccaagtttctgtttcattcatcatttgggtctagtagtcctgccttgacttcttggattacagttacagcctggatttggtcattattgagcactaggtttgcaaaggaaaggaaatgagaagtggttttgggact

SEQ ID NO: 114790 - DNA, 1146 bp, Homo sapiens
ttagctagcattgtgcttttgctcttatggaatctaacatatacagagcctcatttctgaatccaaaaaaagaaaatactattcttaagtgagtttcattcttggtagctagtccttgatatattttaaagctgattctaattcttaaagttattaatagtttctactaaactcttgtttcttaagttacatgctaatgtaccttttgaattggtagtaagctaacagagattagataataaagctgtaaagaaaattctcaaccaatactggattagtggacaaaactagaaataaaccagaactataaatttcttgggatttacatttcttaaaatatttcattaatatgaaatcaaatgggttttctggcaccagcaaaaatggcactattctttaactccatgaacacataaatgatttgtaactattcaaagaacttttgcaatgtctaaaagcctattttgtaaactctatcttaaaataatggtgtcactgatcaacactgaatttttttctccagcaaataaaaaagttacgataaaaccgtaataaaatacaacttttcaaaataattactggacatgcttgcaaacactaacactatggataatttatctcttattctaacctttacagtttatcctgtaagctcttaatttgtaagggttttgcataatacaactccttttcacttttttctctatagtcagaatttcttattaaaaataaaagatagcaggcctaatattcacatttaatctatttcatagctttgttatgtcttcctagaaaacacacattaggagcctattatgtacagacaagccagccaaatccatagaagtggctgctactatgccagaatcaagtagaaacaaaagagattagaggtaagggggcatgggtagaaaagaagcagaggcagagagaaagacaagtacagtcaggtgagagatgctcagcccaaaataatgagcaaatttagtgtcattctcacatgcaagatttatcaagattagtcagttcatagaatttttgtttcagggaaattatttttttaaggcagcaataaaactcacagtccctttagagtgggtatacttcttcttaaattgtccactgctacagcccaagaataagaca

SEQ ID NO: 114791 - DNA, 1079 bp, Homo sapiens
gaaacatggttacagtttgatggtgagagctcaaatttactggtaatatttcatgagtacctattgttgagcatttgtaggaaatctgtggggatagtaatctaaaacaaatttcattagtaattaaggaaaagtaatttaaacaataaattttagccatttatgtttgtaaaactgtcaagaatgagaatgtgaatatatgtagtacctaagacagtttaaagccagttttattcttatgtgcaatcaaatttgattaaacatatcaaatccatatatatatatatgcatgcatatatagctttttgtatcaaggtctttctctgtattatgaagttgagctgataatttaggtaaacaacaagtgctccaagggtacttggtattgtaatatcaacttgttatatttgaaagaataattgggttgcctttaggcagttatagtccaaaagaaatgagaaaaatataatgttccatttaataaacataataaacagaagaatataataattaggctacaaagtcaaaggagaagaatagatcaatgttgtcttggtgacagtggtggttttattagtgtatttggtaactatagtgtattaggtaactattgttgtataacaaatcactcagtttagcatcttaaatgtaaatatttatgacctcacacagattataaaggtcaagattctaagagtagcttagctagttacttctggtttaggcaggaggtgacaatcaagctgttggccaggacagcagtatataaagacgactggaactggagaacacacttttttagctcatcacatggcttttggcagaaggcttcagttcctcaccatgttggtctctccaaagggttgttcatgttatctcttcctctagagcaggtgatctgagagaaagagagtggccaaggtggaagcaatagtgtcttttctaacctgatctcagaagtgatatgtcatcactgctgccatattctgttggtcacatagagcaaccctagtatgatgtgggaaagagagtgtgagtatatgtattcacaaaattgtgaataccagggaggcaggaat

SEQ ID NO: 114792 - DNA, 1054 bp, Homo sapiens
gattggagtatcattaaatgatgatgactgagccttctggacatctttaggtgccacatactctcatctacaccaaccaataggcaatcttaccaccttataatttgcaatggtttgttttaatttgtcttccacatcaagctatgaactccttaaaggagtttcattatttatgtatttttgaataaatgaaggattacattggattaagctttctcagttcttttttagtgacttaggatatcttaaatgacatttcagaaaggattatggttcaaaacatttcacataaatattttgattccttttgagattgctggtttatcctgattttggagatgaggaagctgatgctaaagtgacttgcccaaagttaatagttaaataatttaaaggttagaataaaaattggaaggttagtagttaaataatgatttgaacaacactgtaccattaaataactttacagggtaattagtagcagatttgctgctatttttagtttcattgtaacgtagaaactcacatattattatgtattatggcattaaagctggatgtagactactaattctatctggtcttttttgtttttatttaaagaacacaattttgtggcaaaaaatggaatatagggtagacatttttagaatttcatttcttatttttatagcttagtgataccttttgattaaatttttttgcttcaccttttttcttttcctctttatatcaccaaaaaattcctgttaaaatataggtctgagggtcatttatgcctgcccgttcgatatacacattcctttccagaagccttacagaagttctatcgtggtgagttcaggtaggaatttcttacggttgttcttatgtaagtatcttaataagtatgtgccattaataatgctgttaaaaaacagaacaaatcaggcagggcacggtatctcacgcctgtaatcccagtactttgggaggccgatgcgggtggatcacttgagctcaggagtttgagaccagcctgggcaacatggtgaaaccttgtttctacaaaaaa

SEQ ID NO: 114793 - DNA, 1073 bp, Homo sapiens
ctctgtggtggctgcttcagtagttcaacttttgcattcactttgcttcccttatccttctttcttcaataaacccaccttgttttcacagaggaattgaaagtcactggattagaactacttcaccttttctcttgcttaaaaaaatcttgtcctgtcttgtcttttttttctctcccttcacacttgactccttttagcctaaaaagacttgttcaagactcctgtttttcaagaaaattttaaaaatcctttaccctgtgtcactctcttggttattatctcttttccttccacttatccccaagcttggtatcgccactccttcagttctcagttattttctaaaactttgcagtttttttatggatttgcccccaaccagttcattgacgttgcttttgccttagagatcagtgatatcctacttaccgaatctactggatattttagtccttgtcttacctgatttctgggaagttttggtgctaactgctcccttatttcaactgtactttgttggcatttatgatacctttttcttcctatctctgtgactacttctttgtctgtatttcttttgaaggatcttactatttggttactggctaaatactggtgtttttacatattgtgctctgggccatcttttttcttcttcaattcctatattgtctctagggaggctgattaatactgtggtattattggagtcccctgggactccagaatctttattccaacactgatcttcttgcttccattcttacccttatagtttcttagttcttctccccactgcagccagcgtgattattttatggaagtttgataatattatgtaacttctctgcctagattttttttttgtcgtggctccccatctaacttagggtaaaatctacctttttactatgaatagggtgacaaacttctcctggttttcttggaactttcctggttttagcactgaaagtcctgtgtcccaggagaatgtcagtcccaggcaaagcagggaacagttggtcaccttaaatgtgacatacaggctgtacattatctggccctttacc

SEQ ID NO: 114794 - DNA, 1015 bp, Homo sapiens
gggccagataatgtacagcctgtatgtcacatttaaggtgaccaactgttccctgctttgcctgggactgacattctcctgggacacaggactttcagtgctaaaaccaggaaagttccaagaaaaccaggagaagtttgtcaccctattcatagtaaaaaggtagattttaccctaagttagatggggagccacgacaaaaaaaaaatctaggcagagaagttacataatattatcaaacttccataaaataatcacgctggctgcagtggggagaagaactaagaaactataagggtaagaatggaagcaagaagatcagtgttggaataaagattctggagtcccaggggactccaataataccacagtattaatcagcctccctagagacaatataggaattgaagaagaaaaaagatggcccagagcacaatatgtaaaaacaccagtatttagccagtaaccaaatagtaagatccttcaaaagaaatacagacaaagaagtagtcacagagataggaagaaaaaggtatcataaatgccaacaaagtacagttgaaataagggagcagttagcaccaaaacttcccagaaatcaggtaagacaaggactaaaatatccagtagattcggtaagtaggatatcactgatctctaaggcaaaagcaacgtcaatgaactggttgggggcaaatccataaaaaaactgcaaagttttagaaaataactgagaactgaaggagtggcgataccaagcttggggataagtggaaggaaaagagataataaccaagagagtgacacagggtaaaggatttttaaaattttcttgaaaaacaggagtcttgaacaagtctttttaggctaaaaggagtcaagtgtgaagggagagaaaaaaaagacaagacaggacaagatttttttaagcaagagaaaaggtgaagtagttctaatccagtgactttcaattcctctgtgaaaacaaggtgggtttattgaagaaagaaggata

SEQ ID NO: 114795 - DNA, 1037 bp, Homo sapiens
aagatagttataaaatgttactccaactaggaaaaataatttttgaaggatatatgtatatataagttatcctttctaagggagctagtcagccctttgtttagatttcgtaaggtaaattccaaatagagtttataaatctgagaacaagagagaagcaaatccaagtggaacaaaggtcatctaaccgcctctacaagtattagtttatctttggtcatcaagtagccatatgcagtgtgttaaaaagtcatcaaggctgaggcaggagaatggcatgaaccagggaggcggagcttgcagtgagccgagatcacaccactgcactccagcctgggcaacagagcgagactccatctcaaaaaaaaaaaaaaagtcataaaaaaaataaaaaacttaagctgtaaaacataagattttgagatcctggtgactatatgattcagaaaacataatgctgtatttggtattaaagccaaattataattttctgatatcaggctttctagttcaatttgtacttgtaggtttcacaggtagttattaaaatatattttcaaaaaattatattttatacggggcttttaaaaatcataatattagaacatcatgtgtaatatatattagtaaaacaacgtttcttttgttttgatatagcttgcattgaaaggctctagttacagtggacttcttgaacgacatcatattcacaccaaaaatgtagaacatattatagatagtttacggtaagtctatgggattgggtcttgggttggattttatattcaggacttccagtttttattttgtactagcagcccattcttagatttttagtgatgattgttattataaaatcattttcagaaaattatatcaaggttaatggatctgattttatagcatctttaaagaaaaatttattgttctctgaaaatgtcacaggtgttttcaattatttggtcttccagagaaatgcatcttctgtagagttaattcagttacacagctggcttcaactgtataatattttattt

SEQ ID NO: 114796 - DNA, 1028 bp, Homo sapiens
gcaggagaattgcttgaagtcgggaggcagaggttgcagtgagctgagactgtgccattgcactccagcctgggcaacaaagcaaaactcagaaacaccatctcaaaaaaaaaaaaaaaaaaaaagaaagaaagaaaaagaaaaagaaaatgaatgtatatagtgaaaaaagcaaatggtatgaacatatacagggctaagacaagatgattgattttacagtaacattgtgagttaagtagtccttttttggcccatctgggaaccccatcaccatttataactaggctgctgtgcaaaaatgtgcttttcattccaaacactgatcttaaattgaactctcagaacagttgtattttctttttaactctcttagcagcaggatcccttgttgcaggttttgttcacaagtttctcttatttccttgggattttttttttcatagtagagtaaagtcattcctgaaaaattgaagcaatatttggcatgggaaatacaggagatgaggattgaggcctgagaagttttctgcttgattctccaggaaaagctttcaatgtggttatggtcagaaacaagactataaacatttcaccttattaccgcaaatgcctgcttccttctttaggtggccctggtgacagaactgctggcgaactaactgccttctctccctacacacagcttccctcaacccctcaaagcagcaagatttatgcaagcctcctgtgacagcagagcttctgtcccatcagtagccttatcaaatctgtcctatagccccatcagacctgagcgaacacctgctttccaggtaagttcttaccatggatcaaggcagtggtgcacaaaacaaaacaggctgaacatttccaaattgttgggactcatgccacttctttgggagggcacaacaatcaaatccaacagaatttaggcttgctagagcctaaacaaaaattctttagtccctttggaacaggaaaacttagggagcactaagaaaactttgcacaaacattacagt

SEQ ID NO: 114797 - DNA, 1050 bp, Homo sapiens
aactgcatgatttacccggttacctcaaaagaaaacttacagttctcctatagaccattaagccacttccttctcattcatttaacacatactcatttataattcatgatcctatacgtataataaatagagctcagtaatactggagtatatttgaaaaagatggagaaacaccattcaaaatggtgttgtaaacaccagaagagtggaatttctaagacagaaatgtttccattcaagaatacaggaatggaaattcataaaacttgaacatggaagacagattgatggagaaggaagttcctaagtcattagtacaaagcaataacatctctaataaaaagaagataatgccaggatttaaaagtctgtttttctctaggagttctgggatcatccctagtctatttttctctaggagttctgggatcattcctcacccagtgagggctttcctaagatttgtgagaattgcaataagagttggctgagctagggtagataagttggccgggtgccctcatggttggctttactaatggaaactgaggaggcagaagcagcaagaagaaggcactaacaaagaaacacataaaaagagctcattgacagtcaaagagaccactgagtctacatcaaagacttggaatagcaaatagacaacttaggagcaaacagatttaggagagaaggaagaacccttcagttatctgttagtgtgtcttccatcaagaacccagtgaatataaaggctctatttagcttgtcactgggttccatgtctaccagtcctaagagataggaaaagaatgtgtctgtacaccaactcttaatttatttgctgtagcataagaaaaaacaagaaagatgctagcaaggaagaaggagataattattttcccccaagatgagagatgagaagagctatagttattacctagttttcaaattcctaggtttttattgcttttagtaaaaaaaaaaaaaaaaaaaatcactgggaaaacctatgtactgggttgaatcttttgtttagactgtttttttttt

SEQ ID NO: 114798 - DNA, 1068 bp, Homo sapiens
agagagttgggaaaggttgttttgaagcagtgggtagaagtcttaatgttgttctaagtgtatctctggattctattttgctctttttcttcttgtcatttcagatattgaggaaacagagcaggcaatttcaaatttctctttcaagtaggtaatcaaataagcaagtgtgttcagaacaattaaccttcagtaataatacctttcatttttgtggtggtacagtttacaaagcactttctgttgcactctctgtagcacgtaagctatgaccaggccaccctccttctgatttgtatctgcaaatgtctgggacgcagctaagaaagcattgagagtctaaagatcctgggtacaggcccggctccatcaactaactcgatttttatggtgtaagacaaatctctgggtctcattttctcatcagcaaagtaagtttggactaatgtctgcttccaactccaaaattctatcattttaagtctagtttatcttcctctaaaatatctgaatatatagaataataaacagaggtgttttgctttgttttattttgttttgctttgttttgtttccagggcatgacactgtaccattgctagaatctttttcctagataacccattctggctggtctctccagtctaacaaatagcccccttctctccctttgacctcttgagggcccctggctctgggtctgataatcagtgtttcctagccagtgtttgagaacacagtgaggacacactttgcagaagccccttctgcccttcagtctctgcccatctctcataaattaggggaagaaaaccacaggcttttgtttttgctatggaataaataagattgtgaagagcctaacctgtttagaggaggcaaccagagtttgagcactgtcttttccaagctgtacattccaggtacttgatatttatggaacactaggatactatcattcatcaagtatttgctggcagctaggtgagctgcatcattgctgggagctgagaaaacacacagagcacttcagtgcacagagtttagcgactatactcactgagtata

SEQ ID NO: 114799 - DNA, 1558 bp, Homo sapiens
atgactataaaaataaatatgtatttattccttttttgactctttgtatacaaataatagcatagtatacatagcccacttttcaccttgcttttttcactttacaatatacctgggatattattccttagcacgtagaaaggcccctcattcttagggctacattgtatgggcataatataacttatttaagcaattaccaattgatggacacttcggttgtttccagtctttagacatttttatttaaaaacgttgtaatgaatgatctttcacccatgtatctggatatacctagaagtgaaattgctgggtctaaaggtatactcattcataatgttgataagtattgctaatttgtactccatagaatttgtagtcatttgctacaaatgtgggatttaaaaaagagttagcctcggtactgtactgcctctgccaaaggtaagcatgagtggactttgcagtttgtgcgggttccgcagacagactgaggaaactaaggaaatcagtgcattggaaaactgcaatttcaggatagaatcaggtagatgcaggtatctccctgcttctaaagcccaaatttaatccatatacaacacccaaagctttaatttgtatgttacattcaacttttgaagccctttcacatctcttaccatctatcatcttcacaataaactgtgaaagagatgaaccagggtttcagtttttatccctccctctaagccttcaccccctaccaccaatttagcagaagtttagaaagtgaaacattgagtgatgtgtcaaaggcgcttagaaataagagactgccagaaataagtctatagaagctaggatcaccccgctcccaggccagccctggctgctttagttacagtcttaggggatgcaacctgtccacaaataattccccagaatactggtgctaacagtctgagcacagatgggtctcggctgggctctagagcagaacataaaatcaggaaactagagcaaactttactcttcatactgcacagagacatatcagttagtagaacagaggctctgaaagaacagaaaagggaatagatggaaatgggaacacctttgctgtgcaccagcatataacacacaaaaggcaccaggggaacttgggaaattttaaacatatttcattcccagtttctacttgttcataataatttcctttttccagaaaggaaggcaacaagtcctgcttttaattgctatttctggaatagaagatttttaaaaataacaatggattggacatttagaatacctgtaggattatttgtaaattaaattaccacttcacatagccttttttggtgcagtttttggaagaaagcaccaggcctttcttaaaactccaaggttcttctgatgcagttgtctctaagagtcacacaccgtgtgcacataagtccgtgtctccactctacttggtcatcagtcacccagggctctctcatttgggcacccctggtggaacaaggctggggcaggtatttcccaccttcaacaggaaataccaaaggacaaaaga

SEQ ID NO: 114800 - DNA, 1061 bp, Homo sapiens
accaacacttatcttttcctggtgtacccgcatgatttcatttccttctccagttgcctcccacccccgttaccttttatgctagtgggagaagggggagggggcgggagattttcccatctgaatattttatcagtggacacttggatttttaacaagtggaagctttgcaggataggattctatgttctatgacaatgagataaccatttattcctgcatgggaaaaggtgaaagagtcatttgtctatgtgattggtgaatcagatggagccaagaagttgcagaaaaatgttactgtacattccttcctgcccactcttctctttccccacagcacatctctgacttggagaaggaatttccatagacactgcccgagcaggatgatttctgggtttgtaggtaaagctcagaactcaggtattactgaccctattctcttttccacccttggctcactgttcccctgttgggcatataccactctacctctatgtgagctggcactgagaatccttcccatcccagggagttctcaaggatatttatactatccttcaagatctctgtgtaatgagaacttcatagtacaactcaaaagtcatggaggaacattctattacatgccttggagggctggctattacttagacaggaactatgtcagattttccctcaatgccttgcagatctctgctggtttccacttgtccagggccttaaacaagtgattgcatgtacatatgctttcactggagaatgaattgcccataaaacagtcctggagttgatttgatgtacttgtttgtgaagctgggatggtccattgctgaccaggggtaatcacagcagctacagttcttaccacaaaagctatattcatgctgacatgagggcacatgcttattttattatccatatgctgatatttttctgggaaacaaattattcacagaaagcacttgtaagacagaacccacatctgacattttctgtggtagagcagagtctctcctcaccatccctgctggcagggcatctggattaagtgcctgcag

SEQ ID NO: 114801 - DNA, 1164 bp, Homo sapiens
acatttataatattgttaaagagaaaagaattataagctgcaaacaactaatataaaatgaacttttaaaactgtaacctaattgcaagttgggagtgttgccaaattggaccattaagagagttttagctcttgtccaggactgtgctaaggcaaggagtctgaggggcagaatttagttcgccaaagatctttttaaggtgttagtctgaagtgagtaatttccaaactacacagtaatttagatatttatgatcaaatggaatgaatgatggattcagtaagaatgtcctttatggttttgaatacaataattctaacccaaatgagggtatgacccagctataatgggaagggaggaacttctacaaattacacagacccctggaggatccctgtgtatactgggaaatgttactggagaatgtgttgcctagggaagaaacaaaggcaggctccattgctttagagtggaaaggcaacctcaaatgcctccagtggccacgtgggtgatgcatgtacatgaagctgccctttcaggctattttttgttttcctattttgatagagtcatggatacagagaaatatttctcttcaacaagagaactaagagggacaagtatgatgataaacggagagggacccaactacagaataatatggcaaaaggcaggcaaagagactattgagacaagggccagatcttcctgtttttcaagagtatccagaaatctcaaattttttaagaacctgcagattctttgatacaattcacgaaacaaaccagtgcaaagcaaacgcagtacacccattccaatgtaattccaatggcaggcccattccaaccctcagactaccaatatttgaactcaggtttgaatgtcagaatccaatcattggcagtcctgtgccaaagcttaactgataatgtggaattcactactgaacatcatgtttactgctgactaaacaaattgctattggaaagcctcttctctccatcttctgggtataactgcattgtgtagtagccattctggtcttttctgcaccagaaggaacactggagtaagaactcagaggtcatgctcccataggaaatatttcccagtggggaaatactttatagacttgtttctcctaagttcagttgtcccagggt

SEQ ID NO: 114802 - DNA, 1050 bp, Homo sapiens
attctgagaggatgcactgtcccatcagattaattgcactacatagaggtagtgcccagcttccaatccctgccccccaccccagagttctttaattaattgatctgaaatggagcttgggagttgacatttatttgtagttctctagatgattctattgtgcacccatggttgaaaactaccactttacagtttttctagaattgttgttttctggcgccacagtcccccactgttactactttagttgatacctttattagttcagataccccctcttctaggaagccttccctggctttcccctgctaatacagggtcgcagaggtgtagatacgtttccaccttatcacagttactgcatcacaatggaatgcactgttaacatgtctatcttcctcatagaggcttcttgaaggtactgtgtctttatctggcacattctttgcattgcctagaggacagagtctgcattcttggcaggacaaataagagccttagcagccttcgcaagcccctctaccagctttattgcctgctgctctcctggcagaaaccctgtccctctctcaacgtcctaatgccctcagcacttcatccttagtatgcttccctcttccctagctccatcagaattctttacctacttcaaagtaaattgaaagcttagctttcaatctttccgtaaagttagccctattgatccctccctggagtacctgtcactgtcactcatacattaccagcacatgctgtcatgctccaaactaaactggagggttccactaggaccatgtttgatgtatttttgtggcatctggagcaaagttcatcctgcctgagaagtgtaccatttttaatggttttttgtttgtttgtttttgagatggagtctcgctctgtcgcccaggctggagtgcagtgacgcgacctcagctcactgcaacctctgcatcccgtgttcaagggattctcctgcctcaacctcctgagtagctgggactacaggggcccgccaccacgcccagctaatttttgtatttttagtag

SEQ ID NO: 114803 - DNA, 1027 bp, Homo sapiens
ctacctccctgaaagtatattacaaatgttctacaattgtaatatagtgattcacacacaaaaaaatccctattatcagcatacctaaactacacactaaatatttaagaaaaaaaaagtggaaacattagtagcttttatactggaatcttgccatttctttttcaatttagaatagaatttggttgtcttatcttggtactctgtgcttcatgacatatctgaaagcattcttttggcatggatctggaagatagttttagagccagacatcagtgtagtagttctcaagatactgaaaattcataacattcttatgggtataataaaaaatgtttacatattgaattctatgaattctataatataaagtaggagcacacttactatgtgaaatataactcctatgcaatataaaagtaaaattataagcatatttccataaacagtaaaagctattaaatctaagcatgattgacaatttcaaatgttccaatatcatttaggcataatacttcaaagatttcaagccctttttctgctagcattcagaaaagtagaggacaagaaaggatgaagaaaagcttacagtgaaaaaatcttaaaattgagagaattcaatctattaactttaatctataaaccttttttctccgaactgggtacattggcatcattatttgattttagcagcaaacatttgggtttagcttatggaaggcagatgtcctgtgggaacgtgacttgaagtcaccatataacttcccgctaaataaacatctgaactgtaacttgacagctaccaagtgaggtcaagtgtctgaaagtgctgtgtacaccacataagcacgttttccttatgtgaaggatgcatttctagcaatgtgtatcagactttcaagtactcaaaacatacttgctgccaaactttgccacccaccactaacctccatttgatccttagaaggtagaaacttattttacaatagaaaaagagattattttatttgtatgatgtccctaaaat

SEQ ID NO: 114804 - DNA, 1218 bp, Homo sapiens
atatgagtttatttctttagttgtagtgaataaaaataaagttaattacaaaagtaaagcaggtaacacaactatttgaatatgcttaacactattgaactgtacctctaaaaatagttaagatggcacattttattatgtgttttataccataattaaaattttcaaaaataaggcagatataaatattttaatgtcaattcttttgagtggactattctaaatgattatttgcttatcagtctaacttaagcacagttaatcacttttacactgctttgagttagatagctgctccctatcctaaattttactttctaagatgagtaatacagatactcaagttaaccaggatgttagtctgtgggtcagtgatcaggtatctccaagtcaagacattcctcagccgcccctgtggttgtcctgtgaggtggttggtggtgagggtgggcctggggggagacaactgcaacaggaggacctctggattacatacccaagttccctctcaggaatgtggatgctaaaagtgaagtgctgataacaaatctcactggtatgaagtagattttacaagctgcttcagtctcaggctatatctcaatttatggggcggcgtcattgctgaaagttctgtgtaggtcttttaccatagtattgaattttacattcattataatgctttttattatgagctctaattccaagttagttatttttaattcagaaagaaagtaaatatttgctttctggaggtaactgcacttgagtatctgcaaggagagcccctcaagttctgtttttggggatcctccccttttgaaaacactaatcggacctcaaaaccagattttatctttgaggactgacttccgctgcctttttttttttttttttttttttttttttgatagagtctcactctcacccaggccagagtgcagtggcgtgttctcggctcactgtaacctccgcctcccaggttcaagcaattctcttccccagctgcccaagtagctggaattacaggtgcctaccaccacgcccagttaatttttacatttttagtatagacaggtttcaccatcttggccaggctggtcttgaactcctgaccttgtgatctacccccacctcggcctcccaaagtgctgggattacagatgtgagccaccgcgcccggccctccattgccttttgaccatcaacaaaaaaggc

SEQ ID NO: 114805 - DNA, 1008 bp, Homo sapiens
gtgccattgcactccagcctgggcaacaaaagcaaaactccatctcaaaaaaaaaaaaaaaaaaagattctctatctctattccgtatctctatccacacacacaaaaagggacaattggcataaattcctatttttaggcttcccaaagaaaaacacaatcctatgttctgttggctgacaagactaagattaaaaagtgacataaagcgtaggactgcagcctttctatagtttattatttgtctcctgaaaaggaagatatttgtatttcttttaggaacttcactccaacagatttattctaaaacaattcctgactgtgttgaaataatgaggtacagttcactttgagaaaataccctaaagaaaagtcctgatcaatgattctcaaaatttttccggtctcaatatacttatgggataaaaagtcattcttctcagtaattaatagtagctaatataaccctttgcttttgtgtttattgttggtgtagagagagcagaaggagctatgttaatttgtatggcttttaaaaactaaagattattctgatatcccaatattcatttcccccagtcctcaacccttgagtgagatgggccttccccattgaaaatcactgtgtgagttttccaaaaacaattaattataatacgttccatcatggattactttagtgcacttaaaatttgactcaaaattttacaagcattgattttactttcagaaatacgtttgtgggcagatgtgaaattttcctatgggaatatcagtctaccttactgttttggggacatccaagtcttagtgtagaggcgggtggggaaactagattaaatgttgagtgaacttgtctactgtttctaccttgacctctaactctcaggtgagggtggaagtcctctctcctgaatacaggatagggattgtctatagtctgagggaaaggctgctttccactggggtcatttatccatctgtaaaagaggatttttctccccttaa

SEQ ID NO: 114806 - DNA, 1263 bp, Homo sapiens
gggaatgcagctattctagatgtgatatataagagtagggaaactaagttttttttaaaaaaaaaaaaaaaaaaaaaaaaaggaaatatagaaactaggggctaaactagtaacttggcccctccttgggttccttccccacaccaggcttgctgactcttcctccctaactccactgccctctactatggccaccatctgcaccctagtctgggcaacaccatattgatcctaatctacactaacttcctttctagtctccctgccatccgcctaccccacaatccagggtcttgctcttttcttacctactttttttgcacaaaggtagcatgttcttcctaaaactcaactctgggctcattccccacattgcttttggaataaagatcaaacttctcacatggctccagcttgtgcctttctgtcttatttctcactcctcctccccaccctcccacccccagcccaaccccactcccaccctagtgtctgcctggactcttttccccagcttcttcacctgaaacccctccttaccctcaggtcttaccttgcatgtcactttctccaggaaacatctcctacacacacagtacagttaggcagccccattgccagtctccacctcctccagccaactgtgtcatgaaaacagggaccattttgttcagctctccatccctggggacagacagaaatcatctttcgagattccagagagtcttaagttattttataaagtgttgtgaaagtctccactttcatgttaaaaagtactatatgctgcataacatttttcagaaagggttattatggaagggccgagggtcaaagttccaaggtcctgaaagtattacactgcttccctgagcagtgtcagaccagaaaaaccaacaccggactcttgactcagggaaatattgcaccctactgccaatttatgtggttggcttttttatctttttaaacaggcaaagagagctttgccatgcttttcctggaaagattcactgattcaatccttcagctaatatttggtggaatgcctactaaagccatggcatgcaattctgccgtaggacatgaagtcgtgtgtgcctgctgttgaaagcagtgagtgttacatgagagttttctgattgccagctagtttgcttccctgacaggcatttccagatgtgaggaaagatttattttggcactcccagctccaagtggcgtgagcgcacacacacatacacacacacacacacacacaac

SEQ ID NO: 114807 - DNA, 1240 bp, Homo sapiens
aaaattgaactacagaaattggcgtgactgctgtgaatagcaaacttggaaatgctttgggtgagggtacaatactgaacattcaaatgcttccactggataatgcaggtctagcttcataaacccagtgtgagaagtcagattgatttgctagtttgctttttatgcattttctaagatgtttcttcttgttttatgacctcttagaagcactgacctcatatttgccttgagattgaatgctttgcccatcttgctgcacatctgtgatcattaatggtattacttaatgaataagttagcatgtaaatttgcaatgtggaaactgcatcccctgccatcacacttctcagcagctgcttacaattctttcacgttccctccccaaggaaatggttcataacagaattgaacagatgctaggtgtttggcagcattgtgagcgacactggttttcaaaatttaggttatttcatgtcagataattacaatttcaacagcttttaggcctttaatgtgtggcggtgttcacataaatacttaacctctgactccacatttacccctcccaagttcccctaacttatttattggttctgacaacaccactactaaattcttggctctcaaagtcgaatctggtaaacacgcatgggcagatctgacttggcactaaaattgctccttctttctagatgagcttttacagttgttcctgacagcagtcaagtgttgccagaactccaatgtatagtttagtagagtttcccaagtgcctctctcctgggcccctcacttctgacacacacagatctcttctttctcaacctgatgcactgttctgtctcatggaatgctgtgatgccctggacttgtgagctttgagagcaaacactaggtctttctagagctcctgagagtggcatacaataagtgctcaataaatgcatcccacatgagctgaggataattagctaaaaataaggaaaatattgatgcttttgtttgtttgttttgtttttgagagagcctcgctctgtcgcccagactggagtgcagtggtgcgatcttggctcactgcaaccttcgcctcctgagttcaagtgattctcctgcctcagcctcctgagtagttgggattacaggcatgtgccaccacatccagctaatttttgtatttttcgtagagacagggttttgccatgttggtcaggctggtctcgaactcctgacctcgtga

SEQ ID NO: 114808 - DNA, 1038 bp, Homo sapiens
catctgaggggttcttacacccctccaggggctgttaggaaacacagtgaaaatggtttgggcatacagaaaacactctgtgagtgggatgagccaatggaaatgttctcgtgctgcagaacactcagtggtagatgaagggtggtttgtgtatcttaatgactgagtccctgctcatcgatatcccaatcacttgacttcttaacacagtttatctccctacttgaaatgttttacctttccccccattcgaaagttattccacacacattcatgaagcattttacaaatgctgcagcctccctaagactggatgctgataacacttctaaaggggcacagactccataagactgtggatgccgatacacttctcaagaggcaccatttcctttcccctagcaagccttgtatagctctgtcccctcactggatacacagaaaacagtcttgaccgagcatctgccatatgtcttcatgctaccttcccttccttgtccccattgcatgtgtgctctgcgtcatgcagggctgctattgtctagctgaggttgttaattcattcagtattgaggccctccagttagctgtgctaggtgcctaagaaggaagtcacagcactgttaaccatagactccaggtcctacatctccttcctctgcagagtgaggagatgtttgcatctgaaaaggtaaacaggggccagctgagtggtgcaggggacattcgctctggctgcatttatttgtagtaattcctgtttggttcttaagaacacaaacttctggagctaccagttgcagcattgactagctgtgggagaagtcactttggcattcagggcttgtttatggagtggaaataatagtagtgacagtaataaacatgtttgttgtatgtgcctcctgggggacctggaggtgagctcacggggaatcatggctgtgagtgtggtctatgtgaatctataggcattggctaatgtcagtgactactacactctgagattctgctttaatattataaacaccaacttca

SEQ ID NO: 114809 - DNA, 2089 bp, Homo sapiens
gttcctgcagtgttagtcactgggcatatagtaatcaatgtaaaccatcgtgtattactatacttcaagggctgtgacctggaaaatcactgatatgttattccagaatgaataaaagtgaagttgaacttaaggcatatactttaaaagaatggactttttaataatcattgtagcacaaccagaaatttttgctaatgaattatccaattaacttttctgaagcctaaaataattatgctgttatttcttttgcatatgaataacttctgtttgtattgatccttgatgcatttacatctctgcccaaatgatatgacattcctatctagaggggaaggatatttattagcttatacttctctagattgatactactgattcttttaggaaaacagtaattcctgaagttacaaagtcaggctaacagtattcccacaaaacatcttgtaatagcttcatgtgctatagggaatttttttgtttaaaaagtgctccctttctataatcactttttggttgtggaattcctgaaacaatttgttttggttattctgaaaaattctgaatcttccctaatacctttagtaataaaataggacctgataaaaatcacgaagtgtctttgaatctggctgaatatctagacttaatgagtgtttaaggctccatgtcaacctgcaaagatacctggtgaagcacccttatgtacttttctaaaaaaaccctgccctgttccatactttaatcaacgactcaacaacatagaagtcatctacatagtgttttcatacgacataagcccaaaaaggatggcttccactgcatatgcctgtgatcatgattcataatgatttcaataggctgcaatgctggatggaaaccaacatgatgaagttgagcaaggaataagtgtacatttctgcttttagattcaaaaggcaattgcgcaattacaggatggggaacaactgagcttggcagcagttcatgtgactaaaggcttaatgtgaaccaacagtaggaagtggtggctaaaaaagaatgaatgtagccgtgtgcttcctcagtagaaatattaatagtcactgtactctgcgctgaccgcactgcattgggaataatttgtttggttctgagcacattcaggagaggctttgacaaagcagagtagctactaagagggtgttgaatccaatccaagacacatttattagactcctgttttgggcaggcaatgtgctaaccagggcaggcaataaagacacaaagagactttgccagtctctaggctcaaggagttgaaaatttaaatagagagtcagacaggtacacgcatgactataaaacaaagcgccccacgaaaccaagaagcacaaagaaagggttgtgggaattcaggggctgggctagtggtcagatttccacaggaaatgaggacgagagcagaagaagccttaagagcaaagagacagagacaggaaaacccaaggcatgtctagggaatgctgagaagtctgggttgcctggcagaatagggtaggcctgcgtaggaaatgaagctgaaaaaagaaggtttgggccagagcgtgaggacattgactggtaggcagtgggaggcattacaggttggtgagcatctgaaaaaaaataatgatatatgaggatctgttggagaaatgatgcatattgagtctatagaaaagaagaccgaagtcccctggtaaacgtatctcagacttgctttgggttcctccagaagcaaaaatttatctcaaagggaaagggttaaaaggaatgagattttagatttctaagcagttttttttgtttgtttgtttaatcaaagctgcccatggtgaagacttaccttagaagattgtgagcaccattgtggtgggactcagagaaagtttggtaactgacactctaaacagagttgggggagaaatgctgcagcttcaccaactggcctgggcattctagggattacccatggcctttgcaatgtgtaattatccatggttgaggtttttttctttcttctttgacttaagacatccattagtatgtcattttctgaataaag

SEQ ID NO: 114810 - DNA, 1158 bp, Homo sapiens
acccctgaaatctattcaggataagtgaagtttgctataagggactgtccacaattttcttgtataatttttgggattcctaaatactccttgaaaaaaaacattggaatatgaagctgagaagaaactatgcacgtaagtattacaaaactaaagtagaatgtgcagaaacaactccctcctagagaaggaagaaagctacaaaagtgttatgccactacttgtggaatatatcagcaattattcaattccattgctgcccttggacctgggggcaaaaatgtagcttttcctgttccaagggaagaatgttctgttacaatggtaaccagaaacagggaagccgaccaattctagagtttactccgacagtgttttcactctatgcagtaacactgctttattgtttggctctggtagctgagagaacaatctcccactccctaggtgagactattcttttataggaactattcttttagataaaacaaccaatgagcttttaaatgctgagaaaactaatcagaactgaaagggggtgccgttggccacagctcaagaaatatgctgactaagataaaagccccttctgaatttttctccatcccatcttcctttgctttctcatctcccttccttttctctacgttttctcttttctctttctcctcttgtcattctctcagctctatctccacaatcttccctttctcctctcctcagccccagctctatcaccaaagatttcattttgcacactctttttactggccaaagtgtggacctgaattttttaaatgtattttcttatatagtagataagattcacatctctggatttaatttaaaaaatagacaaagtggtggctcatgcctgtaatctcagcactttgggaggtccaggcgggcggatcacctgaggtcaggagtgcgagaccagacaggccaacgtggcgaaaccccgtctctactaaaaatacaaaaattagccaagcgtggtggtgggcacctgtaatcccagctacttgggaggctgaggcaggagaatcacttgaacctgggaggcagaggttgcagtaagctgagatcatgccactgcactccagcctgggcaacagagcgagactccgtctcaaagaaaaagaaaagaaaagaaac

SEQ ID NO: 114811 - DNA, 1396 bp, Homo sapiens
gtgggcctctgagaagtgaatttcggagctgccccttctgagagtttccggcgacctcgctgagagtgagaggaagtccctgcggtgggccctctggcaaaccacatactgggaagatcgcgggactgtgttaagctgtcatgagagtcaattgaatggtcaagaccagcgtagacagaaataaagcttgaccactcagaggccgccatgggctgcttacccgggagaggcagtctccaccccaaaggttaagccaaagggcgctagaagttctttgatgttagaagtagcagtggtggaagttgtgcctcagtttcctctcattgcttccgaattaaagttcatcctcaaaggacgactgtagccagagaaaagggattgtctgcttagtcctatcagaccgaggatacagtgatttagttgactttttctgccactaataatactgtcttcgccactgatttttttctacttaacaatctttcaaaagagaatgtttctcttttgcttttctacacttcattttcttttcttgtttgtttgtttttgtttttagagacggagtctcgctctgtcccccaggctggagtgcagtagcgtgatctctgctccctgcaacctccgcttcccaggttcgagcaattctcctgcctcagcctctcgggtagctgggattacaggcatgctccaccacgcccggcatttttttttttttttttttttttttgtattttttgtatttttagtagagacggggtccccatgttggccaggctggtcccgaactcctgacctcaggtgatccacctgcctcagcctcccaaagtactgggattataggcgtgagccaccgcgcccggccctgcacttagttttcttaaggaacactagagcttgaagaaaaagacgtgttgacaagttttaagggtcaaatttaaaaatcagtttccctgataaagtatgtgccatcacacgtggcaaatctgtaaggaacacttggtgttttcatgtaatgtaatcttataaggctaagctgtgttataggctaataaaatgtcatttgtgatattataaacagccataatgagaaggaacctttgaccagggtgaaaacccgtgtgaaaatgcttgtgactgtgaattctgcaaaatcgttctccgctcttcatggagatggtttcattctcttcaccaagaatcactgataaaagtaaattgccttctttgctcaaaattccgtgaagtgaacctttctaaaatgtattcccttgttacaatgtccataaaatttctgttcaagtgaaatgacccaatacccaaggtcactatcctcattctgtggtctccactagtgagatgaagcaagttcttgggtatggtggacagcccaagatca

SEQ ID NO: 114812 - DNA, 4731 bp, Homo sapiens
tctataaaggggccagaagaaaatatttttgcacagaaaaacaatatagttctagagagagatttgaagtgactttctttgtgctccctccccacccctcactgcctttcctgggtgagttttttcaccctcctcctcactctcttcctaggatggcagtgtaccctggactcagcagtgggcagctgcctaggacacacggccccatttttcaatctgtaattatgaagtatattgtatttttagagtttgattttcttattaaaaaaacttatattcacatgaatatggtacatattagcactcatccttgctttccttgtaagtttgcccatcttgaaattctaggagggttgagaacaggcgtctttcattagatgcgtgtatgagaaactcattgtggagaaggggtacatctaaaataaaataaaaactgaaacagaacaatcttcttgaatcagcagttgccatcactcttttctttccttctggacctgttccagtggccctggaagaacaatgaaacatcatggggataagtgggaagacaattcaaaacagaagactacttctctagattttgtgtttcaaaaccagagatgggaattgttgaggggagtacactgatacatgttaatgtccaagtcacagattttcagcagacaggagaataaaatccatgccaatgatggaaacttgggaacttggcacattttatgttgtcctttaatacttgactgaatgtatattttatttatccaagaagtcatattaattattataccataagagatctaatttaccatatagacttacagagtaccacatacacatttccaaaacattccctctctgccccctaaaatcccatgaatttggtgcatatttgttgtgacaaatcaattgccaaaagactgtctttataattacctatttgctcaagaaactcccttcctttcctctctcttccatgtgattactgcctaaaatactcaggtgtttgaagcaaagttttaatcttttactttctagaaagcatcttattcagtctccttctgatgcttaactcattgttgaacagaaataggtttggagaaatgattgcttgcttgataagtggttatttatgggtagacttgtagaaaagaaaataagactcaagtgctcacagcagccagcaaatatccacggctctccaccctccattaaacatgctctgggctgtttttctaggaatggtgaagaatttgcactgatattatcagctctctagctagtccttctggtgaccagtgttaatcagcttgatcttaaagtaggtttagggaatactgagtaatgggacagagatttttcacaattatattcctccacagaattatcttcaagccaagtggctcatcttagcaattaactcaaatgcaagaaagttagagaaagtcagcatggataacaagcaaatgaaacatgggtgactcctggcttgtccataaaaagagaggtatagcagtaagaatactctcttggaaatgtgggttcaaatcctgccactgtcatttattagctgtgcaatgccgggcaagttatttaacttctctggtctcttgtttcttcacctataatatagtatcaacaatatctgcattatacaattgtcatggaattaaatgaccattaccatcaatcaaagataggacttagcgagtgagtctttggaccacataaaagttaactcaaaatgtacaaaacacacacacaaatgtgtcattgtaagtgaaagagccatcatggtacttataacaatagtacaatacagtatttctttggatttcaggggggtcttgattctgaaggcaggttgttttcataataaagatgtcatgatgtcttgaattgggctagtttagctaagcccagatcaaatgaagaaaaagaaactagtcaagatcattatctttaccacttgctctggaatgtgtttctcaaatatgtatttagatgaatgcatggctgtcgtaacacactcccacaattacctacataccaaagtaacttcccgtctccccatcaccccagtgcccttttctcccatatattttaaagtgataaggctcaatgtaaacttcctccttcccaaacgtttagggcagttcctgccaaagtgccccattctacaaagtgatttagtactttaaccttgctccagacactctgacatctctgtttagtctctggtgtaaaaaggttcgtctctcatatttcttgaggttggggaaaggaaatggtcacagagtttaggtgagggtgggaaagtgatgccctgctcatttggggttttgtcttccagagttcttcctccattttcctgatgccaccagtattaaggccattgtgtgtgaacagattgcacacatctgtcctgctgttgccctgatgacagtgtactgccttgttcctggtggtctcatttgttttacaagctagggtacctggaacagaggtggtcaagtaactctgtgtgggacttcgatcctcctttaagggaaggacctacatggagatgtgattaatgaatatacctcccttacctttcttggctgaaagaatagcagctgttactttattctctttcaaaggataagggccaatatgcagaggtgagtgaggcctctcatttgatgattgaatctccttctgtgctttttgggaaaaaatgccttgatggttgtcttcagctatttagaattagaaagtatgaagaaaatgttttcatattggtttttactttaaacattttttaaaaacctatgaactttattttctagagtcgacagccctgtagccgtgggtattgggataactttccctatccctctccctatggtgtgagaagggacattaaacctcatcctttgtttgccactttggtttccagtgctctgccttgaccacttagcactctctccgaatagctgtaggtcgagaatagtgggcaggagcatcagagaagagttggcgtgagaacggaacagcaccacaaaatagaaggcgagagggaaaaaagcatctcggaggaagaaaatactgccgcctggtactccctggtacccagagatatccggcgtattgtgcttacactactcgccggttccacagggagagagccggaagaattgcaggctttggtggtgacaagttcaggcactcatgggaaagagagtgggcccctttctgagagaaatcattttgagcacagccaagccaagatattttgagatgtgattcagacctgagaatgaaactgcggggggatgggatacttcggttgggaacagattagcccatttttaacatagttgaaatgttgaagtggtgccatcctaacaaatgaatacttagccccgggtttcgagaaagtggccaaggataaaagaggctaagtgcatggcatcaaagccaaagctggcctccttatctgtgggagctgcagttggttttctcagaggcagaaagtacactgaacctagttacataagacccgagttcaagttcccactccattccacttggtgttaagtcctttaaactgttacttaactgctttataatctgcattataggttgttaaaaataagaacatatgaaatactaagggcttataatgaaaattataagtgatacgattcaaatacgaatgaaattataaattgaaggtcatggcttcaatttccacttaagctaattacctttgtattaagatttttgagcaaacccaaccagttatctggcaatcgtagacaccattttaatcagtactttaccttctaaatatgcaaatatttagagttcacacaaactctaaatatgttcatgtgaacagggccactacctgaatattaaaccaccattagaatctgatactcgtcattgaaatacagcataaccttttaatacatttgtggaaacaccattttaaattgttaaaaaaaaaaaaaactcaattaactgtaattggattacactataattggattttagtgggattggggaggataaagaatgaagaaaagtgaagatacagctaataaaacagaagagctcatattaatatagataatttaatcttttgagagttttttgtcttttccaatagtttttcagcccaaaaagcatggaactgtgttccattagctacagcctttaggaaaaccttaaaagtcatgcctccttttttctctaggatgacaccttgcctgaggcagactttgaagatgttctgaaaatgagggaaagagggatatttagcatgagatgaggcatctcagacctgtgggacaaagtagaggaagacagggtacaagaatgagaactgtgccatgataatttttaaaaattctttgattggatgagatgaaataatagcagagaaactatttgagaaccttataagccaatgtctactttaaatgcaaattgaagatagatcaccaggtgatcagaataatagcttaaattgtacattaaaacatcaaaaaagaatcccaaatacatatataaaataattcttttgaaagaatttaatggcagttaatctgtgtgtgaatcaccagagtgcttgaacttgaggtaaacttagattatcctgccagaaaaatgttttaagtatttatttacacacacatgcacacaggcacactcacacacgcactactcacactcatagcttcccca

SEQ ID NO: 114813 - DNA, 1033 bp, Homo sapiens
gcagatacaaataccttttaccattagaagataaaagctcactttaacctcacttgaatataagagctttgttgcctaaaatattaaaagggaaacagacactcttggttaaataatatttcccaaacatttctccagatggtgtcaattcactcctgttgtaattccctaacgcttctgcttaggatctgtaaaacaaaccaaacaaaaccccaacctagtagaagactggattttacacatataagtctccctttgttttttttccccttgtaataatttttaagactatttttaatatgtaatgcatgcacacattgaaacattcaaaccaaattctttctttaaaaaaaaaaataagcctgaggccaaaatctaactttctttgttcaaaaacaactataactataaataataagcgcctttcaatccaaccagccaactctagcaccatggggctgacgattccagtaagtcagctggccctgtgtgatatcaaaaatgctgatttccagatccttcagatggaaaaagtgctgacttgtacagattgattgtgtttgatttggatttgcattcacaggattttgaagggaaagaaaatgtttctccccaggtctagttggcttagaccaggatgcaaacaaggttgcagtttctgtgcatgctgcaaacagagtctaaggggaatgagttagaggcataagaaagcctgatcaggattgaaaatctgccctggacaatccataaaatgcataaggacccaacggaataaagaaatttgagagttggttggaatagatgaatggggccaatttttttgttgcttgaaattaccagtgctactaactgttcatgaatgtgtccatagtattgacagctggccatggctttgtttgggagtagttgtttcccagtggataagaaacttttccattaacccttggtaaagaaatgaccaagcacttcatatacagcagcactttcttcccctagactctagattcactcaccatcactcaccattattact

SEQ ID NO: 114814 - DNA, 1051 bp, Homo sapiens
tctgaatacaaagtaacagagtaacagtaatcattttagaaaatttgacaataggaaaatataaagaaaaaaataaaaatcacctttaatcctcgttgtgctttttatttttaagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgtatttccattttctatatatgttatatacgagatggttattgccatcaacatgtgttctgtactgaggaaggtgccacgaggcaggatggccaattgcagttatctcactctggtaagcccaggaaaatcaatgaatctctgggcctctagaggccttgaacctatctgcaagcctcttctaataagtttgcttccttgttttcaaaagctgtcacctccttttaccccagtgctgatggaatctcattcctcatttctccattttttatctagtttttcattcaagacataattattgagtgtctactatatgctaagcatatagtgccaggcactgtggatatagcaataaagaaaacatacaaggatattccagatcttacactcttttaagggagacagacaataaacaaacaaatcaatcaaccatatgctttagtcacaggtgctgtggaaaaataaaataaaattgcaggtaactaggagaaggcacaaagtttgccttggatggtgcagaaaggcctctgaggaggtgacgtactttgttaagacctgaatgaacagaggaagcagtcataccaaagtgccagaagaagggtgtttccagtaaagggaaaagcaaacggagaggccccct

SEQ ID NO: 114815 - DNA, 1305 bp, Homo sapiens
tgtgtttggtaatgtgagtttggttgtagtttgctgcacatatgaaacaaacagaagggaaatccaggcagcgaggcctttaagcaaactctaggttatttcaacatgtagaaatcattttgagtctcagtttattgtctgcagaaggaaagctcataaatggcagtagcagcctgtggggaataatgacttcattagaacacctataacctgattgcagtagtacatacatgcacattattaagtttaataatgaatttattttatggacatcttctaattatggcaagtggtactagatttccatttgtactataacatagaattttctcttaaagtaaatttacttaagtaaaaaaggtgatctgaagaataatactaagtaatcttgtaagtggtatgaagatatggaaaggcaataataaaagtggcccttgaataagagaactgactgcaaacctgagacactggtgtagcatcgtgtgcctcttgctttaacttgggaatcaggctctgatgtggaaaatgcttccaaaagtctggatattggtacagtggattccggctgttcaggacacttagcaagggagcaggaggcagagggagtgagtggcatctgaggaccagaaaagtgacccccatgtagtgaaaggagggctggctaggaagacagaggtgggtatcaaaagctctgtatctgccttttcccccaggtctaagagaaaaacattgtgtcctagagcaattctcagtgaggggaaagcccgattctgcaagaatcaggggaaatttatatttacaaaagaaaaaaaagaagtccacagtttctgtaagaaaagaagtccacagtttctgtaagtcctaatggtatcctgggcaggaaagtttggcagtcaactctcttttccctttttcttatcacttggaaatttctgtggactagcttggtggaaaccagactccaaccgtgctggtgttgcttctccccaggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaaggtatgtatgtatgtgtggaaaatgagtctgaaatgttaccttgaaccagggcccctcaagtagggtgtaggagaagccatt

SEQ ID NO: 114816 - DNA, 1027 bp, Homo sapiens
ttttatgttttgcaagttttcttaatgtctggcttaatacaagacagttggagtttcctgtttctgcagtttcacaactgcttcagtgagttgtgacatcacacatcatgtagtctttgcaaaactccactatacattcatgagaaaatgagactgagagggacaaatgacatcttagtattattatgagaatggcttaaagagaaggctcgttccccactgttgggactctcacttcagtcaaactaataactgaacattcatcatctatatggccttataacctttaatagctactattatgaatattatgtgtctattacgtaatcttgcagttggtagatacggcgaactgaatgttaagaggtgcttcgctggccagttcctaacgtaagttgaaaacttgtgatgctcacgggagcctcgtttttccctcctccccaccctgcctgcagggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttg

SEQ ID NO: 114817 - DNA, 1420 bp, Homo sapiens
ttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaacatctttgcacgttgttgttattcttctcctcaaagaaaaatacattttccattcatggaaatattacaataagctcagggcagtctctggaaggatcccatgcagcaaggtaaaatcttggcagagccagccacaagaaaataagtaaggacatgctctcctgctcaactccaagaactggagctggaaacaggaggaggtgagcggagcactttgctgtagcaggccatacttccttgtccatgtcagattcaaatttctcagatgaattgaatcatttccatgtcgggattagaaaagtgtgataccaccatgggcccttccgaaaaagtaacttcctgtctgacctccaaattaggtagatttatctctgtgattattaccaccatttgtgaaaagagctaactaagatctcaagggatttccagaaacagccattgtgctggtgctctattcattaagaacagctt

SEQ ID NO: 114818 - DNA, 1345 bp, Homo sapiens
ggagagtgcaggccgcgggccagcggaatctacttgagctcggggattaggagagctccgggctgagcggagcgactgctggtcggtgacaggcctcgcccgggagtggagccgtagctagtggggaggcggaaacaatacaactaacagcaaatgtgccctgatcgtccccatatttacaactttcccggtccgggagtggggaacgtcccagtgaaacaaacaacctcccttcttccccctgtgaccccatgaagggaggaagtagtttcagttagtgagacaaacgtaaatactcagacgcggatccagtggtaattctttctctttctaaaacttgtttggacgttggaaagttcataaagactcattttcttttttaaagaattaaatcgtccacatgaatatttaatacagaaaaacatactgtggtagacactgcacatctccccctccccaagagcttttatcttgttgttttgacagtgtgttgttgcacatggactttttattcaaagacaagtataaagtacttgacaggtttactctgccactttctatttgtatgcgttatgtaagggcagttttaagcgactatacgtaaaacactcaggtacttcctgaccaaaacgtgtaggagcatacaaagaattttaagtgttctgagaattgtgctgagatacgggtaaaaccacttttcttttctttttccaaaaaagaaattaagttatacttaaaatccttgggaggttaaaaaattgtagaaggtgccatccttttatgtcagggcagttcttcttgaggtcccaggattgtcattggctgtttgtgccatgatgtttgactgtgtaatgagagaggtgtcattttaataggttaaatgtatctgtaaatgctggagaaaaatatcagttctaacttgacaagttctagttcatgagtaagttaagtgtttcgagcttgtttatggaggcgttcataatgtaggttggtataagggggaaacaccaatttaaaattcctcagtcaggcaaattgctagaaaagtgtacctgggttacacgttttgatattttgtttcatattcgctgaaggaaaactttcattggttaaaatgaagcagcactgctcagcgaaatcccttgttttactagtgtttgttacattggttcatattttttgtgtcattaaattattgtcactgtagaataagttattttgtggaggttatttttgagtttagcgtcctgattacaataaattgtttcacatttcctgcaaacgtacggataaatgtttaaaagaatgaagttaatatagctgtcacgtactaggcatgttttta

SEQ ID NO: 114819 - DNA, 1556 bp, Homo sapiens
ttgaagctaggtattgctcagtgctgacactgacaccatttgttactttttcaattatctaagttcaaagtgcatttttcttgtctttgagagagaggatacctgtttcttggttgtattttcctggtatgaaaatagagtgggattttagtgtttctggttgatttaaaaggaattttaaactccatgtctcttaaggccatcattgtaattttaaagggtattttatgtgcttagaatattttgcccaaataaattaagtaataaaagtaattttaggtatttgtcttgtgtgtaattttttttttttggtgtaaatctggagtcagttttgttgaattgagttttgtcaagttgcattatgttttaaggcatatttttttctattcccaaagttatatcattaggagagatcattgcttgatgtagcattgccagctaagattttgaggacttatttgccaggagttaagtctgtccccataatatctcatttaatcttttaacatgcccaaaagtagaaacaataattatctacaatgtacagatgaggaacctgaggctggaaaggtttagaaaactgcccatggtcctacaattagtaaatgatcagtctgatttacatttgttcttatggattcaggattctatgtatctagtttcaatgaaattttaatattatcttttgggtgttagttgatgtgatacttgcccagtcacttagtcaagaaaattgtgtacttcaggcaaagaagctgaaatagaattcaggctatatattctgtatttataatacttttaaaaatcaataactctttaccatcttgtgtttaaaacaatttttgttaagcagtctgtgaagcttttagttctttgaagtattttatattgagttgaagatgtttgtcaaagcatctgttgttagaaagacaaagttcagctttagagagtcatttcattcatagaaatgtatatgaccaattgtaggatagtagctagatctataaattagtatgactgatcattttgtaaagtttcagtatttttatagccagagaatgttgatcattatagtcatcaacttgggaggttgtgcgcttattccagaactgttgccagtacatacaaccttataggaattccttttgtgaatacctttaacacatttgaaatagtctttttctcatctttatgacaaatctttattttctggggtgaatttgagttttagatactgtacaacgtcacttgaaacttagtttagggattttttttgtgtctggcactatgttgagtgctttatgtttgtaatatgtagtattattgaatgtttccatgtgacagaaactgtgcgagggaaaaggtttttcagttcctcaaggtattgaaaagttgaatatgaaattgaagttagttgtatgagaaaactgagatatagaatgattacgtgactagcccaaggtcacacaactaataagttcaagacagtggagaaaggatttcagagttgatactttacccataagccttaaccacgatactgtgtatcatgattt

SEQ ID NO: 114820 - DNA, 1057 bp, Homo sapiens
ggagctgctgagatgacactcacggagctgagacatacggtccagtccttggagatccatctggacttgataagaaatctgaaggccagcttctggagaacagcctgagggaggtggagacctgctatgccctgcaggtagagcagctcaacagaatcctgctgcacctggagtcagagctggcacagacccaggcagaggggcagcaccaggcccaggagtacgagaccatgctgaacatcaaggtcaagctggaggctgagagcgccacctgccaccgcctgcttgaagatggcaagaacttcagtcttgatgatgccctggacagcagcaactccatgcaaactatccaaaagaccaccacccgctggatagtggatggcagagtggtgtctgagaccagtgacaccaaagttctgagacattaagtcagcagaagcagggtaccctttggggagcaggaggcccataaaatgttcagaggtcattgggggaaaataggctattcagttaaaatagttatctgatgactgaaatttttttaatatgtcaggtgtattgaggtataatttatacagtaaaactcagtcttttgggtgtgcagtttgatgagttttgacaaacatacacagtcttaaaaccaccaccacaatcagaatatttccattacccccaaaagttcccatgtatccctttgtaatcagtttcctgctcctactgcagcccgaggcaactagatctggtttctgtctctatagtttttccttttctagaacataaaaatggaatcatatatagccttttatgtcttttttttaaatttagcagaaagcttctgagattcattcatgttctatgtatcagtagtttgtcaatgactgaagtttaaaattgttaactttggtgaagctcttacgaaagagtattatcaaaaaatagtactttgaacagtggtagatatttctctcagattttggcagctgccttattattgaacattttacttgctcatttttacccctcgacccccaaattttacttacctgtttaaccctca

SEQ ID NO: 114821 - DNA, 1028 bp, Homo sapiens
ttaattcattcagtagattcattgtgtttttcatatagaatacacacttcctatgaatattattaggtcatttaaatgctcccgtttcccactattgtgcctgtggtctctttttactatatatttttaacctcttgatgataaacagttgtggcttttcaaacggtgtatatcatttcgaggtattatatagtaaaattagcatgggatctaaactgctattagccaagtggcatttaggccaattcttaacccaagcccatgtcttcaactgtaaactgaagaggttctcagcttttgagatttcatggactagtcagaacaaagcaagaaagtgcttttctgcagaaataaagtggtaaggatattgtagattggaatgtaaaaagaaaagtaatgtctaggtaagacccattacttagtcttaatatttgaaatgtgaaatacccagtgtgatgtgaacatggtcatgatctcatattcattctcttgtacatcaaacactgagtgattcctatgtcttttctcaggagctattaaggcattgcagatggtgaaataaaagacttcaggccgggcacggtggctcacgcttgtaatcccagcactttgggaggccgaggcgggcggatcacgaagtcaggagatggagaccatcctagctaacacagtgaaacctcgtctctactaaaaatacaaaaaattagccaggcacagtggcgggcgcctgtagttccagctgcttgggaggctgaggcaggagaacggcatgaacccgggaggcagagcttgcagtgagccaagatagcaccactgcactctggcctgggcaaagagcgagactccatctcaaaaaacaaaaaaagaaaaagaaataaaagacttcagcccacccatattatagtctaatacagtttatagacaggtaaacagagattatgttacaatatctaagtgctatgatcaagataaacaaggtgcagttggagcactggtggtaggggtggtcacctaatttagactagtgt

SEQ ID NO: 114822 - DNA, 3762 bp, Homo sapiens
gggactgtctagctataatatctccactttccaaattaggaaactgatgcttacaaagaatgtgacttgctcaagagatgagagaaggaagtcccatgagcaattcagtcaacataattacaatgaatgtatgctctccttaagtttagttagactcctgacctccttgaggtcagggacttaatatgtttatttctttaattctagtaccaagcacagcacccagcatatggcatatgctcgggttttttttgttttgttttgttttgtttttttaataaagaaatgaagttgcgagaggctgattcattagctttagctgtaagtcttctggagggaatccataccaatttcatttacattgcatgattttttttcctttgccttggaataccgcttggcaggggacctagtaagttcctgttcattcttcaagttccagcgtaattccatcttttctttgatgccttccttgtctcttttaggcagaattaattgttcccttttctatccactccctttttttccccagcctttattttagattccagggggtacatgtgcaggtttgttacatgggtaaattgcgagtcgcagggggtttgttgtatagattattttgtgacccaggtaatgagcatagtacctgacaggtagtttttgatctccacccttctcccaccctcaagtaggctttggtgtctcttgtttccttctttgtgtccatctgtggtctatgtttagctcccacttacaagagataacatgcagtatttgatttttttgtttctgtattaatttgcttaagataatggcctccagctgcctccatgttgctgcaaaggacatgatttcatccttttttatggctacatagtattccatggtgtatatgtaccatattttctttatccagtccactgttggtgggcatctaggttgattccatgtctttgctattgtgaatagtgctgtagtgaacatacacatccatgtgtctttatggtagaatgatgtatattgctttgagtatatactcagcagtaggattgctgggttgcatggtccttctaagtccttttttttttttttttttttttttttgagtcggagatttgctcttgttgcccaagctggagtgcaatggcacgatcttggctcactgcaacctctacctcccaggttcaagtgattgtcctgcctcaatctcccaagtagcggggattacaggcgtgcaccaccacacccaactaattttgtatttttagtagagagggggtttccccatgttggtcaggctggtctcgaactcctgacctcaagtgatccacccccctctgcctcccaaagtgctaggattacaggggtgagccactgcacccagccctaagttctttgagaaattgctgaactgttttccacagtggctgaactagtttacattcccaccagcagtgtataagcattcccttttctccattgcctcactagcatctgttattttttgactttttagaatagccattctgactggtgtgcaatggtgtctcattgtggttttgatttgcatttctctaatgattagtgatgttgaacatttttttgatatgcttattggcggtatgtatgttttcttttgagaagtgtctgttcatgtcctttgcccgttttttttttaatagagttgttttctgcttgttactttgtttagattccttacagattctggatactagacctttgttggatgtatcgtttgcaaacatgttcttccattctgtaggttgtctgttcactctgttgatagtttctttggctgtacagaacctctttagtttaattagatccagcttgccaatttttgtttttgttgcagttgcttttgaagtcttcatcatgaaatctttgccagggctgatgtccagaagagtttttcctaggttttcttctagggtttttatagtttaaattttacatttcagtctttaatccatcttgggttgatttttgcatgtggtgaaaggaagaggtccagtttcagtcttgtgcatatggttagccagttattattgaatagagagtcctttccccattgcttgttattttcagctttgtcagagattagatgttttaggtgtgtggctttatttctgggctctcacctgttccatttgtctgtgtatctgtttttgtaccagtactgtgctgttttggttactgtagccttttagtatagtttgaagttggatggtgtgatgcctctggctttgttctttttgcttaggatttctttggctattcgggctcttttttggttccatgtgaattttagaagttttttgtttgtttgttttttggttttttttcctaattctgtgaaaactgtcactggtagtttgataggaacagcaatgaatctgtaaattactttgggcagtatgaccattttaacaatattgattctttctatccatgatcatggaatgtttttccacctgtttttgtaaactctgatttttttttagcagtgttttctaattctcattgtagagatctttcacatccctggttagctgtattcctaggtatcttattcctttgtggctattgtaaatgggattacattcttgatttgactctcagcttggacgtcattggtttatagaaatgctactgatttttgcacttcgttttgtatcctgaaactgtgctgacgtggtttatcagatctaggagttcttgaatagagactgtggggttttctaggaataggatcattatcatctatgaggaaagatagtttgactttctctcttcctattcagatgccttttatttctttctcttgcctgattgctctggctagggcttctagtactatgttgagtaggaatagtgagagagggcatccttgtcttgttccagttcttaaggggaatgctcccagcttttgctcattcaatatgatgttggctgtgggtttgctatagatggctcttactattttgcccctctttttaaactttaatatattagtaatacctattattttcatattgtaattatctacttcctctagcctgggaattctttataggtcggggaggggacagtggtaggctttatctaactcatcttagttattgtcagtctcaagtatgatttctggcacttggtgggtgctcactaaatgtttgggctgaatgaattcatataaacaagctaaaaatagacttgtagataaatgatggagaactttatttaaactttgtcttctctgaattactgtcatttgctttgtgattttaggctacttcttagtttatgagcaccatttctcaaggctgcattctttaagaaatattaatatttgaggagatactacaccatccaaagattgccgctagtattttctaagatgttttttagggaaaaaatttaagaatggagggaagaacctaatcagtgaaagatgtgatcataaataagcagacagatttataggaataaacaggttaagaatttgaatatagaaatatagaaaggaatatattagattaaattatagagtcctaaagtagagtgtaagccagaattatatgtgctcttacacataccacatactgtataggattgtttatgaggttcagttgagataatataaatagaagtgctcgtaagtaggatgtttgtttctgcaaaatgaattttattaaatatttagtgtactgtagataaagtgattcttaagaatttttaaaa

SEQ ID NO: 114823 - DNA, 1012 bp, Homo sapiens
ttaatcttcacaacacccctgcaagactgtaatacatgttcattatggaaaattcagataagcaaaaagaagaaaaataaaagttacgtagataccagaaattaaaataatatttatttataagtttaagactccaagtgaagattaaagttctaaaaggaactaaagttatagcttcgggagtattatatgcattttcccaccttaagtaaagaaaacaaaacattgtgggagtaatatgactgaaactaaaatgtatttacttagaaaagaccagaagaaaatgtcagagcatacagtagttgcattagggtgacaggattataacaggcactttttccttttatctgcagtccacaatatttataatgtgcatatgttacctttacaataaaaatttaaaaaccttagtcttctcagaaatgccactgaggaaaaggtctgaaagttaataataactaaactaaataaatactttacaatttaaatgaaaatcatcaagatggacaaagaataattcacacaagtgaaaaatggtaaatgaacaactgaaaagaataaatcaaatacagctttggtaaaatagtaaacagctttacacaatagtaaaaaaacatgcagctaagcaggtatctatcttttccaaaaggaagtattttagagctaacaaccaatgctgacaaggcacagcaaaaccaatatatttgttcatttctggtagtagtatgcatccttttgaaaggtaatgtgattaacacaaagattcataaatatttaatggcaatagaatacaaaaatactatacacactccatctgtcactatgtaacatgtttacatgctgaaagacaatcttttggggaaaaaactcttttttgaggataaagagatgagattaccgagtgctttagtgtttgcttaaacattctttaagtcttcttaacttaaaaaaagcaaataaccaaagttaactttacatatgatagccctctatcaagtaagtaaaccacatt

SEQ ID NO: 114824 - DNA, 1025 bp, Homo sapiens
ttccttcatttcttcctttagactgcacagttgcacttgcagtaaacccttcctcttgaatccctacccaaagatattttgaaaaggatctagtaactaatggggcaataagcagcactatcatcatgggcaccttaggctcagaatttgtcatgttttaactgtttctctgtctttgctcccatgtcatcttcagttgttgggtccaacttgcacatcttttccatatacctttattgttcttcctgtctttatcctagttcacttcatacctagattattatagtagcctgtgaagctggtctcttttcggcttaagtatttccagccgtggagagtatacctcaatgaaaatattgctgtagcaatttgtacctctttactctataatttattttttatcttacctttttttagtggtggagtaagaaggtaaaggtaaagggagatataggagctgatactattgtgtttcagtactggtgatctattgctaaataattatataagcttgcatactgacccaactcttctagaagggagagtgttaacaaaactaggagagagattgtagccaaggtttaaaatggatatatttatgggagaagcctgcttagtgaattgtgttttagggtaggaattctgaatgagtaagcatgtctgctctttttctaatatctgttaagtttggggctattttattccatgtcttttatcttcccttttagaaatccctcagttgaattaagaggaaaaaagatcatttaaaaaaatatctagactagcattgtatgaatgaagactgcagaaatctgtagaaacccgctagaaattggtcagttagtaaggtgtatccccttgatagcaatttctcatatggaggatgtagtagggaggtcatagcatctggagagctttttcctaagtgacagtcatcacattctgagatggcatcccacttatcacctttctccctttgagaatcagttttaatgagtcattattactaagggaatgtgttttat

SEQ ID NO: 114825 - DNA, 1074 bp, Homo sapiens
catgtttgtgcttttctctattgattatgggaaattgttaagacaaaaatcgcattcactgtatagcagctggtttatcctgtggttcttctctttgcaggcaaacttactaagtaaatggaccagaataaattattttcataatctattattattaaaccctgtattagtcagaatgggatataatctcagttatttaatacaactagggtttattcttgctcacattacttatccaacagtttgtcaggaaatagatctactccatacagtagctccagaaaccacactgatggaatttctgacagtgtatatctgtacacctggaacattagtcctccacggtgaccaccacatggaaataaagagctagaaggtcttctgttggccgttaaatatttcagccatgaaatgacacccaggtcattcaggcactcacaacctagtaaccagaactagttaccttaccctactggtaagtgtctgggacatgtgggaagcacaggttgtttggtgaactgtaaatgtgtctgtcacatattgtacttcatctcaagaaatatgcgtagcctttaaacctatggataatggccattgttgccataattctgcctattaaattgtactaaaaaagtgttacaggccgagtatctctaatccaaaaatctgaaatccaaaatgatccaaaatccaaaactttttgagtgcctacgtggtgccacaagtagaaaattccacacctgacctcatgacaggttgcagtcaaaactttaatgcgcaaaagtattagagatattgtataaaattacctctgggctatgtgtatggggtgtatatgaaacataaatgaattttgtgtttagacttgggtcccatctacaagatatctcattacgtatatgcacatgtgccaaaatttgaaaatccgaaatttgaaacacttctggttccaagaattgacactcaacctgaatcactttcagtgacaaacagtggctttcctcttatatattgactatttctcacataatccatttttatttattactttcaaaactatataataaatgtaaa

SEQ ID NO: 114826 - DNA, 1127 bp, Homo sapiens
tgcacttttgagtgaatgaattcctgttttaaagtggttaaggattatatttgcaagttccaagttatctgtattctactaattgtcctatagatgacattgttataatttgttcactcacattgttgctttccactaagatctgttattattatctttaggattttcttatttgttaacatgattgcttaagtgattaatcaaactaaatcagataacatagaactcaatgaatatagctcttaactttggataacagctattttcctcttgaactaatatccaaatttttgatctttaaatgttacaactgcagtaagcatggaatattattgaaataaatttaaatataactgtttaataaattattaattatggatgattaataaaatgtttagtgtgttactgaatgtttcttgagaaaattttatatcagtttaaatagttttgtagcttgtcagcattacagaattttttatttttttattgtgtcattaagtgtagtggttaagaacataggcctggagtaagatttgaattcatattctgattgtggtctttattagctgtgtgaacttaggcaaattactgtaacctctttgaaaaggcttccatttctataatagtttgccagctggtttggtcaggaacactgtattgtcttgtgtataggtgtatccacaatgtctggtaccttgtaggtactcactaaatttttaatgaaatgaatgataactgctttggatgattgccatgaaaattaaatgatgatatgaatgtaaagcagctagtaatgtacatagctgacactaactgctgttattatcaacagtgacagaaaatctccagtctagctaatacaagaaatagatttttcctcagactctcatctcacattcccttttaagatttccttgtcctatccccaccccagacgtttccattttgcttttattttctataataattcctgggggcctctattaaaggcctttttctttgactacttacatccattataccagtatctttgtcagtaaaattttatatatcttttattctgtcatcaggttaagaaacaataattgtatttttaaaggaaaatattttacgatgctactaagcag

SEQ ID NO: 114827 - DNA, 1045 bp, Homo sapiens
aatactttaaaacactcttttctagtatatcatatctccaaatttaatatttattgtcttttacacttattttacatacattaattcattactttttttttttttgagatggattttcactcttgttgcccaggctggtgtgcaatggcgtgatctcggcgcactgcaacctccgcctcctgggttcaagtgattctcctgcttttgcctcctgagtagctgggattacaggcatgtaccaccacaccggctaattttgtattttagtagagacggggtttcaccatgtttgccaggttggtctcgaactcccgacctcaggtgatccatccacctcggcctcccaaagttctggtattaaaggcatgagccaccgcgcccagccagttcattaatttttaaaataactctgaggtaggcactattatcctcactttatatttgaggaaaccctcaaagagactaagtaaataacttaaagtctttcaactagtacgtggcagaattataattaaaaacctgtttttgccactattgcatattgttagaaggctgtttcttcttgaggctgagctaagagaacatatatccatcctacgtaacttacagttcccattgtctgttcatttgcctatattctactcacatttcctgctttccattcttacttatttctgtccaactagaccaagaacataatattctataccctgtctcccaaacttctaagtcatggatttgttttaacctcctgctatgctcatttagctaggtatcatttatgaatattttcttctcattttcgtacccattctcaagtctaattcattgatgactcagtcacgtcagtagtttctccattaccatggcaataccttcctgaatatgagaataaacatatatcctgacttaattcctttggctcactctgtgaattctttaccacttttgaacactgtaaatgtacctttgagaacttctttgttgccagtttgatttaaaaacaaaacaaaaaaatgttactgactgttccagttatctgttg

SEQ ID NO: 114828 - DNA, 1050 bp, Homo sapiens
atttgttagggatctattcagagtttctatttcttgttgagtctgttctggtaatttgtcttttgaagaatttcctttttttttaatataagttgtgtaatttgttggcttaaagttaatattcccttttaattctttctttttttatttttttgaaaaggagtctcactctgtcacccaggctggagtgcagtggtgtgatctcggctcactgcagcctctgcctcctaggctcaagtgatcttcccacctaaccctcctgagaaactaagaccacaggtgcatgccaccatgcctggctaatttttgtattttctatagagacgaggtttttccttgttgcccaggttgctctcgaactcctggactcaaatgatctgcccaccttggcctggaaagtgctgggattataggcatgagccatcacaccgggccttcccttttaatttctaaagtattggtagtgatttcctctccttcatttctgattttggtaatttgtgtctgttctctcttactttcctgatcattctatttaagacattgtcaattttgttgattattttttaagaactaatttttgaattcattcgtatgtctctggttttttttttttttgtttatttttacttttatctttatttttttcttcttcctgtttttgattttgtttacactttttctagtttcttaaggtatggaagcataaatactgattcgaggctgttctttctaatatgggcatttaaagctataaatattcctataaaactgctttagctgtatcccatgaagtttaatatgttgtgatttcattttcatgcagttttaagtatttaatttctctcatgatttcttctttgacccattgattttctcagatttctttcggttatgggttttaattttattcttttgttgtcagggaacaccctttatatgatttgttgtaaatttaatgagatttatttcatggtccagcatgtgatcaattttggagaatgttcttgtatgcttaaaaggcattgagtattctgtggtctttgggtg

SEQ ID NO: 114829 - DNA, 1910 bp, Homo sapiens
gtcctacaggattttaataccatatttttactgtaccttttctatgtttagatacacaaatactgttgtgttacagttggctacgtatacagtacaataacatgctgtataggtttgtagcctaggagcaataggctataccagtagcaataggtgcgtagtaggctataacatctaggtttgtgtaggtacattctgttatatttgcacagtgatgaaattgcctaatggtacatttctcagaacgtttgtccctgtcattatgtgacccataactgtgtgtagctcagaggtcaaagttatattaggaggatatgcccagaattctcactaccatcccattttaccttccttgtggataaccatttcatgactactttcaagtttatcttgacctaacaagtaagtctgattgattaacctcatcttaatcatgggacaaaaacaagcagactcctcaaagttccatatttaaaatggtgataacgagacttaactcattggattatattgaagattaaatggaaaaaaaaaaaagtaaaacaactagcacagtgcctggcacatagtagatataatttccttttttcccttctgtacctcataatataggctatgtattgcctacaattagggaggctaatcagtttgttcacatatagccttttctttctataaaggagaatttgtgatatattaaacaggcattataaaatattacccagaagttttatcaattttttggctttcagctcctgaaactatagatagcatttatctatagttagtagcactagttttaaaatttggaatcttggtcctctcattcatttatgtattacagcagagtcagacttattttaaaaacaattctaacctgcctgaggcttctgtctagaagtggaatgtattttgggtaagcttcttaaacttcataaaatcaccttctcatttattccttgccttaattaataaaacatgtacttctgctcttaatgaccttcagccatatactcttgacattctaaatttttctaacacccaattttgagaaaatgtattaatagaggactgactaaaggttggcattctctgcattcctctgaatatttcaaattttacttttaggttaaaccataccgttggagatctgtgtgcatggattgcatgattttgacctcttgttaactttgcatttgctggattgtactttcaggatgtgatttttttttttcccaagaaaagagaagaaaaggagaagttgcctaaaacagatctttagtttttttaggaatgctattaaggaccttctccattatgtcatccaacgtctttctgaggacttactagtgaaattactctcagatttctgcatcttggaaatgctgtacttctgaacaactactaattcacttttattttatacacatattttcttctttgccttactaacaaggagacttaagccttattttaggaccaactcttggagtttggagaacaatgtgtgtttctgtgtgccatttttattttcgatatcaaaatgtattgtttgccctgaatctttcccctgtttatttttagtcatatgtatgcatcagaattatctgaagcacttattaaataccagctcccatccctgaaaaccttgggttcagcgggtataatagattgcattaatagcaccggttgtttgccatgtgaccacaccatttaccccctgctcctaaaggggcagattatatttccttgccccctgactttggatttgctcataggacttactttggttttagtgggcgtgacatgaccaaaggcttgaatagcactggcaggattaggcttgtacttttgtgcctctattgtctccaaaagaccatgtccagcctggcccactggttccgggagaa

SEQ ID NO: 114830 - DNA, 1050 bp, Homo sapiens
caatattctattgtatttctgcatcctaacaattaacaattggaaatcaaaaatttgtcaattataataacatcaaaaatgtgaactacttaggaatgaatctgaaaaagtatgtgaaagcaccgtagaccaaaaactagtaaacattgctgagtgaaattaaagaatatctaaattagtggagacatataaattgtttgtagatcataatgctcaatatggttatcagttctcaaattgttacatagattgaatgctatatctatcatattccaagcagctttgtagaaactgacaagatgattctaaaatccatatgtaactataaaaaaaaaaccctagcatcagaacagtttgggaagagggaataaatttgtactaaagcagagatattgattagataattggatatgagtctagtatatgggagaaaagtcagatttagagatacaaatttgggagccagaagcacagaagcactattttaaaatcatgccactgaatgagttcaacagtagagtacggagaggaagataaaaagaaccagaagaggatcctggagtggccagtttagtcagcagaaaaactaggagaatgtgttgttctggaagacaaagaattattcaaggaggagagaatgatcaactttgttgatttctaggtcaaatcatatgaggtgagaggcttgcccactgaatctagcaattttaatgtaattgctaactgtggcaagatatttggtggaatggagaataaaaacacatatggttgtgggttccaagagaaagtaggagaagaattagggatgaatataaacaactgagggaattttgctgtgaaagggaacagaaaaattaagccattgttggagagagatcataggggtcaagataaatggtggggtttttttgtgttttgtttttattggaagtagggacaattatttgcatatatatgttttatgctgattggaattattcaatatgtggaaaaattgatgatgcaggagagaggagaattgctgaaacggtatttttgaatgagttagag

SEQ ID NO: 114831 - DNA, 1029 bp, Homo sapiens
atctgtaattttcattcaatggtttctttccattaattactgagcataagttggaactttcttattagcataaatttaggaaaaattcattgtgttttggtgacctttatcagattttaaattccaaccaactttttaaagtgcttgatgtgactactaactatgcagtgttgcattaaatttctttagtaattgttaaataatcaaattaataatttcaaagagtagaaattagtaatttcacagtgtagcaaatggacaaatatagaatagctagtagtgattatagctttcctatattatttcctgtgccttttcctttcagtgggcttctgctagaaattttgtcagtcattcaccaaaggaaagtaatgttttttcccttagctggcaattagtaaagaatgtacatataaaggtctttaaactgtaaagaaaaaagaggaaatgattaccacaaagacaagatagttaatacccctagaaggaaccagaatgctagccttttggatgatgattctatggatgcttactttataactctgttaaactgtgtgtgtgtgtgtgtgtgtgtgtgtgtgtgtgtgcgcgcgcgcgcgcgcgcgcatgtgtgtgtgtagcagtttaatgtacctttgtgcaataggtcttatatttataataataatgtttggggtgaaggaaattcttagttttaactacccgtataattatacgttaaataattctatttgcaatgttgcattcagacataatgagtaagggaaattatcagtattatgtcatttgaatgtttgacgtttacaactcaaaaacttaagaggttctcttaaaagtgactgactagcaaatacaaccttaaaaagataaatatttaagttttttaaactggaaattacaattccgtttttaatcttagctctatggtttagttgatgtagacttccatttgctgattaatttataaagtaaaagtcacttaatgagagcatatctttgattaatgcgtacattgttaaaatattatct

SEQ ID NO: 114832 - DNA, 1051 bp, Homo sapiens
atttatttgtatattcttaagcttttaaaaaacgttacttgtctactttatgaagagtcagatattgttatttgtttgtatgagcgtactattgattctgaaaaatcttataaacaagaacaaatgagattaatgaattgctacattggaagttagtttgtaaccatgcctttttcgctagtcatttgttaataaaatttaagaaatgaaaagcaaggatgaatataagggagctgaattttattcctagagactagtataatctattatggtccaagtgatgttttggaagttttgtagggttgattgaggtttgttaggaagaggaggaatgccttttaataatttgtcacattgatatttataacttacttttaatcccaaaatacagataagcactaaagagacttctatagtcactcaatttctaataatctgattttattccaaatagtcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatgtaagtatgatcaattttatatctactataagtgaaaagttttggccttactaagagaatccgtattcctggttttatttcagaaatttttagatacatagtttattttttaaaaatatccatatccgagggagaatatagtcttattgcaataatagattaatgagatttaagtaggcaatatttatttttagataataattctgacccatgtagctctatggatattttttcagctcttttgaacttatcttgggggatccatcatttgtgcagagatctggtcatgaaactatatccctgtctgggcgcggtggcttacacctgtaatcccagcactttgggaggccgaggcaggtggatcacgagatcaagagattgagaccatcctggccaacatggtgaaaccccatctctactaaaaatacaaa

SEQ ID NO: 114833 - DNA, 1047 bp, Homo sapiens
atttttgataattatatttctcccagggatagcatatttgaaaattcataactgttgggtcagccacagtggctcacacctgtaatcccagcactttgggaggccgaggcgggcagaccatctgaggtcaggagttagagaccagcctggccaacatggtgaaaccctgtctctactaaaaatacaaaaattagctgggcgtggtggcaggcacctgtaatcccagctactcgggaggctgaggcaagagaatcacttgaacctgggagacggaggttgcagtgagctgagattgtaccattgcactccagcctgggggacaagagtgagacttcgtctcaaaaaaaaaaaaaaaaaattcatattgttggccataccagtgtgatttacttttatatgataagtcttcttaagaatcagtcaccattttaatttttgatacttattttctcaatgccagagagttgaaagataaccttggcagtgatgacccagaaggtgacataccagtcttgttgcaggccgtcctggcaaggagtcctaatgttttcagggagaaaagcatgcagaacagatatgtacaaagtggtgagtttcttaataactgaattcccatatcaaacttgttttatacatatttaaatccaggtgtcttctttaacaagctggcctatcaggaatgcgatgtttatgccttcagtcaagccaagaacaagaaggaaactaaactgataagattcttgtagtttaatatgtaactaaattccttgagaattagacaaagctttaagtgtattttgttaaatatgttggaatatatcagtttactcagcttaaaaatttttttgttttagaaaatcagaattaatttgaaataagtctttcattaattaaataaatatttgcaaagcttttgaacatgtacattgtagcaggtatatagagttttaatactgattgtgattatattcatggttttctagtaattgatttaatactcctgttgccttagcaacagaaaaattggttaagtattattattaaaga

SEQ ID NO: 114834 - DNA, 1026 bp, Homo sapiens
gataaaaacccggcttctgaaagagagaaaaacttccagagtaactatttgtaggttagatacatatcccacaagtgttgtcaaggtgagaagttatttagattgccggggaaagagaacagggagataggtgattgatctagataactagctttttttcttctgactcttgagattagatagataaatagtagatgaactttagatagaaatggaaaactttaaaacaaataacctcactaatatattattcaccaaaagcttgaacttctgtcatgaagttgttttctaactagttttgaagggtaagtgcattgtcagtctatcttgatttttagattaattattagaatttgaagtttgttctaaagtgtatataatttgccacatagaatttaaatacaaaggcataatggtatattacaattcagacttagacaaatcttgttttaaatcttcaggtttgttaactacataaccttgggcaaatttcttaacctctgtaggcttcatgttccatttctgaaaaattttaaagataatactcaagaatgttgtaaaaatcaagtgaattgatatgtaaagcacctttcacaactctgacacaaaatgttagactaacatttatagttaattgctcccatatcatctttatcacactagagtcaataaataaagttgtatgtttatatataacatttaaaatacattaaccttgctaactgaaagtccagatttatgtatcatggaaaaagactgaaagcttaattgaaggcagttctaggtttaagttctgtctgtaaaaaaacttttatcttgaccaatttttacaatttcttacaagtttttaaatattttatagtttagtgataagaaatgtatacattattcagatgcagttatactattatttctgaagcatatcaatgcactttttccttcatgtctgaaggagaatttttgtctgaaggcttattaactaggataatttttccatctgattatttttaacactttcctgtttca

SEQ ID NO: 114835 - DNA, 1644 bp, Homo sapiens
ccagtttttgaagtaagtaaaggctctagtaattgtaaattgaccacttgctttttgttatcatcccagtagtattcatgtaagatagtctctaggattaaattgttatttttgtgtaatttaacaaaagcgtacttattcttactttaatcaggatatatctgttttcccagatagtccatgaaagaacagagatggtcatacccaaaatatttgtgttgtatcatctttagaagcaatgaactttttacccctataaagctaaatatgtatactttataggcacaaaaatatagaaataatactggtctgaaaaattgaatactcatacttagattcaaacctagattttagattaactactagcaagctaaacaactgtgtgggacaagtttttaagctttcttttcatctttcgtaaataagtagcttggattatataatttcttatttttttctagtattactatattgtcacttattaatatttctatcacattgtaagaaaatgtgaaaccaccacaactgttacttctatcgaattatttttctaggctcaagaccacctttaatcctacaatctcagtctctaccttgttcatcacctcgagatgttccaccagatatcttgctagattctccagaaagaaaacaaaagaagcagaagaaaatgaaattaggcaaggatgaaaaagagcagagtgagaaagcggcaatgtatgatataattagttctccatccaaggactctactaaacttacattaagactttctcgtgtaaggtcttcagacatggaccagcaagaggatatgatttctggtgtggaaaatagcaatgtttcagaaaatgatattccttttaatgtgcagtacccaggacagacttcaaaaacacccattactccacaagatataaaccgcccactaaatgctgctcaatgtttgtcgcagcaagaacaaacagcattccttccagcaaatcaagtgcctgttttacaacagaacacttcagttgctgcaaaacaaccccagacttctgtggtacagaatcaacaacagatatcacaacagggacctatatatgatgaagtggaattggatgcattggctgaaattgagcgaatagagagagaatcagctattgaaagggagcgcttctcaaaagaagttcaagataaaggtaaaataatctcattattaccacttcatcatctgggcaaatatgtaattatagtgtcaaaaatttttttcacattacttttttcccgaatattttgtataatttatgtctactcaagtacatatttttattactaatactcataatgcagaagttaaattcgtaacaatttcatttattgtctgaaacaactatatgagatttggtaattctctactacaggtctgttactcattatgtactatatgattttacttatttgtgcttttctgctaaaatgaacattagcatttctatataacatgtatatttcacaagttacattaatattgttgtgcaccttcaaatttttttctgctaaaacaaggttaaccactgtagaattattttgaacaggtacacttaagaaaagctcatgtgtatgcttattaggcagttagatatttcacttggtttatgatcc

SEQ ID NO: 114836 - DNA, 1038 bp, Homo sapiens
gcttaccattgtgttacagttgcctacagtattcagtatagtaacatgctgtacaggtttatagcctgggagcaataagctataccatatagcctaggtacatagtaggctatatcatctaggtttatgtgaatatactatatgatgttcacgtaacagagacacctcctaacaatgcatttcgcagaatgtatcctgttgttaagcaatacatgaaatacatgaccgcatttgaaaacttttggaacttagatgccacctaacccttttgatttgaacttggcatattgcattcagtttctgcattgtgtgatgggatggtatttgttatataagaagttaccttgagattttgagatgattaaaggtgtgtatattggtccaagggtgtaggtgaggtcataaataaaagcaaaattcttctgaagtggtggttttagagcccttaagagatgaaatacttccttgaaattaatttgtcccagttaccattatttttacttattaaagactaaatgttaaagtggacatttaatatattcaaacatttggcactgaggacttttttacaactgttgtattactactggtgatatggagcaggcaggactatttgtctggcctactagttgcactttaggatatgagtttgtttgccaatatattcgtttactgtgagagaaatattccactcaataaccagaaatcaaaaacactgtaccttataagtaagattagaaagttcaacaaatgtagaatatttgtggaattcaagtaaagggatagaataatcttaagaaatgttttacctaggctgtggtagaccctattgtacccttgttccgcagaagaaagacatttttctagccgctaggtatttatgtccctttgtcctgttctctcttctttgagcagttctgtatatacgttgataaggcaactttgtaacctaatattttataatattccaaaaggacccttttctcaatctttttgctcatacttttagtgtctctaattacataaattaattttaaa

SEQ ID NO: 114837 - DNA, 3418 bp, Homo sapiens
tgatagatttgactggacaactgaaggagcagaaggacttagttttacaaaatataactaacaaatatcttaagtaaattgcggttatatttgattagattttaaactggcaagaactgctacttcccactttaaaaagaaaacagtggaactttgctatatagaagaagcattaccattaggaaaaaaaaatcacaacttggttctctaacaataaggagccatttttcagttgtcagtttgacttttaaccttgtgataccatcttccttatatgatatatcacattagtgaatattgcaagagaatctagagattgccttgttaaaataaataacagtgacttttaaaacatactcaagcaattcagcaaataaacaaaaggaagccaaacctcaaggtgctataatgtaaccattcccaagacctaactggagatttaatttatagaaaatgactagctccctcttaagtcagaaatggaatcatacacagaaatatatagatgttaaaaataccttcacattttattgtaatggtgaatttgtgtttgtgtgtgtgtttgtctttacatttcataatactgtaaattatttctttctgagaccagaatggatcccagaacattataactttatatcgaagagtaggaactgtttccttcagtggaagttgcttaagacaggattctaatttatacctattgctccctgattttaaattttctatacctatgaaatctgttgcttccttattttaaatttacttctatctaacattgtggttaacttttaaactcctttcacacttttaacacttcaaagaatttgaattattgattaaagttaaatgacaaattattaaattctttttttaaattcattttttcccaatggcatggtatatattttctttcttttttttccatacttatcttagatacagtaaaaacttatatttcctgtttggtatattggcagatttggagctctttatggtttttggctaacagttaaaagtaacctgagtgagactttatgatttgtaactggttgctttattattaggaaaagaatctgatttatccgtgacatctatgaacataaatatatgtttgtatttggtacattataagttctattcattttatattcttacacttatttatatccttaaagagtatgcagttaaattctttttactatatttattgagatctctcaagcatatttcttcaaaccttacctttcaaagtattgtgtcattcatgcttactattttatgtgtacatatttgcatttgcattttactccattttaaaaacataaccttaaaaagataaacaacgtccatagggtttttaataagataagaatacatgtctattactgatattgatatttatctttaaatttcagataagcctttgaaaaaaagaaaacaagattcttacccacaggaggctgggggtgctacaggaggtaatagaccagcttctcaggagacgggttctacgggaaatgggtcaaggccagcattaatggttagcattgatcttcatcaggcaggaagagtggactctcaggcttctataactcaggattcagactccataaaaaagcctgaagaaatcaaacaatgtaatgatgcacctgtttctgttcttcaggaagatattgttggaagtcttaaatctacaccagaaaaccatcctgagacacctaaaaaaaagtctgatcctgagctttcaaagagtgaaatgaaacaaagtgaaagtagattagcagaatctaaaccaaatgaaaaccgattggtggagacaaaatcaagtgaaaataagttagaaactaaagttgagacccaaacagaagaacttaaacagaatgagagcagaacaactgaatgcaaacaaaacgagagcaccatagttgagcctaaacaaaatgaaaatagactgtctgacacaaaaccaaatgacaacaaacaaaataatggcagatcagaaacaacaaaatcaaggcctgaaaccccaaagcaaaagggtgaaagccggcctgagactccaaaacaaaagagtgatgggcatcctgaaaccccaaaacagaagggtgatggaaggcctgaaactccaaagcaaaaaggtgagagccgccctgaaactccaaagcaaaaaaatgaagggcgacctgaaacaccaaaacacaggcatgacaataggagggattctggaaagccatctacagagaaaaaacctgaagtgtctaaacataaacaagatactaaatctgactcacctcggttaaaatcagaacgagctgaagccttaaagcagagacctgatgggcgatctgtttctgagtcactaagacgtgaccatgataataaacaaaaatcagatgacaggggtgaatcagagcgacatcgaggggatcagtctagggttcgaagaccagaaacattgagatcctctagtagaaatgaacatggcattaaatctgatagttcaaaaactgataaactagaacgaaaacacaggcatgaatcaggggactcaagggaaagaccatcttctggggaacaaaaatcaagacctgacagtcctcgtgttaaacaaggagattctaataaatcaagatctgataaacttggttttaaatcaccaactagtaaagatgacaaaaggacagagggtaacaagagtaaagtagacactaataaagcacaccctgacaataaggcagaatttccaagttatttgttggggggcaggtctggtgcgttgaaaaattttgtcattccgaaaatcaagagggataaagatggcaatgttactcaggagacaaagaaaatggaaatgaaaggagagccgaaagacaaagtagaaaaaataggattagttgaagatctaaataaaggagctaagcctgtagttgtgctacaaaaactgtctttggatgatgttcagaaacttattaaagatagagaggacaaatcaagaagttcccttaaacctatcaagaataaaccatcaaagtcaaataaaggtaagaatacttctactgatgtcatttataatataatcgattttaagtgttaagattactaagttttaaaaaggaaatttacaaaaattagaaagctactacatgaaaatataacatttatgtcaaacaacaggaaatttttttcaggagtatagataaaaagtttccagtgaatttttttttccccacagtttttttcttcccacccactactcaaggtagttatgaatgttactgctatttggttacacagagataagttattttgctgtttagttatttcttatatttctgaaatatgcttaagtgaatgttgtattaaaatagctgtctttaaaaactctctatttaaaaatgtcttacaatactacatt

SEQ ID NO: 114838 - DNA, 1940 bp, Homo sapiens
atagagaaggaggaggagtggtaagtgtcttccaacacttctcacttgtattgaggggtaacattagattcaaactacttcagacctacacaaaacaaaatttatgtactaccaagaatgtcaagtgtacctcttaccacaaatccacttgctaatgtcagtgaatctctagtttcagaaagtttttagtcagtgcaaattgaaggcattatatcaaaaatgtattatataattacccttcatttttatggtggtgtcatgtttttaaagtcattacataattatatgtatatatgtacacatacatatatattaactatattgtcactttagggttaagagtattatagttgtgttttattaaaataaacagttgatttagaaaacaaatactaatatttttattatgctaacttagttaaaattttccttttatcttcagatttacattttttttttaaatttacctttcattaataggtagtatagatcaatcagtgttaaaagaattaccccctgaactcctggcagaaattgagtccaccatgccactttgtgaacgtgtgaaaatgaacaaacgcaagcgtagcacagttaatgaaaagccaaaatatgctgaaatcagttcagatgaagataatgatagtgatgaagcttttgaatgtaagtatcacagaactctttgttattattttagagtttaaaagcaggttgatgtgtttttctcatttataatttgggggtttagcaaaagcacagtcaccttaattcttaataacacagtatagtaagtttttttctctatactttaaaaatgcgtgaaagatgagatcagttggcaccaagaaaaaaatattaaataagctacaattaattttaaaacacaggtaggtatgtgtctgtatgcattcagcaaacatttattgagctcctattatatgctagacactgagagtaaaaatgcaaataagatatggcccctgtcttcaaagagccttcagtctaatgggggaaatatgtaaataaataattgcagtatgctgataaaagtacaatgataacagtaaatccagggtgctatgggaacacattggattggcatcaaaatcagagtgggggctcagggaatgcttactggaagaggtgacacttgagttgagtcttgaaggacacgtaggagatagccagatgaagaaatatttaaaaccatactatcactaaattatgaatggattagccacattgcagattatctgtgtggtttggacctggcttctcctttttgcccagctgtgtcctggaattcctcccttgtttcactgttttccagagctggcttcttcactacacagctacctctctacaacactgtgatcacctgtctttgcactagacttgctatacctcgcctgtcttcctactggtccactgaaaaagttcttctcttttatccctatcttccttcttctggagcaagagaattgagcctagccaagaggggtcagcaaccttgtttgacttaaacggcattcagtggaaacagactatgggagatcttcacttgtgtgccaactgacttagtcataatgaccaaaagaagtgggaagaccaccagtgttctactttttccacctagtgtccatagattgaggtgtgacaagcaagggcaggaaggacagatgcatgctgccatttttaaatgtatattgctgatggaagcccttcacctcctccaaagtttttaatgttaatttactgatttttttttaattgtgagctcttgagctatgagcagtagactatgaatactgaacaaatctgaaaaaagttttaaaattgaaataaaatatacagcaaacttaacatttaatcatgtataattgttataattgtattatgaaatgtattgacacacagtatattaaaatggctaaagttaa

SEQ ID NO: 114839 - DNA, 1108 bp, Homo sapiens
attcttttccccttgctttctatcatgaaagctattgtctcatcttatggaggcacatagcttcgttataaagccatggaccctgttatatctatgcccaactatatcgaaaggtaatatttattttaaagaacctaagcttcacacactgctagaagaaaggaaagtttctctggatttttaaagagatgtcaggagtagcttcctgtttttcttcacttatttctatacaagtaactatagaaaagtggacactggaggcaccgatttgaatggtgaaagaagtccaaatgattgttcacataaacaaccaaatggtcacaccacaacagaaacagtgtattgaaaatatagcacaatacaaaatgtgaaactattatgagaacgttaagttgcaagcattatgctgctgagagagagaaaaaaaaatttttgaaacttagcagtttaatcaaattggtttctcaaaatctaaaaccaaggaaatagttttgttgaaggttaggggaaaatgttgaaggataattttgaaagttggggtacacagatttggatggccatagcacaaatataaggtcactgggtgcctggggaaaatggagagaggggtgatgtaagaagctcaagagatacataggtgaaatttggaaagagaagatagagaacacccaagtcatgttttacgtacctctcttttgagtcctttcccctcccctgcttattccagggtaatgagagaaatggagaaagaataagctaaccacaatgagttggtatcctaataacctcattataacacaatgtgttatggaagttgttttttttttaatttgtcaccccatttttatctaaattgtctaaaatttgatgaatgtgaaataaagatttacaagatctgtggatagttaccaccaatacagcatattctatgtaattacaaaccactataagattcttcaagcattttctactcataggattgaatgcttgaaacagatttgttatgaaattaattaaaatgtacaaagactaaagcaggtcatattcaaggttgtaaaatactaatttctggcgcagtagctcatgcctgtaataccaacactttggg

SEQ ID NO: 114840 - DNA, 2679 bp, Homo sapiens
aattcatacctaattatgaagaaaatctcagatatttatatccatttacatttgtgctttacatgaacctttttgctatccaagcctgtgactgtaaagaagaggaaacaaaatgaccttttcctgccatgttgtccatagattagctagaagagtccagaaccagaaaccaacctagattcttgaacaggagtagttagggtagcatttaagaataagattagacagagtatagacatttattacccacacatgaagacactggcacaagcatagagtgcctgggccagaggttggcatccttacatctaagccaagtaggggacttaagcaaaacatttgtcttaagtatttgtgtatttatcatagttagggattcagaaaagagcagttgctagtcaaataacagactagaaagtttatcattgtcagcaacaagtgatcacaacaacaaccagtatatgatttcaaggtaggacacatcacttctctgccctggttttaacttggtggtacctactgcatcctagaacagacatggtaaatatttgtcacttatagtgccccccagctcttactgcagacatttctaatcagtctttcttgctgaactatgatgctttctcagggcttggggttattttcagcataatgttctaggcagctattgccagttgatgagagttgatgtgttagatgaaatctgtttgccaggtctgcctaaaggctcctgtcagtacgggtgattttagcagaatgctaaaatgatggggaaaagattgaaggtaacatacataatcatgcttatgaagcgtgcataagcttagaaacttttcttgggtttaagcaagacttttgttgaagaactgaattcattatgtgagtatttacaactgtacaggttttttctgtctcagtaggcttgtcatgttaggtcaccagggcttatggaatttatcgctgagttgtgggtttaacttagctattaattgatgatgtacatggttacccatattctgtaacactttctcaaaagttgacttttcctccaaaccctgctccccatcagtaatctaagtgctttaaggtggttctgtttttcatctaattcctaaatatagtttgttttacagcctcaattaatcttgaagtttaggtataacccttactgacttactgaataactgtccttgaagtgaacactgtagtttaatttcaagaaccttcctctctgtatttattagcagtaaacactgagttcatgtaaagatctttaaatctgggtagattgtgctaaaattagtgatactttttctatatcataacttaaacttctggatagacaaaatcactgaatttcctagaccctatggaatgaagatttttttccccatgtgattcatttgtaaagtacaagttttaatcatctttttaaatgaggtaaattatttgtcatggggatttgcttctagcctctaggaaacgacataaaaaagatgatgataaagcttgggaatatgaagagcgtgacagaagaagctctggggatcataggagaagtggccactctcatgaaggaagaaggagttcaggtggtggtcgttatcgaaaccgaagtccgtcagattctgacatggaagattattctcctcctcccagccttagtgagggtaattcatcagtgtcaacggatttcttacataaaccaatttaaatttagggctttaactttgaagaatattttatatctttttatgagttaataactaattttcaattaagacaaaaatacttagtttctatgtgcagtgattatcgtttaagtctttaacgttcaggaaaaaaactagaaacaaaaatggaattattttaagttgtcagtcctgcatttcagtacttctttttgttcgttttagttgctaggaaaatgaagaaaaaagaaaaacagaagaaaaggaaagcatatgaaccaaaactaacacctgaaggtaacacgttagtttatttaatttgtctttattcatattcttcagcttcacatgtctacttgtaatgtgagaataatgaatatatttttctctcttgcagaaatgatggactcttcaacttttaagagattcacagcctcaatagagaatattttggataatttggaagatatggattttactgcgtttggtaaaatcaacttaaaatacatttacacatactctaagtgtcttaactgtatcctctagagtaactcagttactctagtgatgtgtcctaccttgaaatcatatactggttgttgttgtgatcacttgttgctgacaatgataaactttctagtctgttatttgactagcaactgctcttttctgaatccctaactatgataaatacacaaatacttaaggcttaactcagttactctagaggatacagaggcatactctgtgctatcaagaaacttgaaatctagttgtaaagtcaaatctagtctgttaccaagaaattaaaaactttagtacaaaactcaagtatatattaatcaagtctggatagtatctaaagaatcatgagtaagtgagagtaatttaaaaagtctttatgcaggtgaggaggcttgaaaaggccctgtataatgaaggtactgataggagcatatatgcagaaataagcatctattcttctgtt

SEQ ID NO: 114841 - DNA, 1046 bp, Homo sapiens
tcatgtattacttttacaatgacataaagattacatctataaatattaaaatgtttataaaaacactgcttgcaatgtatagagctattcttaacaatcttatgccaccttcagctggtaaagtaagtatttgttttgtgagaattacttgcctgagtatcattgtgtttgctgattatttagaatgtcagtttcatcttttttaaaactttacagttctgtgctgagaaattgtcttctgtatcatttagggtccaaaagtacaaagggcactctcaaaataggataatatgaggaggagttatttacaaagagaccagttaaaaagatggaggcaaaataataccagaacccagggttaacagccttaaaccaaaagagtgaggatacagaaaagtcaccagaactcattctgcaggaaaaaaagttgtagagtaggctgccttgaaagaagcaataccttttggtcaggggacagagccagcctgaggagaccttgtaagcaaagagtaagagatataaatactttgaccttacactcctctttgatcttctaacagggcaccctactggccaaacccaaacaaaagccagagggcatgggagactcttgatgtagtccattcaggtcagcctcctgaggcagagaatgtggttgagaaagagtcaagagtatatctaaagtagtaaagataagatatctatctcatcttcccatttcagtcataaatctgacttcaatttctgtcctttttcattcagggtttacttgaggtttatatatagaggcgtcttaggttatttgtttagtttgcatgtctaaaaattttattagaaagttaagcttgacattttgaactattttatttacctaaactttgtttgtgtttgtttggcttgattttgcaggtgatgatgatgaaattcctcaggaactgctcttaggaaaacatcagcttaatgaacttggcagtgaatctgctaaaataaaagcaatgggtataatggataaggtatctcaccaaagtaaaatttataaatttact

SEQ ID NO: 114842 - DNA, 1004 bp, Homo sapiens
gtgttaggaatgattgtcaattttagtactaagtaagattttaccctttgtcattaatttttgctttgttatcacagcagcaagcagaatttataaagtctttaaactatcataatgtttatacccaaaacacaaaattaatttatatgcagttaaagtcataagctaaatcttaaattcggataaagcacacaaaggatataaagataattataactttgtcagtagggtgtcatctagtggtgaaatgaggtagagtatatcacgtttgaaaacattgaaacacaaatcgtgctcaaagtagtatcagtatttgtacctcattctggatattcttaaaagaattaacacacatcataacacttttccaccagtgaaaatcaaatcataattttaatgtatattttaaacctataaatgtgtttatttccatttcattaacaatactgttttacagaataacgatactgaagaagaagaaaggttatggagagaccttattatggagagagttacaaaatcagcggatgcttgtcttacaactatcaacattatgacatcccctaacatgccaaaagctgtgtacattgaggatgtaattgaaagagttatacagtacactaaatttcatttgcagaatacactttatcctcagtatgatcctgtttacagattagatcctcatggaggttagttcgtataatatcaaaattattgtaaatttttgccatgttagatgagtcaaaataggacttaaaatggcaccaaaatttttgaatcatataacttgtaataaacactgattttgattatggatttgactagaatatagtacttgttcaattataatttctttaggaacatttatatataatagaagttatttctacttgtcagggaaaatctcagaaaatactaccttctggtttcatttatcacttcgccctaattttacccaaaatagcagttgtctacaaaatggattgattcaagataaatactcc

SEQ ID NO: 114843 - DNA, 1042 bp, Homo sapiens
gctcactcaataataagaccagcactatattatcaagaatttttcctgttaagagtatgttatatctaaatcgaagaaataaaacttcaggagttttaaaaagacattttatcaggagacaaacaaatgtagtgtaaattccaaactctaaattctttgaaagatgggttatattttcatgcagatattaaatgtttgttatttctttatattcctgtgacatttgtaaactcaaaaagtagagattagaggactgatagctatgatacaatgtacctgttgtatatgctaacgtgctttgaggatgaagggaaacagagaaaagaatagatgctgattaggtggggaaaagaaaaaatgctttcttagtgttttccagtaagcttatgaatgtattggaatttagtaagatagaatgttactgaaatcaactaaaggtgtatactacttactcttcttttttaaacaggtttcatctatgggaataacaccattttttgtggaaaatgtcagtgaactacagttgtgtgccattaagttagtcactgcagtaagtataatcaatttgtatttttagttaccccacaaataaaacaatattgatgtcatttaatccaaatttccaaaaaataatgaagatacctggttttcagtacattcatttcaatctaaggactattttactaagtcttattagactttattaattgaggatttatttttctgtttggttaatttgttgggttattctgtttttgtcacatttaaaacacttccaaatatttgcaaatatttcagctaataattccttgatatttataataaagttagaatggtttaaaatcatttaaattcttgtctgactgcctatagccaagatttcatagtcctttaaatgaaactagtgtactctttgacttctataagaatgttataattaatgataggaaaatagagcagcttaccttagatactgaaaacattttcattctaaatggcaggtaattttttaaatcacatgatattattttttggtttgttt

SEQ ID NO: 114844 - DNA, 2075 bp, Homo sapiens
agttaattttggaagaaatttttacttcacttgcaagattaccaaccagcaagaggagtttaaggaacttcaggtaattaattataacagaggtcaagtttaatgaagaaccaccattatattgaaccgtcatacatttattcttcatttctgtctgatttatattttaataattaaaaactaggcagttacatcagaacagcatgaaaaatagatgtgtgaaataacatggcatatttagggggcttagaaaacttcactgattctcaagggtaaagatctgtggcagggtttttcagtgttggcactgttgacattttaggccatataacactttgttatgcatagctgtctagtggaatacagcatgctcagcggcatccctgacctctacccattaggtaccaatagacacccttcctccttccagttgtgacaaccaaaattatttccaggcactggagagcaaaatcattccttaatatgaaccactagtcagtgagaagatcttgttcatcctgttggaaatatggctcaaaataatcagatcagttcaaagaggattttataagatttttgtgtctcaaaaaaaaaaataaaaaacagaaagattaatggcagtatggagaataaacatggggattaaatgctctttaatcactaagcacactgttaataaggagtgttacccactgctatggtcagcattattgtctttgccatcatagataatcaccggaattatcttaatattcctgagtgattaaaagtgttgacgtggcatataggattgtttttaagattgctttgaaggcttctttcttctctaaaataattattttatcttaatcattttttggactaattgtatactgataaacatttattgtctgttaaacctgaagaaaaactatgaagaaaaactatcaacacataaaagaatccttagattttttacaatatctatagaacaaaagatgtggaaattgattttttataatctgtgctaccaacactagcatagatgatcaagagctgtgtagcagattttaataccaaatgaataacagattcagcagatgaatagcaaaatatatgggcatttggaaactttgaagacttttatcattttcaaaatcattttgagaaatgtttagtagtagtatgaatttttatctgcaatgtatgtaaagcatacaaatttgtattaaatactgtatttttcctttgactattttaattatctcagcatgcataggcatttacttgatgtttttgctaacttacaacaaataattacacataagaacacaataagcactaagatcatgcctagaaatattggcaaacacagtatcgtgaaactttcagacaatagatgacatttaaatgagattatcttgatactccatacaaattttttttcttcattaaaggttaaacagtagtgatatggatggagaacctatgtatattcagatggttacagcactggttttacaacttattcagtgtgtggtacacttaccatcatcagagaaggactctaatgcagaagaagattcaaataaaaaagtaaggaatctattaaaggttttacaactgtacttttattgaaggaaatacctatattctctgtcattcttataaaactgaagttctttttttttctttcttttttttgagacggagtctcgctctgtcacccaggctggagtgcagtggcgcgatctcggctcactgcaacctctgcctcccgggttcaagtgattctcctgcctcagcctgctgagtagctgggattacaggcacgcaccaccacgcccggctaatttatgtatttttagtagagacgggttttcgccatgttggtcaggctggtctcgaactcatgatccaccctcctcagcctcccaaagtgctggggttacaggtgggagccactgcgcctggccaaagctgatgttcttaattagaggttcatggctgggctttaaggtccttttagagcactagacatggtgttggaagagttgagttctggttctgttgtatctatcagtcataaaacatat

SEQ ID NO: 114845 - DNA, 1266 bp, Homo sapiens
tccgtctgcaatcccagcacctcgggaggccgaggctggcggatcactcgcggttaggagctggagaccagcccagccaacacagcgaaaccccgtctccaccaaaaaaatacgaaaaccagtcaggcgtggcggtgcgctcctgcaatcgcagctctcggcaagctgaggcaggagaatcaggcagggaggttgcagtgagccgagatggcagcagtaccgtccagcttcggctcggcatcagagggagaccgtggaaagagagggagagggagaccgtggagagggagagggagagggagaaggagagggagagggagggagagcttaatctttaaatttctgatgaaggctttgaatttttttttttgattgtatggattatatgtttcttaaactttgaggttgacatattttttctaaattctttttttattttcaatccatttctttctgttctgaccaggattatgataaacaactattgatattaaatttgttaaccacatatgttactcttacattattttaataacactctatctgtatttttatttgtttctataaagttttaaaatatgcttagtgtgctaattttggcttctcttattatatataatgtaatagtttaagcattttagtatttaaatatattacccctcttcagtaataacatgacaatagcaacagggctaacttattatttcttgtatctttataaactcactttttttcattctagattgaccaggatgttgtcattactaactcttatgaaacagctatgcgaacagcccaaaacttcctctccatcttccttaaaaagtgagtaaaattaatataaatctggtttttcttttccacagtatagagaatagttcatttttttaaaaagatgaatccaatttcctgccataatctgaaccttgaatacatcttcctgacacttggtttcttgatctttaaaatgaggcaattggagtattaaaaatctaaaattgggatgggactacacgggggaaaaaaatctaaaattttgtgaatttgcttatatgttagactccagaaattaaagtactagattgaaattctgtaatttgtcttcagtaaattttggagaattttcctagtgtacctgaataggaaagtttgtgaagagatgttatttagcctccatatgaatttttttttttttttaatgagacagagtttcgctcttgttgcccaggctggagtgcaatggcacgatctcagctaactgcaacc

SEQ ID NO: 114846 - DNA, 2027 bp, Homo sapiens
gcctgtagtcccagctacttgagaggctgaggcaggagaatcgctggaacccgggaggtggagggttgccgtaagccaagatcatgccactgcactccagcctgggtgacagggtgagactccatctcaaaaaaataaagaatttatggtgatcttttaggtagaaaaacagtgatcatttttttaaatgtgtttcacttgcgagaaagtagtattagtattgcttaataaatgaattccctataattaaggagaaagtggagtttgtgaaatagactcattttaaaccatattttatttaatgtacatttatatattttgttactaaacatagaaaaaagaaaacttagctaacaatttcaatcatgttggtagacagatgactgacatgtgtcacctaaattgacatccttttcattatttgcctttgaacagatgtggtagtaagcaaggtgaagaagattacagaccactgtttgaaaattttgttcaagaccttctttcaacagtcaataagcctgaatggccagctgctgaactactccttagtttgttagggagactgttggtaagagtatagcatttaaagattattagattactagaagacaacataatgaggatgtactctgattcacagatgatgaattctttaaaaatgtgtaaggaaatatgaacattgcatctctttttgcatgtgcataactgtacacaatattgtcagtaccttgtagaaaattttcaaatgttgtgaagtttggtgctttcatttcattacataagataacagtgctttaacaatttttttttttttggaaatgttatattgttaaaagcatctcaacactgagtcataagttactcatttcaaagcaagaaaatgattaatatagactccttatcatctttaagagtatttctacaaatgtatggcattttgtagtcgtcatgtaacacagtaggtaaatgcaaagaaatgttgtgactctatttttaaactacatttgaacttgcacaatacacattgttacaaagcttctgggacctttttgtgaatgggaaaatatgttaatattattcggaaactataataacttttcataggcatcagaattccaccctaagaaattcttactcagtaataccacattttgtgcaaataatacagttgagcctgcatatttaatgagttgtgttgttcttaaggaagtttaatctgtaatttttttagtcacatgaaaatgttcagattccagaaaatcaaaaggcaaaaatgactttatgggacaatatcacaggaaaaaaaaaagtttaaattttaaattatacaatttagattgggaatttatatgataaattgctatttaaaatatattgttataaatctattcaatcaaaaactattttgatatttaggttcatcagttcagtaacaagtcaacagagatggctttaagagtggcatctcttgattaccttggaactgttgctgcacggctaagaaaagatgctgttacaagcaaaatggatcaaggatctatagaacgcattttaaaacaggtactaagataaaagattaaaattatgggaatgaataatagttattttctttgcatgtccttacattagttttgcatttcattttgtgtggattcaaaataagatttttacttctaaaagtgggcttttcaaagccccagtgagaaattttaagacctgagaatgaattatttagtctaacagggacttctgaatggttcatataaatcatttactttctttttgtgaagtactcttaataatgtataatgctgttttatatttgatttaacataaattttatttaagtttttaatttactgaatggtgatttagcatacacaataagattgttttgtacttttgaatgttttgtatcttctcataccaaggaggtgtgaggagagcttttttatactttattacattagagagttttcatcttgggggaaaaagtgttttattgcttttttttttttaatgtggat

SEQ ID NO: 114847 - DNA, 1024 bp, Homo sapiens
tacacctgtaatctcagaagggtggattatttgaggtcaggagttcgagatcagcttagccaacatggtgaaaccctgtctctactaaaaatacaaaaattagccaggcatggtggaccatgcctgtagtcccagctactagggaggctgaggtaggagaattgcttgaacccaggaggcaaagattgcagtgagccgagatagtgccactggactccagcctgggcgacagagtgaaactccatctcaaaaaaagtaaaacaaaaaaggcaaacttcagctatcaatatataatatttttcggaaataatatttttctgttttttccttttagttactgtggttgtattttcatttttaatatcagtttttccttcagatttgtgtttacaattaggtgatttattaaagcacaccagtaatatcttttttgttcttatttggtttattctataggtttcaggaggggaagatgaaatccaacaattacaaaaagcattgcttgattacttggatgaaaacactgagactgatccttcactagtggtaggattcttttcccctgttttggagatactacatgtttatttaaattgggtttaagaaaattgggaggtagcatgatgaagaggaaaacttaagttgtttggaatattgattttcaaaacaaagggatacttgataatctaaacagaaaagaatgctttgggttgatttgtcttatatggaattctggttacagatactgtactgtactaaaattgtgtgacaagagaaatatttggaagtctctccgtaagtgatctttgaggctaggctaggtcattggttctcagagtgagtatgggccgagtggtacatgagatgatctataagcctgtaaaaataaactattggatttttatatgtatatttttaaatataattttacttctatttcatgtatgttacacaatgtaaccaaaatattagtataagaggttcatgtacaaaatttataaactattatttgagaacattatac

SEQ ID NO: 114848 - DNA, 1421 bp, Homo sapiens
gcaaaatttgaaaacagatgaagtcttctaccttcagcattttatcaatttgttttaaactttcctagttgacccatcatctgtttaactttgtcatgatgttgtccttgattaagtagttgataatagtattctatatttaatacagttgtgtttatcaaattatcttgacttcattaatataagtattggaacatagtaaaataataagttttctaacatttaggatattctatattttctggctttcttaaaatctgtttttatcacatggaagttgttttaaagtaaactttaatatttgtattcctgtaatgtgagcactctaactttattaacttggaaatcttgttgctaatttcatcaagctcaagtctgtctaatttctttccagttttctcgtaaattctatatagcccagtggtttcgagacacaactctggaaacagaaaaagcaatgaaatcacaaaaagatgaagaatcatctgaaggaacacatcatgcaaaggaaattgagacaactggccaaattatgcatcgagctgaaaaccgaaaaaagtttcttagaagcattatcaaaaccacaccttctcagtttagcacattaaagtaagatccaaggagaaaacagtttacatttatctccttgatatctatttccctaagttacaaaaaaagaaaaataaatttttaatgactttttgttgcaggatgaactctgatactgtggactatgatgatgcttgcttgattgttcgatacttggcctccatgaggccgtttgcccagagctttgatatttatttgacacaggtaaactggataagaattccttatacagtgatattgatttttctgattctggatgcttgtgagcagtatataatatcattcattgttgagtacagatacttaaaagatcatagatgtagtatttgtttttaggttctccggccgggtgtagtggctcacgcctgtaatcccaacactttgggaagccaaggcaagtggatcacctgaggtcaagagttcgagaccaacctgaccaacatggtgaaaccccgtctctactaaaaatacaaaaattagcggggcgtggtggcacatgcctgtaatcccagctactcgggaggctgaggccggagaattgcttgaacctgggaggtggaagttgcagtgagccgagatcgtgccattgcactccagcctgggcaacaagagggaaactccatctcaaacaaaaaaagaaagtccttgttctacatcccttttacatattcttgttttacaaatatatatttgtatgaatgcacacacatacagtatcagtagagtaagtgacattataaaaacatccaactaaatcccagcactttgggaagccaaggcgggcagattacgaggtcaggagatcaagaccg

SEQ ID NO: 114849 - DNA, 1032 bp, Homo sapiens
gcaggagaatcgcttgaacccgggagatggaggttgcagggagccgagattgcgccactgcactccagcctgggcgacagagcgagactccatcccaaaaaataaagtaataaaatacaaaacattcaactaccaaattatgatttgaatgatactaaatatctttgattcaagttacacatagcaaggttttaatggggctacaggttctgcaaatgaagcaaaacaattaaaaaacaggtttaattggataaacgaaaggctccaaagtatggactatacacttaacacctgtactgatttttaagttaaactttgaatcattaggaaagatcctttactcatttatatacagattaaagagaggtaaataatagatttgttttcttttgcatgttttcatgctatttttaattaaattttatgtattctaaaatttacaaaaatgtcaatgtttgcttggcagatcctacgagttcttggtgaaaatgcaattgctgttcgaacaaaagccatgaagtgtttgtctgaggttgttgctgtagaccccagtattctagcaagggtaaagagcaaaaatgattctttcttttctactcgaattggaatattcactctatttaggtataaattgtttttttctcttcatttttctttagcttgatatgcaacgaggtgttcatggacgattgatggataattcgactagtgtccgagaagcagcagtagaattactaggtcgatttgtcctttgtcgacctcagcttgctgaacagtattatgatatgctgattgaaagaatattggtatgtttgtcatttttataatgattcgtgaatataattttgcctttcaagcatcatgttttgttttaaagtgttaagttagaaaaataaatgtaccaattatatatttatattgtcaaatttatgaactattgccactttctaaacaagtacatattttcaagaatagcccttgcaatatcataaaacaaatcattggtaataattggattccttttttcagttg

SEQ ID NO: 114850 - DNA, 1035 bp, Homo sapiens
gcagtgagctgagatcgcaccattgttaccccagcctgggcgagaagagcaaaactccatcccaaaaaaaaaaaagaagtaaccataagatagtgccaaaggtttgattagattcaggttaaacatttttatgaagtctacttttaagtgatacttcatgtgctgtttaagtgccagacactattctaaagcttatgtttgttttctcatttaattttgacaagcgtatacttctagtcttgtgtccagggcttaactataaaatatgtttctatgtcttagatatcatactttaaaagtaaagacaacataaaaaaataacacatttatagtagcagaaagcatgtaaaaagcaaatatgtcaagtgtgtttatcatgttaacaaatagtgaatatactgcgtatggatacttattttctaatttcatacactaggcatctcaatttttctgactcttaaaaatacctttctgtttttaggatactggtatcagtgtcaggaaaagagtaataaagattctcagagacatttgtattgaacaaccaacatttccaaaaatcacagaaatgtgtgtaaaaatgattcgcagagtcaatgatgaagagggcattaaggtagtgttgactgttttaaatttatttttcattaatgtttaaaataagttaaatgtttattgcacctaaatgttgattttaaatatatccaaacactttacaatgaatcgtttatagtttataaacttaagaaaaatacatactttaattttttttgtttctagatttttatattaagtattataatctgattttaaccaaccaattcctcagtggtaatatttatttaagactggccatagtagctcatgcctataatcccagcactttgggaggccaaggcaggagaatggcttgaggccaggagttggagatcagcctgggcaacatagtaagaatcctatttctataaaaaataaaatgatgaaaataatttttaaaaatttcaccaaacatagtagagcatgcctatagttcca

SEQ ID NO: 114851 - DNA, 1027 bp, Homo sapiens
ctatacttcataaatgtgtacagctattatgtatccataaaaaaaaaattttaagtttagtcctaaattcattagtaaatttacatttatatataataatatgtataattgtcccttttttttaagtttagcaaacactgtaacaacttcttctccaaaagcagtaaatatattttttagtttgatcataaacatttgagtgtatagtatgaagaagttctaggctagggatagtatcacccattcgtattgtttaaaatctttaccaaattgaaaatttttatagttttgagaaattagtagttttagaaaaaactgaggaaattaataccagaaattcctggcagtttgtgttttgattagttatttatagctttgtgttgggcctaatgagaatttggaattgtgaaattgccgtatttgttataattagttaatttgaaatttctcttccttctagaaattagtaaatgaaacattccagaaactctggtttactccaactccacacaatgacaaagaagcaatgacaaggaaaattttaaacattaccgatgtggtaagaaggactggaacaagggtgtggtcactgttgatccagacctaattgaggcctacatgtcttatgaaggaagagacaataatgagatatttcattaatcttgacatttcgtactgctgcctttactttatatttctggagatgctgaagggatgcaagtaacatgtcgttgatgcttccatatagccctacttcttggcattaattgatgtaaacactgatactgagattttcctattcctccagcaattaaaaacagggagggaaaggagaaatggaagaacagatacaatcgcccaagggtaataatctgcaaagatagtaatgcctacttttttcagaaattatgaatatggattagctacattttttattatgcataagctatacattttgtgtttttaatataagaaatttttgccagtcacagcgcatatgcctataatcccagctgctcaggagtct

SEQ ID NO: 114852 - DNA, 1046 bp, Homo sapiens
ataggcactacactccagcctgggcaatataatagcaagatcccttctcaaaaaaaaaaaaagaaaagaaagaaaaattctgtatattcaattacatcatcttctacatttctattgatgtctttaaaatgtgccatctagaagcgtaataagaaaaatatttttgttcttaatgtttaagatattacagattttcctcacagagtgtagttcaagttattgtgccattttaaacttatgccactttaaacatttagtgccatattaaacctcaatacattaaactaatttcttcaatgttttccaagatattttttagaataaagttctgtaacgttggtaaatggttgtgttactgaaaaaatagtttactttaaaaataaacttttgaattgagaaaattgaaacatgtttcaggctaaagcataacaaaagtatattttattcacatttataaatatacttctaactttgattcttttcatcacccttaggttgcagcatgcagagatactggatatgactggtttgagcaactgcttcaaaacgtgagtgttcttttgactcctgataacctaaaatttaataggttagttttttgttgttggtgtttttttttttttggactgtatgatttaaaagaacctttttagttcttttggtagggaaaatttatttcaatatgttaggctggatgattttgttaatttctataattaattcagttgcctggttgtggtttttttttttttttttttttttttgaggtggagtctcgctctctcactctgtcgcccaggctggagtgcagtggcacaatcttggttcacttcaacctctgcctcctgggttcaagcaattctcctgcctcagcctccagagtagctaggattacaggtgtccaccaccacactcggctaatttttgtatttttggtagagacggggttttactatgttggccaggctggtctcaaactcctgacctcaggtgacctgcgtgcctcggcctcccaaagtgctgggattataggcatgagccactgc

SEQ ID NO: 114853 - DNA, 1071 bp, Homo sapiens
gattttgcaaaggataatgcagaaaagaaatctaccgttatgttttataattgccttttaaggtgcaattcagatgcagttattaattatttaaaataattcaactagtattatgtgatactgtgtttttgattggaatagggagaaagggaaggtcatcttttctacatctttcacgtattaccttaggtcttacacagcaatttaagtactttgtagtaaaattgtttgaaagtattggtaaattactggtttataagatatttttaaacatatatatttttgttttattaatttgcactttgagtattaaattgttaatgacaaattgaaaagtatgttacttatggacacttttaatgtgtttatattattattgcctaatgaataattataccgggatttttttttcttttttgtatatatatatgtatatatatatatatatatatgtatatatagttgttgaagtccgaagaggattcctcatataaacctgtgaagaaagcttgtactcaacttgttgataacctagttgagcacattcttaaatatgaggaatctctagctggtaagacattttatatatatattgatctttagttgattttataagatatttttaaatattttgagtaaatttctcatttttgcctctggctctgcttgtctaatgattacttcacttttaaatgaaatacatttttgttatataggtatctgtttgatgttgcatcctagattatattaagattgactaagattatctagagcattgtaataaaagcatgggcctcacctctttcacatatcttttaatagcatattataattttagatgtcatattgaataggagtaaaaatccaggggctaatatgtatctagctaatgatactcatcacaaaactgatatctcctaagtcatataaaattatgtctcaaaatgaaattgttttagctattataaaaatgttttttaaagatttatattacattcctaatatttattatttataattgttacataaagtttgcttaatcttgagctagaaatttattaaaatgtttaa

SEQ ID NO: 114854 - DNA, 1012 bp, Homo sapiens
acctcggcctcccgagtaactgagactacaagtgcacatcaccacaccgggctaattttttatttttctgtagagatgcagtttttgcgtgttgtccaggctgatctcagattcctagactcaaaccttcttcctgtgatggcctcccaaagtgctgggattacaggtgtgagccatcacacacagcccattgattttagataaaaccaatacgacatttattcccaaaagcccattcctaagcttcccaatttccattagtataaaacttgccttctatagagagcatggcctcttgttctttatcttgagtattatttctatatcaaagaaaaaatgagatggagaaagtctagtatcataagaactactaattcattatattgaggcctatactggacctatttaggggataatattaagtaatttaaataatattctgtatagtttccactaccttgtcatattttagtgtcttatttctctgtttgtttttccagactctgacaataaaggtgtgaattctggaagattggtagcttgcataaccactttgttcttattcagcaaaataagaccccagctcatggttaaacatgcaatgactatgcaaccataccttaccactaaatgtagtgtaagtatagagctgtcttattcttgtatcttacataaaacattaagtgctttaaatttagagttcacatgcgtcaaccacattctcactgacagatcaactgtgtcatttacttagatatatgtactatttgtagcaagtgatctataaacatcaagtctgacataaataaagttcaggttccattttgctgtaaactcctcaagccaaaccctcagtagatgcttactaaatgttatagctattgttaagatctcaaaatgaatgaagcagagttcctctctttgagaaatttactatcttttgggtcctgaatttacttttcatttgtctgtcatttataatataataaatataaaaattgatacccattgc

SEQ ID NO: 114855 - DNA, 1640 bp, Homo sapiens
tctactaaaaatacaaaaattagccaggcatggtggtgggcgcctgtaatcccagctactcgggtggctgagtcagggggttgcttgaacccgggaggcagaggttgcagtgagccaagatcatgccactgcactccagcctgggcaacagagcaagactctgtctcaaaaaaaaaaaaagacaattaaaaaattaaccgggtgtggtattatgcgcctgtagtcctagctactcgagagactgtcaggaaaatcgctcaagctcaggagcaggattgcattgagctgtgattgtgccactgcactccaacctgggcaattgagcaagactgtgtttcttagaagtaaagaagccttctgcctggttctgggattctacatgtttatctgtcatagaaaattttaacacagggtttctcaacctcagcactattgacaggactagatgattctttgttgtcaaggattgttctgtgcattgcaggttgttaagcagcatccctggcctctatccactagatgccagtagtggctcccattgtgacaaccaaaaatgtctccagatactgccaaatactcctgtgtcaggatacgggggaagaagcttattcctgattgagaactactgggttaacatacacagtttggaaaatactaatcgtaaaaactgtaccagtctttgtataatgctgtcaatatgtaaatacctttgtttagaattgacttgtgttacattttagggaaaaaatataacattgtgattaagtgaccccaaagtcacattttggtaagttagttgtcggtacatattcctgacatgctggtgcttctccttccataccttgaaaaaaaaactctaacagacttttttttttaactggacctttacgtgcaaaatgccctatttctgcccccaaatacgtaaagctgtatatagtttcttttcaggttttggatattcataaagcattaattttattcttatagacgcaaaatgatttcatggttatctgcaatgttgcaaaaatcctagagctagttgtaccactgatggagcatccaagtgaaacttttcttgccactattgaggaagatctaatgaagctcatcatcaaatatggcatgactgtaagcactcagtttaccatttctttattcattagtgtaaagttctaatgtattttattaaaatttttaaagcaaatatttgtaaaaagctaagtttttaaaatagtatatttttaacttttatctaaacattttctatatcttttaggtagtgcaacattgtgtgagctgtcttggagctgttgtaaataaagtgacacaaaattttaaatttgtgtgggcttgtttcaatagatactatggtaagttcaataccagggttttaaaattattctgctaggtcctgcagggggtcagctcattttaaacacatttgataaaaggctagactcgaggaaattatgaggtgtgattatccaccgtggtcctctcagaaacaatattttctagtgtcttttgtatttcctgaagaacccactgtgattacttcagaaatttatctcctgataagtaaagattggtaaattttttgcgcactgtgaaaagtaaaatttaaattttcttacattagt

SEQ ID NO: 114856 - DNA, 1030 bp, Homo sapiens
gacaagttatatcagttttgtaacagtagcacactgttgacatcaacagctgactttttaaaaaaaatttttttcaatgaaggaaacaatgcactgatttacattccgaaacaagcttctttgtcacagactgatactttgaatgccactgttctaaaataaatggaattggttacttatttttttaataaagttcacacaaattctcattgttttaaggtatttttttcctttatagttgaaaattaatctaagttactgttcatgaacactttaatgtgttttcctccccttaggttaacataaaagataaagtacttgaactattgatgtattttacaaaacactcagatgaagaagtacaaacaaaagctatcattggtctaggtaagtctaaatttctttataatttgtagctatttgagagggatagagcatatttttaaatattgtgaatctaaattgttgatttactttaatatgtttctattagcagtaggatttggtgtatagaatgtaggtctgaggattaaaacaactgggttgcattcttgtcatggccattgacttcctgggtaaccttgagcaagccatttgtctgttcatcagtttcttcattagtaaaatagagataacaatactttcttctacccctcctccatagggtatcttaagaacatttattaaagccctttgataaagaaaaataatatagaagaattctgtgctctttgcatttttttaattgttctttttcattgcaaagctttgtcactacaggaagctgccacatctggttaaaacaatgatcagtctacactgacttatttatataaaagcaaatagtaagcaacccagaaggaacaatttggatatatacctgttttataatgtttttccaggaaggattgatgtaataaaaacatgttttgcaattgttaggcaggtctatgtggcttatatctaggaaggaattagaatatgaggaaataggaggtgaatggcattaaagtacctgaattgaatgcac

SEQ ID NO: 114857 - DNA, 1498 bp, Homo sapiens
ttcagtctggacataatttatacggagtggcaaaactaatagtgttacaagtatttcagagtacaaaaagatgaagttttaacttaagcagcgctattcagaaaatattgcctctagaccagttaataaaagacatcttgcctgggccatagttatcctgagtgaccttgggctagttatctgatcactctatgctttgagtttagtttgttgtttgttaccaataatacttgctatcatcagagatcttcattttttcctcaaataaacattatatacaaataaacatggatgatatattgctacttattaacccgtggttataggattcagcattgtggccttattataatgccatatgaaaaagaaatggaagatatttttagctctggtttattatattgtttcatcaaatgaatatattttaattttttttttaaaataatgtcaatgtagtaccttctgctggggatctgaaaaatgtttgcagacattatttcttaaatcctgaaaacatccctgtgaggtaggtgggtggtaaatattattatccccattttacagatggagaattgaggcacagagagattatgtgactcacccaaggtcacactacaagtcagtggtggagccaggaatagaacccaagactcctgactcctaatccactcccctagccactaggccctgctccctcctcaaggtttcctcttgtgtgaaattctcctttgaaatgcaatttcttgtttttaattcatggggaaagaagtacctgctctaatgcttctctaggtaaggccaccagcatattcttccagtcattttaagttttaattttttgaaataaggagccgtttatataatttattaacatatttattaaatgttttatttaattttaatatgaatatatgatgagatttttcccctctcccataggatttgcctttattcagcatccaagtctaatgttcgagcaagaagtgaagaatctatataataatattttatctgataagaactcctcagtcaatttaaaaatacaagtgttaaaaaacctccagacctacctacaagaagaagatacacgtatgcagcaggcagatagagactgtaagtgaaaatatatttttaaatttcatagctacatttatattataatggctttatcttctttaatctaaatatctaaatttccttatttgttagatgaagaaattcagttaaatagcagtccttatgctgaggtctatagctgggctttagcatattcttaaattctctaaaatagttttaaaattgtatatgtgtgtaaacattaacattttgagggaggaaagagattatagttctcactgggttctcaaaggggcctctgacacagacacacacacacacacacacacactcacacacagattaagaaccattgagccagaacactagctgtaacgttttgtgattttggttatggcctaattttgaaatatttagtaaa

SEQ ID NO: 114858 - DNA, 1736 bp, Homo sapiens
aagtacagtgaatatgactgttatcaactctctgttcctcaaagccacatctgaaatcaactttgaaaaacaattatattttcgtagctttgagtatggaaaacaaattactgtttgccctatattatctttacaaggcaaattcagtcaagctttaaaaactactggattatacatttgtagtctatatcataatcttaaatagatattcttagtgtgagaatgctttatgtttaaagaacctaaaatttacaatgaaattgtttaaattttatcacgtcagtatttttgctggtgctccagtgctttctggatttaagctgaatctcaaaagatctgtcattttaaaaagaacactaaaacatagactttataggaaggcctataaggttaaattcatatatctcagatatatgaaaagttttgacatatgtctaaatagagaatttttactaccatgatatctcgtaatttttttttttatttccagtgtgtgccatatttaattgctatgggcacagacccagaacctgctatgcggaacaaggctgatcagcaacttgtggaaatagacaaaaaatatgctggattcattcatgtatgtattttaacattttataacctaaatttaaacatttttcttgagtaaagcatttctttgataaatgctctgcccacattcataattggaataaaatgtcttacttagtacctatcttctaaacatgcaactaagttagtcttccaaggtgtttattctagtctaaagttaaggttgggctagaggtgacagtaccaagcacaccagactaaaaatcaggaaacctggattttatatcttactatgtgaacttggctgcagtgactctcctgggcctcattttttttttcttctttgaaatgagggaattgtaagagataatctctaatgttccttctagcacttcattctgtgattcgtattattttaattaaaaaaaaacaatgaagctagcctcagaatgtaatgctctaagtatatttttaatttgtgtcttttaatttccctgacaaaaatgagacttttattgatttcagatgaaagcagtggctggtatgaagatgtcttaccaggtacaacaggcaatcaacacatgcctaaaagatcctgtaaggggtttcagacaagacgagtcctctagcgctttgtgttcacacctttactccatgatccgtggaaaccgccaacacagacgagcctttcttatttctttactcaacctctttgatgacacagcagtaagcacaaaaacttattattttaagaaaataagtgctctagaaattttatggataaagtagtcattttttaaatattaccattttattagtatatgatagtaacttcattaagtgttttcttaatcttctaagttatttacaaagtacacagtcagaagtgaaggggaaattttgtatgagaataagtgtaatgaggaataatgtataattttgcctccatactgaatatcctataaactttgataacagtttctgtaagcgtatctttaaataagcaacatcactaaactaatcgctttgggaaccgattacctcaaatattgttagagaataactgttctaggtttttggctattgagatccctagttgttcaacttgatttcccttaatgaagggaagtcacttttctgtatagtagtccacttttgtgtatagtagtcctcccttatcatta

SEQ ID NO: 114859 - DNA, 1548 bp, Homo sapiens
ccagcctgaccaacatggtgaaaccccatctctactaaaaatataaaaattagccgggcgtggtggcacgcgcctgtaatcccagctactcaggaggctgaggcaggagaattgcttgaacccaggaggcagaggttgcagtgagctgagatcacgccactgcattccagcctggccgacagagcgagactccgtctcaaaaaaaaaaaaaaaaaaagaacaaaagaaatactttaattacttgttagcctgacagcagatttttgcaataaagcaaaattataattaccatagtgcagatatcttactagacctcttcaagtactacatgaaatttatcatcaacattatcatcatatcattatcagtattaagtttgcattgtgtataggacactatacgaggagtgccagatgatataatgtagtgcttttgccctgaaaggattttccctccagctgtggggataggatacaaaattaatagtgattacggttagtatatcctgagtgccctgatggtttgtgttgataatattgttccagtccttgtttctgtccaaaagaacttcatttctatgtgatttcactgcctgctttatgtcattgactagatgttttgtcatctcagcatttgaaatgctaaactggaaacccagctctcacaatgcaatgctttcttctgactacctccaacaaagaatgtcagagaaggaacaaatgcctgaaggcccagagggatagaatgagagggatctgctatataaaccagggaaggaagatgttccagtcagggccaaaaaattaattaaaaatacaaagataagaatgtgtgggaaataatgaatagtttgttatttgactggggcagaaaggtcataatgaggaataatatatagaggatcctgtagatggcaaaaaaaaaaacattgtaagtgtgtgaataaaataatgaggacaattgccaaagagcagtttaggaagatgaatttttttagcattgtggtcacactggaggtaataataaattactatgataacagtaggggagaaaaagaatggatagtagaggctgggtgtggtgcctcatgcctgtaaccccagcatttggggaggccgaggcagatggatcacctgaggtcaggagttcgagaacagcctggccaacatggcaaaatcctctctctcctgaaaatacaaaaaaattagccaggcatgatggcgcgcacctgtagtcccagctacttgggaggctgaggcatgagaatcacttgaacctgggcagcagagattggcagtgagctgagatcgcaccactgcactccagctgagcgacagagcgagactccatctcaacagtaaaaaaaaaaaaaaaaaagaatggatagtagaaaagaaaagaaagttgaggaaagaattaaatgagactgtgtgaaaagaatagttagtggacaactggaatatttttatcttgagcacctgaaacaataataggattgttgccaaagtcagattgcaaaggagttggcttgaggagtacataaaaagg

SEQ ID NO: 114860 - DNA, 1600 bp, Homo sapiens
agagtgagagtgatactcttatgaatattaatagcaaggttattccatctgtgctatgggatcttgctgctgctgctgttgggttttatgttgtttccatggcaggggaaggtagatggtaggagtgagtgttttttagttgtgagctttttttttccttgagctataaatatttaaaagaaatttgaatattaatatgcctttctgtttatgatcatgaaatgcttgaattctctattacttctttttaaagcaagcaactaaataatcataatttttctcttaaattttgcctgcctcacagtttttacagtgtgaaactgatagcattgtcaaaacaactctgacattctgaattacatatacacaggaaactgacaaatgtttatgagtacatgggatttgggttttttcttttaacctatgtattagtactataattactagttattttgagggcagaatagtaactgtgtgtaactgatctccatataggttaaactcttagtagcacaatgatataactagaactttcatgtatactttctgatatggtatggatttatcataaagattccatatactctaagaaaacttcaaggaatttcacatggatgcaataaaaaatttcacctcttctcttgagatagcatagtgtaagtcattataaaattaaaaaaaatgggcctaagattattttataaaattccatttctgttcccccttttccctttttgttacacctgtctccctttccctttttcccccctctatatttctctccctcctcctctccctctgtctctctgtgtctctccccactctctccgtgtgtgtctgcttatctctgtctaacattaagtgaggtgaaagtgccctgtattttttctaaaaaaggttttttggttgggtttctagattatccgctaaacatgtgtgctttttcttaaaatttacagaaaacagacgtgactatgctcttgtatatagcagacaatctagcctgttttccataccagacacaggaagagccgttgtttataatgcatcatatagacattacactctcagtttctggtagtaacctactgcagtcattcaaggaggtaagttacacacattactattcttaatccatctgtcaaagtgcaggcatgctgttttcactgttttgtttctcattattctttttatcctcttcacgagtatataaaatctttctaagtgaacttaatgaaatctgggcaatacttgacttgggagaggatgtacattgccactttacctctatttagaaacatctaaaatagatatatggattgttctgttgataagccatcacatttatttctctcactttaagcactgaccttaagtgtttgcatccattcatacattcatttaaactccattttaaaacattattctgtaaatcttgtaatgctgtaatcacaacattacacatgaaaatatatagcttatttacacttaaacagaaaatttatgacaccattgactttcttatccctcaactacagcaccgttatagagtttgcatatgtgtgcccaaaatctttgctaaatttcttgttgaaccttc

SEQ ID NO: 114861 - DNA, 2943 bp, Homo sapiens
ttctcttgtatcgtcttagcagagagcaaagaggggagataactagaaaatgtctatcagtaattatcacctgattgcttgatgacttggaccaagggtctgaaaactctggctgtttttgtatctaacccattgcctgtttttgcaaacaaagttttattgaaaacattcatgcccactcatttatttgtctgtagctgctttcatactacagtggcagagttgggtagttgtgacagactatttgaccttcaaaatgaaaaatatttaccacctggctgtttacagaaaatgtttactagcccctaatttagatgatggctaacgtctgtttcacccacaccaaactactgccatagaaaacatttaggaatttgacaatcttgcttgaaatatttacttaaaattctgaaataatatctgttttttgtagttcaaacttctcatggaacatctggaccctgatgaagaagaagaagaaggggaggtttcagctagcacaaatgctcggaacaaagcaattacctcactgcttggaggaggcagccctaaaaataatacagcagcagagacagaagatgatgaaagtgatggggaggatagaggaggaggcacttcaggggtgaggcggaggaggagtcaacgtatttcgcagcgtattacgtaaaatgatttttatgtgcttatatatgtcagtctattaaatgtacaccaagtaatgtaatacttaaaagagaaaacattttgtagatagagattctctacttacccgtttatacatccttttgtagaaagtttaacataaaagacaataaaaaaacagaaatgagatttatccagcataaagggttaatttttctttgaattgtattaatgtgtgttatttttattgttgctaagttttatgtagctatatggttcatatgtatatataattttatatatcaataagagtaaagacacgggtacaaattaagagttatatggttttacaagtatatgttaaccccttggcgctggcggtcacggtgcgtctcattgccggcaatggaagtgtgccgggaaatcccaactcccggcgtcaagggattaaaagcaataaaaacaataatttcactaaaattcttttgtgtaacacttggtcttttttcccccctcccaatgttttagtcattgagaaggtcaaaacgaaattcagactctacggagttggcagcacagatgaatgaaagtgttgacgtcatggatgtcatcgctatttgctgtccaaagtacaaagatcgaccacaaattgcaagagtagtgcagaaaaccagcagtggcttcagtgttcagtggatggcaggctcctacagtggctcctggactgaggctaagcgccgtgatggccgcaaactggtgccttgggtagacactattaaagagtcagacattatttacaaaaaaattgctctaacgagtgctaataagctgactaataaagttgttcagactttacgatccctgtatgccgccaaggatgggacttccagctaatgaatttgtacatgcagccaaatttacaggaatttttttaaaaggcagaaaaacttgaaataccaacattctggcaaaaaaaaatcagttttatgaagagtaagtggaacctgggatgcaggaacaaaagaaggaaatgttgggcaaacatttttgtgggagctcccttcgctgttgtgcagcagaaacagattctcagttcatttttactcccactgtattatagtttaacaaaaattgtttatatcttggaaaaaaaactttctgtttaaaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagaatctcctggatatataatttattctgttgaaaaaaaaaaaagcatgcagtatctatgacctatctgcagaaggagtttttgtaaatgtagattttgatgtattaggtcaccctgaaaacaatacaagaaaagggatccccaggtaatctggtggagcgaatactgcaataaatttttttacttctctttgttacttgtctgtttccatttgaatttcttattgtaaaaatctgtttaaatccatttatattattttacagtcttttatgtaaaatttattatatcactggttttcaaagcaaaacataaaatattgtttatacagtttgtataggctgacttctgaataattggtatctattattttcattcccataagagggtgtaaacaattaactccagggttttattgtatcctgcaatatttagtattaactatatatgatttagcactgtgccaaacacattttcaagagtacattttgatataaaaagaaactatagtttattccttgtatgcttcaatttctttctagtgatgtcatgatgctgatatttattctttaaacctcgggtaaaggtaacctgttatttggaaaaccagcatttctcttggttaaaatgatgtccggttattttagaactagagttgagatgaatatgacacttcataattacactcactacatttttcacaaattattttttaatgctgaaaagagtaattttacttgttgagatgtttattcattttctaatctatgctaaaagcttttatcataagtcttgggaacagttgtcatttacacattacttactgcagatatcttgactaaatcaggagggaggtgtttaatcatttgatatgtatagttgacactcaggaatagtaatgcctaaaatttacagtggatgaggtctgtttcaagtttaattctttttaaaaatgttttacttatttttaaatcactttgaaaaaattgacctc

SEQ ID NO: 114862 - DNA, 1052 bp, Homo sapiens
gtcctttctgtaggctttctcatgtctttttattccttgcaaatttcttatattgaaaacacaagtatttttccttgggttcttaagtagattctaggggctgggcgcggtggctcatgcctgtaatcccagcattttgggaggccaaggcgggcggatcaagaggtcaggagttcaagaccagcctggccaacatggtgaaaccctctctctactaaaaatacaaaaattagctgggcgtggtggcacgcacctgtagtcccagctacttgggaggctgaggcaggagaatcacttgaacccaggaggcggaggttgcagtgagccgagatttcgccattgcattccagcctggcgacacagcgaaactccgtctcaaaaaaaaaataaataagtagttgattctaaatggagagtctagttgttttctgatttttaatcagttttcttacctgaagttattgtaggcttgagagatattggatctctttcaaattcataagtagcttgagcctgtataactagaacagagtaccactacagaggtaatgaagtacggagataggtccacttttcaggaagatggtgataagcattgattaatcctttgatttggagttggcaaataaccaagcaggcagttggagatagagatttaaagtaaggaaatggaagctgaactagatgccagaggatgccctataatcagagttccttttgttggtcagtaattttgtaatacatactgcttgaaataagttgactgcaggctatgatttttttaatgatacagctttcagggtgttacagtttttgttgaatggaattttgcccttttgtgacttttttcagtcattgtttaaatctcaatcacatagaacttaaaatgaaaagttagtgttgctttatcaaaccctttacattgacctttcttctgctaagaaataccagagtaagcttttcttgattataacatgcctagaattgtaatttagccttaaccttactagatttaaatcctggagcaaagaacagaaaaaggttattatggt

SEQ ID NO: 114863 - DNA, 1039 bp, Homo sapiens
ggttttgtgttcttgaagtcattataatctaacatgaggccttgcccatagaaagctgtaggtatttgtttcattgttcaatggtaaccctgcctctgaaagttagaaatgtgtatgactccaagtttctagcttaagtgcttagctagactgtgactcacaaattgacacaagtagagcaggaaaagaagcaggattttctttgggaatgatggaggtaataggtttagttttatcatccagtttcagatttctcaggctagactctgtagacactgtttggtgttatgttataaagaaactgagtgtcagtgcccaccgtcctagagaaagagtacttcctttctgagggaagccagtgtacttggcagcctggtttctgctgtggggtgtcttcttgatctataacttacctttcacttcagaaagctttcactgtccagtggggcaggtacactttaccttgaaaagtcttatgcatgctcagtttcacagaacttttctcattatatttttatctcaaattggatatcccagataaaccctggaaaaatgcattatgatctgaaaggaaggaaattacaaagccatctctaggtaaagtaaggtgagagaaacccagtgatagcctctcaaggtttgtaataccccataggtgaagatttatcctaaaatgcaagactcttaactgtaattttagcagagtaggtggtggtttgatttgtcattctttctagatgacaataattatgttcatttggacaaaacaagaatgtcgatgtctagatgccaaattaattgtagccaagatgagtttgggattagttgatgtttgtagcctttgttgatctctagtcatatcgtgaatacttgaaggaataacttcagcaccccacctccacttgttcccatctactttgaagtggaagcctactcttgtggttatgttgcttaaccactcattggtttctctttcagtctcactttttctgttttaacggctgttttttttttaacacagtgtttgttcacatatgca

SEQ ID NO: 114864 - DNA, 1113 bp, Homo sapiens
ctttaacccaagaggtcaccatcttcgctaatctcacctacttccccatatgcagcccagtcgttattggaagagaatccttcaagctttttttcgtgaataggccagcaggggcctctcaaatactgatagaaagtgtctctttaatggaccttctctttcctaagtacataggattaatatctttttctacctagtaaaaagctataaggggtagaactattactattacgctaatcttagatttatgtgaaatatttctctcttagttaaattgaattagttgctcttaacccacaaatgcccagattctgagaacgaaaataaaatccttgatttggaggttaataaattaaatagaacaatatgttttcaagaaaacaggtatttcatattaaaaccatgtgaatgtgtaagtcttagggacagatttggtttatctcaagataataaaatcttaaggaatattttttgagaagagatgtcagaacacttttccctatattaattcaatcctgtttttagaattaaacatatagaagaattaaacatttagaatgaaacatatagaagactgaatagattaagtgtttttctctgaagacatatagttaatactggacaagacttaaaaattatattttgggacacattcttacaggtaaattgcttctcggatttaaataagatattttctaaaatatattactttcagatcaccagagatttgttttttgtttgtgtatattttataaagtaaattgcactccagtactctaaactgtgtactaagcaaagaagggttgtgccttctgacatattacactgagtactcaggatagaaaaagtaataatcttatactggctgggtgcgatggcccatgcctgtaatccaagcactttgggaggccaaggcaggtgaatcacttgagctcaggagttcgagaccaacctgggcaacatagcaagaccccgtgtctacaaaaaatacaaaaattagcctgcattgcggcacacacctgtaatcccagccattcaggaggttaaggtgggaggtttgcttgagcccggaggcagaggttgtagtatgccatgaccatgtcgctgcactta

SEQ ID NO: 114865 - DNA, 1050 bp, Homo sapiens
caccaggggagagattttctttttcctattttatggacaaagctgtccttcagtgctctaagatacatgaaggtagctcagtttttccctcattgcagtgtacagaaccacatctcctattcctcagtagactatcccagcatcattgcccacttactgctccagctatgagttcctttttcttttctggcaccatgggatttctctgtttagaaagattggtcgtatattaaaatttttttttgtaatttagcatgtctatgtttttatgaaagggcataggcctatgtacttcagctcagtctaataaatcttgtttatttactgtgggagagctttaacttcaaattttttattaaattcattatacagtagaaagctattagcataatatgtgacaaacttctaatatctgggttgccagttggaaatagtggcaattgtcttttccatgtgatcttttttcctctactattttattttaattgtaatatatactctggattagtgcgttttttgacccatatggatgaagaagatcaaagtgacaaaaaggagacttcagaacctgaattttcaataacagaaaattattctggtcagaaaacctgtgtgtttcctactgccgattcagctgtcagcctttccagttccagtgatcagaatactacttctcctggtattgttctttactttttcatttacacatactcttattctccattataatgttactgaacatgatttactgggaatatagttatgaaaggtttgtgaagtcattttgtaatatttattttaggggaaggaaagttaaaacttttgctagtcacatgaagaactgtgacatcttgtcaccttcataagacatactgcaattatgtatcatatcttggtgtaacttattaatatgaaatatatagcaactggaattactgtaatagttgatttttacaaaaattgaaaaattaaaactcttccaattataagaactttgaattttaatttgaaaacaaaatagtagccatcatttcttgagcctctaccatg

SEQ ID NO: 114866 - DNA, 1050 bp, Homo sapiens
ttttaaaaaatgctctcacattattataatgtacacataaatacaaacatcttcacttgcctaacttaagaaaacagcttatagtcctggaagaggcccagggatactctgggcagacactgagtggtaaatagtcttgaagacctgggttgaccgtgttatgccactaaaaaagtcattgaatctctctgggctttgttctctcatctttaatacgaatttgtctagatagtaattaaggttcttcattctaaaattttatgatacaattttcctgagccttttaaaagtttataactcagttaagctacaaataagtaaaaatttcctctgttttattgatccctaccatttagcttatattggatttaatcccatttttttcacttttgcattaatgcaagtgtttaaaacttacataaaactgtttgttattttgaaattatcaaagtattactgttgttttgttgtgtgtgttttttctacagattggaccagtggatcacattgaattctcttctggccctgaattcaaaaaaacattagcttcaaaaaccattagcatttctgaagaaggtttgtaggggctgataggggctggctgaagtcttgctttagttgatctgaaagaatgtgcattgttttgtggagtgccagaagtaggagtagttttcattatgtgagctgaagtcataagcttcccagtttttagattaggattatttttttgtaatgtgattagcttccacctcacggcctttttttttttttttttttttttttttgagaaggcagtaacctcctctggattttatactaggatggggcaagtgtggcctggagctcagtttttgtggattccaagccattggcctcatagtgctgaggattgcacagagctttgtgctgaggttgctgtttgtctgtgatcatcagctgagctggaatttgaggttctggtaaaatggccaggcagtggtgaggtattaagttttttcattttttattgaaagaatgaaattagaatagttgtttttaccttctgctgtg

SEQ ID NO: 114867 - DNA, 1018 bp, Homo sapiens
aaaaagaactattgcaaatttgggagaagaatcaactgagtttaagaataagaagagtcattggctttgattttggttttaggaggtttaatgtttgcctgagatctcatataaagtcagtaatagccaatattggggatagcttttaacgtgtgatgtttttggttttcaagtagaatttgaaaaagtcataaaaatattaaagttgctttttgatgaagtatatgtttgtagcaagggatgaaagtaatattcagacttccttgtttgtggaactttgttgtagtaatttatgtattcttatcccagaaatcaagaagctgaaaaggaatttttaggtatatttaattaaaactgatttggaaagtagtgttgtgttggtttaaaatgaagtcatcaaaaaatgagatcatcaataatacctcttctttaattataatcaattctgcttttattcttattaatatttaggtctgccaaaaccagagttccgattcaaaggacagagcacaaagtcagactctgcagaagattatctattgtggaaacggctgcaaggtgtctctgcagcttgccctgcaccaagctctgcagctcaccaactagagcatctcagtgctaagcttcagaaaattgacgagcagttgctagcaatacagaacattgctgaaaacatagaacaggatttccccaagcctgaaatgctagatctacattgtgataaggtagactacctttatttttagttttttgtttgctactgaattattagatttgtagtgtgatataactttggatacctgatttttcaaaataatgagaactttgttttctttaagctagggtttgtcaacctcagcactattgacatttgagccagttaattctttgttgtgggggactgtcccatgcgttgtaggatatttggcagcatccctggtctttacccactggtttccagtggcactgctccctagttgtaacagtcaaaaatgtctctagataatgccaaatgttc

SEQ ID NO: 114868 - DNA, 1031 bp, Homo sapiens
gacattgaagctaatgatcttctacaggaattacctgtgagagaagagccttcaaatgataatgttatcaaacagcaaagcgatcatctagcagttccatcgtctgcagagttacattatatggcagcttcagttactaatgctgttcccccacataattttaagagtcaaggtaattttttcctacttttaaaacaaatataatttgaaaagttctttaatatagcattgttatccctactcacatctcttacctctcctcctacaaacccactgtatttttggatgtttacatgcacagaaatgttctgttaatcttcggattaccttatttagaagtttagaatcagtctttgaatgcttttcatagtcttgatagaatcagccaattcctctatggatttattttctaaacctgcagaagtaactccagcttgtctggatggaaaaagcttgagagcaggcattacagaagtgaaggagcctagtgtcacctcacctacaccatcagacatacagcagaacaaaggtaaacagccaagaggtatagcatgaccctctcctgaattactgttgtattggaaacaagcaccaaaatttggtaattgcaaaagaaaccagaaaaagggttgtcccttgctaaggagcatgggggcaagtaggtaaatgaaatagagacatgattccaaagctgggaaccatggatattttgtaagaagtcacagatctgtttatgcatatgtcttttctcaattaatagggctaaaaataaatattctttgtgagttcatgagtgttttgatgttagaaagcaattctcatattgtaaaaggtgggaaattctcaaatagcacaccaaaaataaacaggcatggtagccaacagtactttttttcccaacttttatttcaaattcgggacacatgtacaagtttgttacataggtatattgcatgatgctaaggtttgaggtatgattggacgcatcacccaggtaatgagcatagtacccaataggtagtttctcatcc

SEQ ID NO: 114869 - DNA, 1446 bp, Homo sapiens
cgtggagttaaacatactgaataataaggcctctcaaggctcatctgggatttacctgatgaagatggaatagactccaggtgttttcaaagactgtctttataaaaaggatagaaaatatttctgtcattatattgtttctggtaatattccctgagccccctaaaaagtcaatagcttattttttaaatgatcagttttctcttcatcttcacttatcgctagaagacattgaagaatctgttggaggtttcagaagtcccagtcttgccatttgcatgatgactttaccacagcagttagaagaagtaagtcaataaatagtggatataattattcttctttcattttgtatagtgtttaaattatacatgtttttattcattgttattaaatatatcaaagcagggctagctcttaaaaatgcaccatgggttgtagaatatagccatgctgtgtggcatttttctttccctgaaattctagtacagtgtagtaacctgtccaataatttcaggcaatgaagttttcacatcataaactgctttagcaaatttatttaatcaagagtagcaaatgtgtcctttatttaaaaagtatggaagtatggccaagcatggcaactgatgcctgtaatcccagcactttgggaggctgaggcgggaggattgcttgaggccaggagttttagaccagcctggtcaagagaacaagactccatctctacaaaaaattaaaaaatagccaggcatggtggcatgcgcctgtagtagtctcagctacttagaaggctgaggtgagaggatcatttgactccaggagtttgaggctgtagtgagctgtaatgtgctactacattccagcctgggcaacagagtgagaccctgtcttttaaaaaaaaaaattaaaaagtataattcagctgtagtatactttttatacatatatatactttttgatattatttttctcaaaactctatacactgaatttccagggggaacatagacatttccaattattgtaacaattctgtgtttttgtttttttttttcgagatgagggtcttgctcttttgcccaagctggagtgcagtggcacgatcatggctcactgcagcctggaattcctggaataaagtcatcctcttgcctcagcctcccaagtagctgggtcttactataggtgcacaccactatgcccagctaatttaaaaaaaaaaaaacatttttttgtagagactgggccttgctatgttgcttaggctggtcttgaactcctagcctcaacctctcaaagtgctgaaattacaggtgtgagccaccgtgccctatctgttgtaacaattcttttttatttttatttttatttttatttttgagacagtcttgctctgttgcccaggctggagtgcagtggtgtgatcttggctaactgcagcttcca

SEQ ID NO: 114870 - DNA, 1023 bp, Homo sapiens
cttgatcattgcttcagcaacaaatattgagttgtagaaatgcagtaaatatttgataaatgaataagaggattattcagaattcctgtagaaagaatgaataattttaaaatatggtgaaaaataaagggttcaataaatactaaatactttaaatggtttgctttagatggtagagaatcgtgacactgggtgtcagattggacccaatattgagagggagagcaaatcagatgctggcggttcagttgcagtagcaactccaggtggaactgaggaaagaaatggtcagaataaatcttgtcaaaatatcttgaagtaagttgccgattatactcttcttttcaatataagacatgtagtttgatggcatttgggcttaaagggaagatcaaacccttgaaagttaaaggaatgagcattttttgaagtagaggagcaggcagtgagctttctgaggtgctttaacaattcattgcaaattgtatttcttccctcttggtctagcttatatcttctgagagagcaattaattcatcctgagggattcctttatcaatttatttcccatatcagaagttgaactaatcctttcatccatttttatatatgaagcaatgctaggagtaacatagctttgaataccaaggcaaaacccattatagcatgaagagtcctttgtgagaatgataattttagttgaaattattccaatcattcgagtaaataaaaactatgatgtttagttatttactgaacaatctttacctgagcttctgtgtatcagaattttttaaagaaagattttataaatatgaaaccaaagtttgttctttgcttttaaaaaactgaattaagccgagattgcgccattgcactccagcctgggcgagactccatcttaaaaaaaaaaacaaaaaaaaaacccaaaactgaattagctctttatctccaagaatagttgtaattttagttgctgcatttttttcagtagaatgccaactgaagcaaaaaatcctgata

SEQ ID NO: 114871 - DNA, 1047 bp, Homo sapiens
agtacagtccagtaattcgtgtaaagacctctacagctgccattcttacatcattatggcttttggaacaaccctattttgctacatataaggcaaaaaatgccattattaaggtaagcatatcaattgtttattacttacaaatgagaattctcattttagattaaaactatgtttacatttcccatcttttaaagaatcattaaataatagaaaattaatgacaatgttgattataatcagtatctcctatttttttcttccagtggttcctttaattcttaacaataaagtgctttcagagaggctgtgaggttttgaagttttatgtgtatttataaaaaagaaaaaaaggaaggagataattttaagtgatattacaagtggtattacacgtatattatttctcctttcagtttcaggttttggttcagatgaaggaggactaggtggctctgtagttttaattactgatgtctcatcaagtccgttaggggatagtttttcttatactctcaggccagaagaggttggagaaccaaacacagaaaggcagatgggggagtcagtagaggagttagtgtttaattaactattctttcttccctagtcaatggcaagtgcttttattctgaagtagtttattctaggctgaaggatgtgagtgtgtgtgtgtatgtgtgtgtgtgtatgtgaatatgtgaatttgttttattttttacttattcattttttgagacagagtcttgctttttgttttgttttgttttttgttttttttgagatggagtctcactctgtcacccaggctggagtgcagtggcgtgatctcaactcactgcaacctccgcctcctggattcaagcgattctcctgcctcagccttgtgagtagctgggactacaggcacgcgccaccacgcctgactaatttttgtagtttttagtagagatggggtttcatcatattggctagggtggtctcaaactcctgaccttgtgatccgcccgcctcggcctcccaaagtgctgggattacaggtgtgag

SEQ ID NO: 114872 - DNA, 1274 bp, Homo sapiens
atatctgttagtgacttataagtcaatctccatgacttttatataaggacttttatataaatttacaatgagcatgtgttcattttataatgaatgaaataaagacctttattttgaaaaaaatgatcagcagagttggagttgttataatattaatgtacatactcatgtgattttctttcatatttgtgttcctgctttaggttgcttcagagaactttgtgctctgtgttggatgctgcatgtccgtgataagttatcctatagttgcaggcaatatcagaaagcaagagaaaatgtaaaaggagaaaaggtatttaccagggcaaaaataagaaaaatgaacacacgttaagtgggaaattattgtttaaaagaagattttattgtttgtagcaaaactttcttttgaactcattctggtctaccatctaaactaaaaaggaaatgaatgtttttcaatatccttttaggaccttgaagtggagtttgattcttgtatgattgagcactgtcttagtgcagtggaatgggcttatagaatgctgcctttctctcggttttttaatatggaagaacttattcaggatataattttgagccttattggagaactgccaccaatcagaaaggtaatgtgcttgtaggtgaaagtaaactacatcagaatcagagactttaaaagatttttatttaattttaattaaggatgatgttgcctttctttggattatttcacttagcataatatcttgtgggttcaaaaaggtaaatactgtaggacctcacttgtgtgtggaatataaaaatgttaaactcacggaagcagagagtggaatggtggttgtcagaggctggggatgtggtggaaatggggagatcttggtcaaagggtacaacctttcagttacaagatgaataagttctagggatccaatgtacaatatagtgactatagtttttttttttttttttttttttttttgagacggagtctcgctctgtcacccaggctagagtgcagtggcgcgatctcggctcactgcaagctccgcctcccgggttcacgccattctcctgcctcagccttccgagcagctgggaccacaggctcccgccaacacgcccggctaattttttgtatttttttagtagacacggggttttaccacgttagccaggatggtcttgatctcctgacctcgtgatctgcccgcctcggcctcccaaagtgctgggattacaggcgtgagccaccgcgccgggctatagtg

SEQ ID NO: 114873 - DNA, 1084 bp, Homo sapiens
tttttttttttttttttttttttgagacagggtgtccctgtgtggcccaggcttgagtgcagtgatgcaatcatggctcacttcagcttccaactcctgagctcaagcagtcctcctgcttcagccttccaaagtgctgggattacaggcgtgagccactgtgctcagctcattagcctatctttattttcattttaacattctaaattttctcattactagccactaaaatggattgttttattttcctcaggaagatggtgatgatcttcttttaaaagctgaaaaaaataatcgccagaaggtatctggaatccttcagcgtgttctcctgcttttccgggcggctcagtgttcttttcctgtagcacagtggtatatattgcagttgaggtgggcaagaaaagtcatgcagaaggtatggaaatatcttagtcatttacatgctgtgttaactgaaattactcatatttatattattgtttttataattgttatattttcccaaggagtcctgccctataaatccacaaatttcagatttattcataaacaaacagaccagattcttcctgttgaaaggtgaggactctgaacagggtctctaggttagttccaccatgtctagcaaaagatagtgtaatctagtccattaattccaggcaattacagttttttttttttccaactcccctgtcattaaagattgaaactcagtccagggctttctcccagttctccttgaggtgttgtctgtgttctgtggggccttctgtgggttcagagaatggaaagttatagttcattctcgtctgtttccatccggtagcctccactagtcagggtctcccccttgctattttctgagatgtgcaattcagtttgattcccaggtgttcatccccttctatattgacttcagctgagctgtcgcttcattcttatcagatatctagccagataggacacctggtaggtctttttatctagctgaaaatcctttatatgcctgctgtctctcttggaaatgtggaaataaatttcatcatctccaaatatttttaattcagcctaagtaaaatta

SEQ ID NO: 114874 - DNA, 1034 bp, Homo sapiens
gtgggaaaattggtagaacctgggaggcagaggttgcagtgagccgagatcctgccactgcacttcacactccagcctgggtgacagagtgagactccatctcaaaaaaaaaaaaaaggaaaagttactctcacacaatcttttatattattttggtgtctttcttgacattcttttcccattaatattttttcaattatttttgactcagaactacattctaagaatatttttattgtatagttgtttctacaatatcttgtataaaaatgtctcatggtcttacctataatcttaaagtaacaagatagtttgtaatttctgtctgtaagtttggatgtttgtatgtcaaccaatgtgttcattcttgacaatgaatgtttttagatttgaaattttttcctacaaaatggataagaagtttaatacaagctttaactattttaccaaatttttgtatttgatagatcccattgaagaggaagatgcaaatctgctatttggttcagtacaagaagtactgaaagcatcagttatggccgatgcagatattctttcggagacatttcaacttctgatagactctgccaaggacttcagtaaaagactgtggggcttagtgccattcggcttgtatcttccagctcctccattgtactgtccccagccagctattcttagtgaagtaagcttatagcattaacttttaaattaatttaaagttgattttgtcaagtttttaaaataattaacttgataataatcatcaggttaaaaattcaagctctaaagacaaacgtatagatcccagctttgctgttcactaattgtataatcttagggaatgtactaaactgctgtttaagtttccgtatcggttaaatgcagatgataatagtacctctcatggcatttttgtgaggattgagatatcctgtaaaatcttctagctcaggacctgggacatatagtaattattcaataaatgttaaaattattgtaacaatatagcacaattaatcttaatatccaga

SEQ ID NO: 114875 - DNA, 1985 bp, Homo sapiens
ctcacgcctgtattcccagcactttgggaggctgaggcgggtggatcacctgaggtcgagagttcaagaccagcctgaccaacatggagaaaccccgtctctgctaaaactacaaaattatctgggcgtggtggcacatgcctgtaatcccagctactcaggaggctgaggcaggagaatcgattgaacctgggaggcggaggttgcagtgagccgagatcgtgccattacactccagcctgggcaacgagagtgaaactctgtctcaaaaaaaaaaagtataatatataatatatatacacgtatataatatatatcgtatatattatatattatatggtatattatatatgtatataacatgtatatattatatatattatatgcatattatatattatatataatacatgtatattatatattatatttttatatgttatatattatatatgtatatatattttttatatattatatatagagagagagcttgtttggtaatttaacaagctagaattgatgatactaaatatgcgatttaactgggaaataacagattcatgaacttaaaaaaccaaaacgtatttaaaatatctgcttggtattcttcgtatgtgtggaccagcattttattatccaaaccactcttgttagaaatttcactttgaagttttattgtcccctctccccactctcagggtggtgtgctaatttaaatagtataaaagtataaaaagagaaaaataaatatgtaagaatattttcagttatagtcacagtcaatgtcagtattttcttaagagcataaactacaacctgattacccatttgagacctgcctctggctcagaaaaaaattacttagtcttaagcttaatgttaaggataaaaagtataagcaagatctcaatattttttactggtttatgatgaggaatatatatatgtattttagtatcttgatttattttcagattaattttatactaaagtatattaaatttatctacagttatttggagactgctgcctgtgttcatttactttttattctggggaatgcctgaagttaacatttctagcaattcggtggcatgagaatgtatttacatctgtaaggtgaggtaaatgttttcttcttccttttcttactgatttttttttcttttggaggcagggtcttgctgtgtcacccagactggggggtagtggcacaatcatagctcagcctcctgagtacctgtgactacaggtttgtgccaccatgcctggctaattttttttttttttttaacagacaagttcttgcactcctgggctcaagcagtcctcctgccttggcctcccaaagtgctgggaatacaggcatgaggcatcatacccggccccatattttctatccctttttaaacattattatcttttgatccatatacatgtaataaaatttgtaaatgttattgtgagtttcaagttctgaggctttacaaatcatttcttcccctcttatttctaaatgtttaatccagaaagtttatcttgttttgtcttgtttcccttctttgaagtgagaatttgtaaaagataagacaagctatggttttacttgtctaagactataaaagtaactattctggaaaagaattcagttgaaatttaaaagggacataacttttgatttcctattgtaccttttaaatgcttaagtgttcttttatttaaaaatagttttattctaaaaagcctaataaaatagaaaatatgcattttttttttttgagatggagtcttgctctgtcgcccaggctggagtgcagtggtgcaatcttggctcactgtaacctccgcctcctgggttcaagtgattctcctgcctcagcctcccgagtagctgggactacaggtgcccgccaccaggcctggctaactttttgtatttttagtagagacggggtttcaccatgttagtcaggtggtcttga

SEQ ID NO: 114876 - DNA, 1320 bp, Homo sapiens
attgaaatacaactactaggtagccttacctattaattctaacgaggtattttaaaacaattcaaaatgttcaggctactatagagtattaagcttaatgttcattttatgatttgtggtacaaatggataatctttcttaaatgtcgctttgatttctgggataatttatttaggcagtaagttgaattaatttctggcacctcttgagtccttcacatgtttcttctcttaggaaaaagaagccgtttttcttttggatgataaattcataaatgaaattaatttgctatcaggaaagataaagaagaaaattcctagtctgcagcctttcttgaaggatgttattgtcctaacaacatccagtaatggttaagtagtactgatattttcaaatggctaaaactatattttttaataacttagggtgatgttaaaggaaatactagattgtaagtattgcatttcatttttggaaacagatgcctggctggctggggtactaactacaggagagcttttcctttggaacaaagatcaagattgtttgaaaactataccaataactgaaaagcctaaggaaatgatcaaagctacagtcggtgggaatttttttatttgtttaagttggtttaactaggaaaaataggaaaagaggatgaaacatttttctgttactgtcttgaaaatgtatttctgtgtatgtgcatatgtatatctgagtgtgtgtatatatatatatatatatatatatatatatatatatatatatatatatatatagttttggttatgtttatctgtgatactgagactcaacttgaagaagaaaattctggcatgcctaacatttctgtgataataataggtttctaatatcacataatatatacttgataaatgttgctatttttgtacttttttttttcttttttttgagacggagtctcgctctgtcgcccaggctggagtgcagtggtgggatctcagctcactcgcctccggggtccacgccattctcctgcctcagcctcccgagtagctgggactacaggcgccagccaccatgcccggctaatttttttgtatttttagtagagacggggtttcaccgtgttagccaggatggtcttgatctcctgacctcgtgatccacccagcctttttttttcttttttagagacaggatcttgttctgtcactcaggctgaagtatagtggcatgatcatagctcactgcagctttgaccttttgggctaaagcgatccgtctccttaagcctcccaaagtgctgggattacaggcatgagctgccgtgcc

SEQ ID NO: 114877 - DNA, 1026 bp, Homo sapiens
ttgaacccgggaggcggaggttgcagtgagccgagatcgcgccactgcactgcagcctgggctacaagagcaaaacttcaactcagaaataaaatataaatcaaaactttatgaaaattgtcagttaagatcttcagtggtccatgcgcagtggatcgtgcctgttatcccagcactttgggaggacgaagtggatggatcacttgaagtcaggagtttgagaccagcctggccaacatggtgaaaccccatctctacttaaaattagccaggcgtggtggcacacgcttgtagtcccagctactcgggaggctaacgcaggagaatcacttgaatccgggaggcggaggttgcagtgagctgagatcatatcactgcactccagctggggcaacagaacgaaactcttgtctcaaaaaaaaaaaaaaaatgcccagtgaatattatgcatcatttatattttattactattattgtttacagaatcttgggactgttttacttaattggtcattgatagcttaacaaacatggagataagattagaaatcttgacatcaacaggtattaagcagaaaaaaccatggccacgtgtctcctggttgggaaaggtaggtttttctttattcacgcaataccagttttatatatgttatatgtgtgttttgcctgtaatataggagtgttctatgatcttaaataaataaaacatcatctactggaggaggatctacaggaggatcacctacctgcacactgaacagggttttgtgtgtgtttcgtttttattataatgagcaagttagcttttccagaatgttaagtggtttatttagaagatttttacttaaactatttttttcatattatgtttaagtcaagtttaagttaagttgagatggcatatatcaaaagggaatatttaatgtcctgagctttcctttactggaacagttaatggagtgtttcctcctattgtggttttcatgattgtgctatgaagtgttcttggaaactaggatggaa

SEQ ID NO: 114878 - DNA, 1106 bp, Homo sapiens
agccaggcatggtggtgggcacctgtaatcccagctactcgggaggctgagtcagaagaattgcttgaacctgggaggcagaggttgcactgagccaagatcacaccactgcactccagcttgggtgacagagcaagactctgtctcaaaaaaaaaaaatgtaactctaaatatactcctacctttttcctcaagaaattacagattcctagtgtggcattataagcactgcattttagttgagcaaaaataaaaataacaaaagtctcatgttagttttagcaaaagaataatttattggccctcaaaactaaaatgtccatgtataggcaacttccacctgactacatccccagcctcaatattttcagggccttctctagctcagttcctctcttttcatgtcactctgctcttgcaatttgtctacctgtgactcctgggagagtatgggcagtgttacatcctgttagctctaacctggagatacagttaacagagaagtcctaggaagggctctgatcaacgagtccagcttgagtcatggactagtcttggggcatagtggtcatgcaaaccatatggaataggaaagaaatgctttcctaaagaattggatgctgggcatacatgtgatctcagctatgcacatcagatatagtaggcacctcagtccacctgcattgcataccattcacttactgtgctttgatgaaaactataagcttacagatccaggaaactcaatgaacccagagcagaatagacaaaaccaccatggacacatcataatcaagctctcggcaacctaggaataaaagggaacttagcctgataaatgacacctatggaaaacattcagctaaaatcaaacttcatggttgttgggaacaaggcccccaaaatctggccataaactggccccaaaactggccataaacaaaatctctgcagcactgtgacatgttcatgatggccataacacccaccctggaaggttgtgggtttaccagaatgaaggcaaggaacacctggcctgcccagggcggaaaaccacttaaaggcattcttaagccacaaactatagcatgagcgatctgtgcctt

SEQ ID NO: 114879 - DNA, 1103 bp, Homo sapiens
ttgcccaaggcacacaatatataaagcaaaactgttagtaatgtactttttaattattccttaacaaaatagaataaccaaaccaaatgcttcaaagtaatagcaacaagagagaagaagagtgggaatgaccagagctaacaaaacactctattcctttctctcttttttttttttttggagacagaatctcaccctgtagcccagcctggagtgcagtggtgcgatcccggctcactgcaacctctgcctcacaggtttgaagcaatttgcctgcctcagcctctcgagtagctgggattgcaggtgtgcgccaccatacccagctaatttttgtatttttagtagagatgggtttcaccatgttggccaggctggtcttgaactcctgacctcaagtgatctgcccgcctccacctcccaaagtgttgagattacagacgtgagccaatgtgcctggcctattcccttctctctttatgctaccacaaataattaccttctgtttattgtaagtgatgcatgtctaacaatttgtacaatacattttgaatatatttttccttccattattgtcttttcccaagaccatagggttgccttctctacatttgttctcttagaattcagctcccttttccctataatcttctaatgtagaatatttaatagaatgccagaacgtcactcagtgggtactactacctcttatttttcaacttttcagtttcttaagtttagcgttttttgaatatgtaaagtgaatgtatgcgatacattaattcgttttataaatttaaaattctgtcatgtctacttaaaaggaaggccttgtctgaatgttgtaatttaggtgtgactccagttctgctagagataagaacttcatttttgttttaagcacatttacatactagcaatatgttgttatatatactcagctcacaacattgaaagtacatgttttaaaagggctgtaggcttccatggttagatggtctgttagagtcagaaatctgaacactgtccttttattcacacagcatgctttgagaggttttaggaattccagccccacaacagatgcttgcaataccttttgg

SEQ ID NO: 114880 - DNA, 1406 bp, Homo sapiens
aaaatcttcaggccaggcgtggtggctcacacctgtaatcccagcactttgggaggctgagatgggcggatcatgaggtcaagagatcgagaccatcctggctaacacgtgaaaccccatctctactaaaaatacaaaaaaattagctgggcgtggtggcgggcacctgtagtcccagctacacgggaggctgaggcaggagaatggcgtgaacccaggaggcagaggttgcagtgagccgagatggcgccactgcactgcagcctgagtgacagagcgagactccgtctcaaaaaaaaaaaaaaaatcttcaaatggaacccacctacacccaagttttcttttttactttatttcttatttacttaatcacatggtctttcctctcctgtgagaattaaagttgccagaagttggtggggaagaagtcctgcaggaggaaatgtttgtaaatgtataattaatcatgtgtctttttcgttgtaggagaagatttacaaatctctgcctggatgctgtttgtggttaccttgttgagctccagtctatgagctcgtcagtagcagtacaagccatcactgggaattttaaatctcttcaagctaaattagaacggcttcattaattactgtgatatactttcatccgttttatgatctgtaaaataaaaactcagctgggtccagatatcaggtgttctaaatctaagaatgtaagaacaatcttaatagaaatatgtttttaataagtggctaatatctacaaatagtacctttgctaaatgaattcttttttatgactattttgttttttagtaattgggtgaaaaaacaactgaaatgagattatttattattttaacataaggattaaaaaaatttagaaactcttattttgaattgtactgcaggcagaaatttcgaatttatattattcattttcaagttagtccaaggatattggcattaaaactccactaggcggccaggcacagtgacttacacctgtaatcccagcactttgggaggccaaggtgggcgaatcacgaggccaagagtttgagaccaacctggccaacatggtgaaaccccatctctactaaaaatacaaaaaaaaatagccaggcgtggtggcgggcgcctgtaatcccagctactcgggaggctgagggaggcgaatcacttgaacccgggaggcagaggtttcagtgagtcaaaatcgcaccattgcactccagcccaggcaacagggcgagactctgtctcaaaaaacaaaaaaacctcaaataggctaagcagatccattcccataatagtggattctaaaaccgtccttaaataggcaaataactgactttttcaaaactttttttaggtgttgggttcacccttgaaagaactgtcctc

SEQ ID NO: 114881 - DNA, 1050 bp, Homo sapiens
tcttcttatatctttctgagttttctaggttctgtaattttaattttaggacattttcatcatcccaaaaagaaactctgtgctcattagttgtcacttcccattccttcacaccctccagccctaggcagccactaatctactttagatttgcctgttctggtatatatcttacttttatttaaaaaaaactttttttttcttttaagctgagagtgatggtgcacacttgtagccccagcttacttgggaggttgaggtgggaggattgagctcaggatttcaaggctgtcgtgcactgtagttgctcctatgaatagccactatttctagtctgggcaacatagcaaaaaaaaccccccgccccaaaaaattgcaattggatttcagaagatatccccctagaaactattcagttatgaataagacctaccttttagtatcaagagctaaaaatccaaatttccgatctttttttttcttcccagattttattgtacagtttttagaacagcaggtttgtactttgaactgggatgtgggcttcgtaatacagacaatgaatgaaattggagtaccattacctagactactagaagtttatgatcagttgttcaaatcacgggtaaggaaaatattaaataacataaaattattttctttaattaaagtaactttgtagatatagagtggggtattttgattgcatttttgtatcctatcacttagtctaattacacttggttgagtcttggaaattatgcttttgactttttaaactgataatgagagttgctttcctgtatatcatgattaaaatgaaatattatttttgaatattaataaatatgctttactcttggtgaaagaggctaaaccaaggtgtgggctaaactcattacattaagaatcatcatttgctttatttttttttttttttttttttttgagacggcgtctcgctctgttgcccaggccggactgcggactgcagtggcgcaatctcggctcactgcaagctccgcttcccgggttcacgccattctcctg

SEQ ID NO: 114882 - DNA, 1093 bp, Homo sapiens
agacactttggcaagatatcatagagaaaggtaagtgttcagttataggtatgttagcatacgttatgtagtgacttggtggaggaatgcaagctgctagtaactaatataatgcaagctgctagtggctcatgaaaattgtgtatacctaagaagagagtaagtggaagtcacctgggtatggtggaggatgatcatacacagaatgacccaagtgaatattcgggagaatactcagtgaaaaggttatttaatttatattatttgtgctgccttataaaagatactgagacactcacctcagaatctaataaccagtataacctggtaagacatgagagtatctcagacaataacagaaacaccaaatctgttaatcatattaatgtgactatctgttctaaagtattttgaaccttgaaacagaattaaataaccaatgtaaacatttcacattaaaagtaatttgggtttcaaatgacatgtctttttgttacagaattgagtgacagtgtgacattgagctcctcggatagaatgcatgctcttagtctcaagattgttctccttggcaaaatttatgctggcacaccacgcttctttcctttaggtaagctgtgatcttaggtgcagtcacgtattttctgttctgatggttttctccgttgatatggacaaataacgatctttcgagtaaaataaagagtttctttgctatttagttcagcactttaattctgcctctccggaaagacttccaaagaatggcagaatttgttaatgaagagttgagtatgaaactttctgtgactaactttccaagtttatattacctgtcttaggattgtgctgactgacaaactatgattatattgttggtaaccctatacaagtttctgaagagaaaagaaaaacggttgatgtttttgtgcataggtaatctgtgattgattcaactgttctttttttatgttgagggcatgtttttctttaaaatagcaaataattatgttaaaacttagtgtttgaatccctttcttaatgagatatggtggctataatttttaaataaggtagctaattatgagctatt

SEQ ID NO: 114883 - DNA, 1032 bp, Homo sapiens
tttttttttgtgagacagagtcttgttctgtcacccaggctggagtgcaatggtgcaatctcagctcactacaacctctgcctcgctagttcaagtgattctcctgcctcagccttttgagtagctgggattacaggcgcatgccaccaggcccagctaatttttgtatttttagtagaggtggggtttcaccatgttggtcaggctggtctcgaacccctgaccttgtgatctgccccctctcagcctcccaaagtgctgggattacaggcgtgagccaccacacctggcccccaatgaagaaatatatttaacagttgccttttaggcatattaagaccttttccttctgaagacctatcagaaatattttatgttagcagggtgactattgtacagtagagacataaccttgatcattattttcatgtgccagctaaggaaaaatgtatccaacttagtagtaagtcataggtcttcattcttttctttcccatcagtgagattttatgagggtgtggtggaactttctcttacggctgcagagaaaaaagatcctcaaggtcttgggcttcatttctataaacatggagaaccagaagaagacatagttggacttcaggccttccaagaaaggtgcattccattacgttagcagattgtcatctttatggatacagacttttctttgcataatgttttttgttttttgttttatgttttttttttttttttgagacagagtcttgctctgtcacctgggctggagtgcagtcgtgtgatcttggctcactgcaatctctgcctcccaggttcaagctattctcgtgcctcagcctcccatgtagctgggattacaggtgcacaccaccacgcctggctaatttttgtatttttagtagagacagggtttcaccattttggccaggctggtcttgaattcctaacctcaagtgatccacccacctcagtcttgcaaagtgctaggattatagccatcagccaccgtgtctggcctctttgtgtaaaggt

SEQ ID NO: 114884 - DNA, 1086 bp, Homo sapiens
aagaaaaatcactaaatttagaaattaaggaaatttaggggataatttatctccttagcttaaggaaaagtactaaaacttcaagtaaatcttttagtgaattagagttaatgggggcatttttattgatcctttcctacaggtggaaaaaataaataaatcagtgtcacatggactgcctgctgcccaataatgtattgactaggcaagagaattaccagacaaaagttctcttgcttaacatatttgggagaggaattaagaatagctaggaatctttggtcaaaaacttttctgcctaaaattaagaagtaagtttgtagagttgttttcattttaatggtaataaccatatataaatttagacatagactaaaacttagttgacagcatcatctgtctgcttgattttatatatttttaagttcttgttatctcctcttctaggcaaatgagcttctccagcgttcccgacaagttcaaaataagactgaaaaagaaagaatgttaagggaatcattaaaggaatatcaaaaaattagcaatcaagtggacctttccaatgtttgtgctcagtatagacaaggtgagaaataaaatgtttcttgtatcttttactcaactcaaaagacaaacaatagtgtatgaatgaagcaagctaatgatgaaaagccactttccagatgcaaatcttctttcagcatcagaggccgagtgaaaggacgtaggaatgtggtatcattgtgttgcaatatttgatgactacactgacctgcagaagctgtaatgttctttctattttttgaaatgtacttttttttttttttttttttttttttgagagtctcgctctgtcagccaggctggagtgcagtggcacgatctcagctcactgcatcctctgcctcccaggttccagcaattctcctgcctcagcctcccgggtagctggtattacaggcgcacgccaccacgcccagctaattttttatttttttatttttttattttttttattttgagacagagtcttgctctgtcacccaggctgaagtgcagtggtgcgatctcagctcactgcaagct

SEQ ID NO: 114885 - DNA, 1401 bp, Homo sapiens
atgtggttgtttttgcaatcagtctatcatgttatcttagttagctatcatgcctaatatatatttctcttagatttgagatgtatgatttcattcatctcatttgcttaaaagtatgaaacagtacagagcccctttataaatttcctgtttacaatttattatacagagccttttgatttttcttcagtaatatttcattatctgaaaaacttaggtacatcaggtatgaaaattttctagtattccactcttctagatagcttagtaaaatgttaaatgaaaccactgcaagttttaaaaactgaataaagccattaagttcctagagaaagaaatttattgtaattgtttttattcatttacagcacaatcattaaaacttttttttttccagaaacatttgggatgcaagcttagttgtggagagaatattcaagagtggcaacagagagatcactgcagtaagtgtgtataatattattttgttatttttgtgtagccagttgatggtataaatggttagattgtttcacatttcctgatattacacaaataagatggcaaaggttatttttttttttttttttttttttgagacagagtcctgctctgtctcccaggctggagtgcagtggcccagtctcagcttactgcaacctctgccctctggggtcaagcgatcctcccacctcagcctcctgagtacctgggattacaggtgtgcgccaccatgcctggctaatttttgtagtttttgtagagatagggtttcaccatgttgcccaggccagtctcaaactcctagactcaagcaaaccacctgccttggcttcccaaagtgctaagattacaggcagggggcctcagcgcctggcgggttattcttttatgtatatgtttgcattcttggacaacaaactgcttaccttcaggtttaaatctcatctctaacattgattaactgtctgaatatgagtaaattacttaacatttcagagcctgatacctcatggtaaaagaaggggcgtagtatatctccctcataaggttgtcatgagggataactcaagcaacttaatattgctcaaattttactatgtaatactttgacatatatatgaacgaaaactccatggacccagcactaatttctatgaattggcatactttacagactgctttttgctcttgttgcccaagctggagtgcagtggcacagtttcactcttgttgcccaagctggtgtgcaatggcattatctcggcccatcgtaacccctgcctcctgggttcaagcgattcttctgccacagcctcacgagtagctgggattacaggtgcgcgccaccatgcccagctgattttttgtatttttagtagaaacagtgttttactatgt

SEQ ID NO: 114886 - DNA, 2442 bp, Homo sapiens
acttccccaaacactatgccaattctgcttaatatgtatcattagtattgaaggcttctgaattactttaaggaaacttggtaccaaagagatatttctatttagaaaatatttaagaatttgaaatgtgattttgttagaaacgttttttgaagtactatctaaccataacctagtatgaaaattacaatgccatttactcacaaagtaaattctatgcattgcatatctttttcttagaagttatcagagtcccttataattcttcctggtagcagtttcaagtccacatttactgaataaatatttattataagtcttatgcatatactttactgtcagcacaatacattgaagtctctaatgtttaaagcatttacttggaagctaaacaggaaaaggaacaattccagtttttaagatggatggtttgttttactgaataaactcaacctcttgtcataaaaataggtatggtggtgaagcacagatgagatttccaaccactcttccgcctccaagtaatgttggtcccatcttggggtctcctgtctattctagtgagtatggaacattgaaatgaaattgtttctaatcgtttgaatcttagaacctttatagcaatttttatcaataagccttttcattatgttttatttactgctattgtataattgatgaatacatctatagattctgattcttaaaagtgatctattaatattgaatccttaatgtaaggaagcaaaataagatgtaaccaatcatatttacataactcatttggtatatattcagagggaaacagatgaatgatttaataattaactcgcacatcagtgttttccaaggtgggagttgttagaaacttactaggagatcagtccctaattcttgcatatatcgtggacaatgtaactccttatgcttagaaatagcttctgtggccaggcacaatggctcacacctgtaatcccaggactttgggaggccgaggcgggcagatcacctgaggttgggagtttgagactagcctgaccaatatggtgaaaccatgtctctactaaaagtacaaaaagtagccggcctgtggtggtgtgagcctgtaatcccagctactcaggaggctgagacgggagaatcgcttgaacccgggagacagaggttgcagtgagccgagatcatgccactgcactccagcctgggccacagaaagagaccctgcctcaaaaaaagaaaaaggaaataccttctttacctaattttgatcacattcaaaagattgagatgttcttttctaaatctttatattcttctttccctttttaggttctcctgttcctagtggtagtccctatccaaatccatcctttttgggaacaccgtctcatggtacctcttttctttgttttggattggattcattttgaagtgctaacattatgagttaaccttaatgcttagtgtgaaaaagatgaacttgccttattcccttgaaaataaatataattttagaagcgctgtccaagcaagttttggcatttggatgtgaatgcctttatttaggaggaactcctcttataataagcctggaaagcccattatttggctaccaggattaaattgaaccctaaaatctgtgtaatcagttctatttcactgtcagcattacaagcagtactggcaagtttgtttccttttcattctgcattgtgaacacttgcaagtctatctgggagtacccatccacatttaaatctctcttcttattaaggaaaaccaagttaaatatctatgtatttcattgtttttgtaaatacctttgtgtctagatacacaaacttgggttatgagaattctgaattttatgggttctaagattaagagatttatgggttctaagattaagattaagagatttatgggttctaagattaagattaagagatttgtttttcttatgtgtgtacaaggtatacagcctcctgccatgtcaactccagtgtgtgctctgggaaacccagcaactcaggccacaaatatgagttgtgtgactggaccagagattgtgtactctggaaaacacaatggtatttgcatttacttttctcggatcatggggtaagtttgtcatgaaataatgaattattgctcaccttgtcccatcttgagtagttaaatatttttaactctgaatttgggacatcatttattcctattaaattttagttttagctcacttgttgatcaataaaacttttctattattccagtttttgttatctaactatattcattgctgtgttttatttctcttactctctcataatctatttttgtagcatcaaaatacagttgttccttaacacaggggttaggggatgccaaccaccattcctcaaccttcatgtagtcaaaaattcatgtacaacttttgacttt

SEQ ID NO: 114887 - DNA, 1045 bp, Homo sapiens
acatttgaaagcaggattaatatgagtcttgtagtgagctttcagatttttattctctgttgttgataaattcttttttttttttgagacagagtctcgctctgtcgcccaggctagagtgcagtggcgtgatctcggctcactctaagctccacctcccaggttcattccattctcctgcctcagcctcccaagtagctgggactacaggacccccccaccacgcctggctaattttttgtatttttagtagagatggggtttcatcatgttagccaggatggtctcgatctcctgacctcatgatccacccgcctcggcctgccaaagtgctgggattacaggcgtgagccaccatgcctggcctgttgttgataaattcttattgaagtctgctagtaagagtttcttgttcaggttatatgataaatgccttttcattaaaagcacaagacatttagggacaagttgtttttggtttgtttgtttgtttgtttgtttgttttggcttaatgacctgaggaagaaacctgaggcaacagtgtagagatcttagtatttcagagccacaactggaattgatacggttaaaattgggagtagttcaaagttaagtatacagactctggattcaaagcacctgtgttaaaaatcccagctccaccactgaggtaaattacttgacttctctgggcttcagtttccttatacattataataggatgtggtatgaggattaatatatgctaaactcttaaaatagtacctgacacatggtaggtattcagtgttaccacttaattgttattttctagaaagcagaaagaccacaggaagaaaattggagacataagccggaaactaagtcagaatctaggttaaaaggaaaagagaacatcctgtaatcctagtgcttatgatgaacttaaaaccagtagtgtttacttgtctttttaacactaactgatttcattcagtcagcaagtatttattgaatgcctgctctgtgctagatacagactttaatactgcatctagcagtaca

SEQ ID NO: 114888 - DNA, 1033 bp, Homo sapiens
tatgatagttttattttgtcctttaagtcttttgatctatttggaatttactctggtataaggtatgactatgtttctagctttttttttttttttttttgcctaaattgatataaatagtagcaacatgattaattaataatctaactttaattctctggtttaaggggcagctttgccggggcaattgcattaagttttctttatagatatatagatctactggaggttgagtagagaagtagatgatctttttgaccagttgtactttttatatcacctcagccattcctcctgcctcagccccgtgatgtgctggaaatacaaatgtgggccaccatacccagcctactttgtattgttgaatggttttttttgtttgtttcatttattttatcaaataaggtagagtcagttgctatcagccaatcttggtaaatctcttgttcatgttctttcttcaaatttcttaggggagccttatgtttcataaacttagacctgtagatcaactgaggcatctacttgtgagtaatgtgggaggagatggagaagagattgaaagattctttaaattacatcaggtaattatatatacttttaaaaaatgtgatgctattttaaacaaacagtgggagtcatagtttatgtaaattgggactggaatactgtaataaatatatatatatattttgagatggagtttcgctcttgttgcccaggcaggagtgcaatggcgcaatcttggctcactgcaacctctgcctctcaggttcaaatgattgttctgcctcagcctccccagtagctgggattacaggcatgtgccagcactcccaactaattttgtatttttagtagagacagagtttctccatgttggtcaggctggtctcgaactcccgacctcaggtgatccgcccacctcggcctcctaaagtgctgggattacaggccgtgagccaccaagcccagccataaatagataatcttaacaatattcctttctttgcctaagtcactgtatgtgaac

SEQ ID NO: 114889 - DNA, 1051 bp, Homo sapiens
acatggtggcaggcacctgtagtcccagctactcgggaggctgaggcaggagaatggtgtgaacctggtaggtggagcttacagtgagccaagatcgcgccactacactccagcctgggagacagagcaagattctgtctcaaaaaaaaataaaaataaaaataaaacaaattagacgggtgtggtggcacatgcctgtagtctcagctacctgggaggctaaggcaggagaatcgcttgaacccgggaggcggaggttgcagtaagccgagatggcgccactgcactccagcctgggcgacagagctagactccatctccaaaaataaaaattagtcaggaaagttatgtatggttttagcagagtgttgcattgctgtatgtaattgcttcaataacacatttacctcaggtccttgttttctattactgatgcataattttaccccatcttcaggtgttaggttatattttagcacttgtccattcagacagccattagcacggcctaatacactgacgctggttcatgtccgcttacctcctggattctcagcatcttcaaccgtggaaaagccttcaaaagtacatagagctctttatagtaaaggtaagttctgaaatactatcagatttaagattatattcttaaaattgttaaaattatatggtgttgtgaagtatttgaaaataccctatggcaacagtagaaactgggaactactagaagggtcagggaagtaggggagcaagggttgaaaaacggactattgggtcttatgctcagtacctgagtgatggaatcagttgtaccctaaaccttagcaccacgcaatatacgcaagtaacagatttgcacatatacctcctgaatctaaaataaaatttgaaattgtagtgaaattcaaaagttgaaagtgtagttttcactgctacatttaggtttttgatctgttttgtgataatttttgtatgttgtgtgaagtaggaatctgacttcatccttctgcatgtggttatctagctgtctgagcaccatttgttgaaaaga

SEQ ID NO: 114890 - DNA, 1029 bp, Homo sapiens
gcaggttctgtttaacttgaattatcaaattgtatcagacttcttttagtaattttaaaatgtatattatagaagctgttgactatgttaattgtcagtaagaattgagtaaggctgggtatggtggctcttgcctgtaatcttagcactctgggaggccgaggcaggcggatcacgagatcaggagatcgagaccatcctggctaacacggtgaaaccttgcctctactaaaaatacaaaaaaaaattagctgggcatggtggcgggcgcctgtagtcccagctactcgggaggctgaggcaggagaatggcatgaacccgggaggtagagcttgcagtgagctgagatcgggccactgcacccagcctgggtgacagagtaagactgtctcaagaaaaaaaaaaaagaattgagtaaacatatagattctgatgataatgcaaagatttttaaaaactgtggagtagctaataaactgatttatgtattctttcttaaataggttctggagttcttaatgatagtttgtctggtggaatgcagttgcttccagatcctttatattctcttcctactgataatacttaccttttaacaataacttccactgataatggcagaattttcttggctggaaaggatggctgtttatatgaagtagcctaccaggtaagtctgacatttgtaaacgtttttttttctctcttgatggagtagggaaagataagcctttattttgttttctaattatataaggacattaatatatttttatggtaaatattcaagcatacagttgaagctgtagtccccatgactacaccatgcctacaaaactcagccctcagaggtaaaagtcattattctatgtatgtcctcgtggaacataaggcacacatcaatgtctctatagatatctatgcatatgtgtttgtgtgtatatacacatatacaaatacaaaatgcacttttgcaaatatgtgttttcacttggattattgatttaattcgtaattgcttttttttt

SEQ ID NO: 114891 - DNA, 1034 bp, Homo sapiens
tgtgtgtatatatatatatgtcattttttttaatgcatctatcgatggacacttggattttgttttcaccttttagttattgtgaaaaacactgctatgaacatgggtatacaaatatacatctctatattttaatatatttaaactattttgtaatataacacttttaaaatagcattaaatactgaagtgattgttttctaaggtggttcttttccactgctattaactttttttcctcttcattatcttgatgacattcaaaatttacttatttaaatgatcatacataataatatttttaacaacagaattgactaaactgcatccagacttttcatataccatttaattagtagctcactttaatggtaataaaagcttactctgttagtgcttaaatgctgaaagtattcctgccctgtgtctactttatcttaggcatctttcaacctcatgtgcgacacctcctggttttggcgacccctgtagacatagtaattcttggactcagctatgctaatttgcaaacaggtatggcaacccacatgttaacgttttttaaaataatagtattttggccaattgatattacagttaaaagctaatctgggtgaaatgttgaattccattgactcacattaatgattattactgccaaatcctcaggctcttttccacaagttaacattgggttagttttttgttttgttttgttttgttttgttttttgagacggattttcgctcttgttgcccaggctgcagtgcaatggcgtgatcttggcttaccgcatcctctgcctcccaggctcaagtgattctcctgcttcagtctcttgagttgctgggattacaggcatgcaccaccatacccggctaattttgtttttttgtttgtttgtttgtttttgataagggagtcttgcactgtcgcccgggctggagtgtagtggtgcaatcttggctcagtgcaacctctgcctcccaggttcaagcgattctcctgcctcagcctcccaagtagctgggatt

SEQ ID NO: 114892 - DNA, 1023 bp, Homo sapiens
aaatacaaaaattagccaggtgtgaagtggagattgcagtgagccaagattgtgccactgcacttcagcctgggtgacagagctggaccttgtctcaaaaataatagtaataataataataaagatcattgtaagataatacttggttttctgtttttcttttcttttcttttttgagacaggctctcactttgtcacccaggctggagtgcagtggcatgatcactactcactgcagcctcaacctcccaggcctttgcgatcctgccaactcagtggcctcacacccccatgcctggctaattttttgtttcttttttgtagagacagtctcactatgttgcccaggctggtcttgaacttctgggctcaggcagtcctcctgcctcagactcccaaagtactgggattaaagacatgagccaccacatctggcctatttgctttatatgtgtaacatgtttttcttcatttattcacagaggagaccttgcctattttgatggacttagtgagactattcttgctgtggggcttgtgaagccaaaagcaggtaagaaataaaactataaggaagagattatgtttgtatatgtaaactccaaatggtatagacctgaacaacaacacacatttttttcgagatggagtctcgttccatcgagtaggctggagtgcagtggcgcaatcttggctcactgcaatctccgcctcctgggttcaagcagttctcctgcctcagcctcccgaatagctgggattacgggcgtgcgccaccacacccagctaatttttgtatttttagtagagacggggctccgccatgttggccaggctggtctcaactcctgacctcaggtgatccgcccgcctcagcctcccaaagtgctgggattacagatgtaagccaccgcgcctggctgacaacacccttttttaaacaattgtattctccattgaagttttattttgaattctaattagaaatatgtaaagtgattattaatgtttaactgtttactt

SEQ ID NO: 114893 - DNA, 1047 bp, Homo sapiens
cctccacctcccaggttcaagtgattttcatgcctcagcctccggagtagctgggattacaggcctgggacaccatgcctggctaattttttctatttttagtagaaacaggtatcattgtgttggccaggctggtcttgaactcatggcctcaagtgatccacacgtctcaacctcccaactttacctatttgtacatatagtcaattaggtaatttttcctatataaagcctatatgtatagttcatagttactttacatttcttgtctgatagtttggattcatagctgagtctggttctattgattactttgtttcttgacactggggttttttttcttgttattttgtgtctcatgatttcttattgaaagccagaaatcatgttaagacagtagatactgtaagtaagtagcaagtggtatttattcttagaaatgggcatgtcttttccttggctaaggtatagcagatctttattatatggggaattgcctttttccaggtcaggacttgagctggatttgggttctgttgttgtacttagggtgcaagttggtttactggagattttttctcagtgttcctcttacatcctcagtcttaggctcttcctgtgattccatccttgtaagatggccctcttcttacccttatccctgccccagcagtagattgctattacttgatgtgcagccctgttgtggagatgtttggaatggggagcagcattttctatttttgtatttccctatttttctagttcatccttagccataagcaggtctggatccctgggtcttggaactgaaacagttttctttgcttgtttattttttcattatatatataatgaaaaatatttttatatattcaatatatataaaatgaaaaagttatatatatatataaatttttcataaagaccaagtctcactgtgtttcccagggtcttgaactctcctgggctcctgcctcaccctcccaaagtgctgagattacaggcatgagccacctctcccagtcttttttttttttgagacgg

SEQ ID NO: 114894 - DNA, 1476 bp, Homo sapiens
tgaggtcaggagatcaagaccagcctggctaacacggtgaaaccccgtttctactaaaaatacaaaaaattagccgggtgtggtggcggacgcctgtagtctcagctacttgggagactgaggcaggagaatggcgtgaacccgggaggtggagcttgcagtgagccgagattgtgccactgcactccagcctgggcgacagtgcgagactctatctcaaaaaaaaaaaaaataaaataaaataaacatttcctttgttacagagcaagttttttgagatatgactttccctttaggcctgaaaccagtaactgttcctaccttcacaagggaatatttcaggactactttgtgttgggtcaaaactagaatattctctctgtacctttggaaccaacacacaacaatttttttgtggcactcaatccttttgtttgcccggttgatgagcagtacattattataaatacttcattttctttttgtagataatcccaccgtttctggcatgtcagatatggattatcctttgcaaggacctggtttgctgtccgtacccaaccttccagagatcagttccatccgaagagttcctctcccacctgaacttgttgagcagtttggacgtatcctattactttgtatttattttaaaaatgttaaaattggtatttttcattcttataattcttgttctatgtttaattaatgtgttatatattcatttaagggttttatttaaaattcgtttaagtatatgggttccatgttgtattaaagagtggacacattgtgattttttacgtaaatattaagtcaaaagctattgaaacaagttaaagaagaataagattcacctctgtctgccttacatccacactacctcagatatgcagtgtaattgcatgatgggtgtgttccctcctatcagcagagcttggctcacaattgacagtgatatattcatgtggaactatgaggatgggtatgtatttaaggctggtttgctttaagggtgattggaatttatataaactttactgtagctagtgttctcattagaagctgcttggtttatctttcattcatctagcctttgggtcagtgcttctcagtatcagtcatctggagatgttcaaatgtgcattctgtcttagtagtcctgagtgaggctcaagagtctgcatttctaacaagctgccaactgctgctgctggtttaggtgccattcttgagtggcaggagcccgggtcccaagctgttagcccgtagtaaaaatagatgttggcaattcattgagagatgattggacatttttaaagacttctgttttccttgcatttctatggagtaggcatgtgatatttatttattttgttgtcattttgtgaatttgacccgtgtgtaaattatatgtatagaaatgattctgagtgaaagcctaaggtacttttgcttaaatacagcatgttggtc

SEQ ID NO: 114895 - DNA, 1838 bp, Homo sapiens
attttaccctgccacaccccaaaaccctcaaccccctcgaaagcatcagcagcctcctagctccacccacaacctctagccccctcccaacagcttcctcttcccaggccagaacggcgtcttccagttccccaccggatgaagcggaagtgcgtcatgtcgaggcgccaaggcgctcgtttggcgcgcgcgccctaggcggcggatctaagctaacttcttggatcttttcttgtttctccttggtttttgactttttctggaccctggtgtctacgatttccgagatgccgtcttctttgttgggcgcggcgatgccggcctctacatctgccgcagccctgcaggaagctctggaaaatgctggacggctcatcgaccgtcagttgcaagaggaccgcatgtacccggacctttccgagctgcttatggtgtctgccccaagtgagtgatagtgaccctgctttctcaacctaaaggactctcgcctgacttcctaatttgctacttatccccagcgttggtcccggcgaggatatgctgagatttatggcactgttggctgcatttttggagaacagcaagcagcttcttttcaggttttttcctttcctcactttcttcattgtagatacttgagagggcaagagtgaagagcaagctcccagttgaagcagaaagaggcaaagacctcaaccttaatgagcttctcgccgctctcaagtgcttatggctaaggccatatgagaagcatctccagatccaagtcccaaatttgttcatttctcctgttagtgtttgagtagatcgtaagagcaaacgaagttaatttggaaatttagcatgttatcttaaagatacgctttgctttatatttatttgtttatttattgagacggagcggttccctcttcgcccaggctgaagtgcaatggcgcgatctcggctcattgcaacctccgcctcctgggttcaagcgattcttctgcctcagactcccaagtagctgagattacaggcgcctgccaccaagcccggctaatttttgtgttttttaagtagagacggggtttcaccatattggcctggctggtcacgaactctgacctcaagtgatccgcccgcctcggcctcccaaagtgctgggattacaggcgcaagccactgcacccggccaagaaacgctttattatgtgtagagatgtgtgttatgaaatgctggaggatcttaaaagaactaccagtggaataaagaaagagaacagggaaatcacagtgcttatgtacagggagagtaaggcagaatatgtgttgacaatataggtgactggaaagtaatttgtttaacagttttaagttataaccagctccccacggcttatggaattacatcagttgctagaaaaagtgacccctttgtgagatggaatttggagaaaaccagcgaagtgtaagaaagaaaagattgttggtgagcaagaaccaaagtaatctaaataggataatttgtgcagtgtaaaccgagaacacttctgattatttataaaaatcattgatagctttgtaatcaaagaaatgatagaaacaaagatagtatttgctccctacagctacttaccaatgagcgtgtcttataatacctgattggcctattagcaattatcatcttgaacaacattactcattttggcctccttaggtgtgaaaacaagatataaaaacagtgcatgcattctggtccttctcttacatatctcatgcctttacacacaccttcctctttcacccagtctcttccccttcttttccatccaatttttcatccgttgctctgatta

SEQ ID NO: 114896 - DNA, 1034 bp, Homo sapiens
tcagatcttgccgggcacagtggctcacgtctgtaatcccagcactttgggatgccaaggcggatggatcacctgagattggtagttcgagaccagcctgaccaacacggagaaaccctgtctctactaaaaatacaaaattagccaggcgtggtagtgcatgcttgtaatcccagctatttgggaggctgaggcaggagaatcgcttgaactcaggaggcggaggttgcggtgagccttgattgcgcattgcactccagcctgggcaacaggagcaaaactctgtctcaaaaaaaaaaaaaaaaaaagaaaatatatatcagatcttgtcacttctctgctccaaacgtctggtttcttcctatcacttcaggttctttgccttggcctctgcaaatcacactgactttatccccttctaccccctggcttgctcactcctctctagccacattgatctttctggttttctttggagacctctattcttattcccgcatggaaactttctatttactctttcttccacatggaataatacccagaacttcacatggctcccttattttgcttggatctgtgctcaagtgttaccttctctgtccatcttatataggtcccccctgctccccatcccacctcttttcctatcactgctttatggtacttatcattatctgacatttttgtgtattggtttattgtctttcttcacataagaatgtaagttctatgaggacagtctgtttttttttttttttttttactgctgtatcctcagtggcttgacagatacctagcacatagtaggtactcaagaaatattagttgaatgaatggaatggccatccttggctgtgggcatggctactttcttcctaaacatttcattgaatcaaagttagcttctgatctagtcacaattattctttttttttttatttttattgatcattcttgggtgtttctcgcagagggggatttggcagggtcataggacaatagtggagggaaggtcagcagataaacaagtg

SEQ ID NO: 114897 - DNA, 1022 bp, Homo sapiens
aataaaagaattatgacatgaaataagcatatgcactatagcaccaacagttcaacagttagcggatccttcttttgtgcaattttctaaacaattaagatgaattaactcatataatcctcctactgctccagtgaagtggaggtacagttatccatcccctttcgacaggtgaggaaactagtattcggaagtgctaagttctctaaggccacgcagtggtaaatggcggagtcaggtttcaaatttagggaagctactccagaatccatgtgcttaaccattatgccctactacactactggttgtgacctgttctgcttctcagggtcatctcgaatctctcctacatttgcctcatgccctatctgtgtaaactgtgaacagtctttggttctgactgtttcatgcattccagaatactttttcttctctctggatgctgatcaatacttagtacacctctattcagtggcattctatgtaagctgtgacgcttgtaaggtactttgtgacagacctatctctttcatcaaggaagacctttttcatttttcagaattatttttccctgtgaaaacagagcattttctccttgtgaaaatcttcactgactcacaaaagtggtgttgaataccttctcttttgtgctacctctgatttgttatattcctgtcttacatttttagtaacagaactgtggagatatcagggtgaagtgtgtattaatctttattctacttctaaaaagatgctttgtttcctaaatgaatcaatcaacaaatattctttgtagagagaaggctaaggatttgaggctttgagaagatggttcaggttgttaatttgtgtgcatgagaatggggtatacatgaggttggtattgccactgacatcctagatgagggactttttcagaaataggaaaaatggtgcaactcagacccagctcagcaggtgaaattctccctctctcttggtggttgtaaaagaaagtcttctccttggggtgggagtgagag

SEQ ID NO: 114898 - DNA, 1041 bp, Homo sapiens
agtgagtaaatgaaggtattagttcattctcacactgctatgaagaaatacacaagactggataatttgtaaaggaaagaggtttaattgactcacagtttcacacttctggggaggcctcaggacacttacaatcacggcagaaggcaaaggagaaacaccttcttcatagggtggcaagacagagtgcgacatgcaagcaggggaaatgtcaaatgcttataaaaaaccatcagatcttctgagactcactctcaggagaacagcatggggaaactgcccccatgatccagttacctccacctggtcctgggaatgtggggattacaattcaagatgagattttgggtggggtcacagccgaaccatatcaatgaagaaatgaattaatgttaagttagtgttattagatctccatagtttcactagaatagactttaattctggttgcctgcactggtagctgtacttcagtgatttctgcgagaaaatagcgctcattttcaagcttctttttggcagtccttactgtcttcccccagcacccagcaactttgtagcagatctttgttattgggtagaggtttaattatggcttatagttgtatgtgaccttagcctagaagggttgtttctgatttgtaagtcatttgaaatttctgtaaggatgttcatcagatagaattgctcatattattttagatatatttaccatcattgttgttattgggtgtagaccacagagcctgggaaataatcctttggttggttttcaaaattaagccaaaacaaaaaatggtatattttcctctcttccattgggactgtagctcttgttatgaattctggtaataaattacttcatcgaagtcaaatagtttatgatgttccttggcaggaaaatcttgaaaatattttactgttatagcaaatttcacactaagctatatttcaaaaagtcattagtaaaagttctggaaaaagaacagtcaccatcaagtgatatgctaccaaaagatggattgctactattttagatga

SEQ ID NO: 114899 - DNA, 1032 bp, Homo sapiens
gcaacttctgcctcccaggttcaagcaattctcctgcctcagcctcccaagtagctgagattacaggtgcccatcaccatgcctggctaagtttttgtatttttattagagatggggtttcaccatgttggtccggctgattttgaactcctgacctcaggtgatccatctgccttggcctcccaaagtattgggattataggcatgagctaccttgcccagccgctagtgggtatttagaacccatttgaggttgatgttcctgattttgtggaattatcaatttgtccatttgtgtaacatttttttttctggcaatacttaatgtagtaaaattataaacattgtgcttagtatcttaccaactttccttttcttttcgtacagccatcagatcaagtcattacagtatagtaacacaggagacatgattcttgttgtatctggaagctctcaggccaaggtgattgacagagatggttttgaagtaatggaatgtataaaaggagaccagtatattgtggacatggccaacaccaaggtaagcattaaacagaatattttaatgaattaattcagcacacatttattaacaactatttgagttatcatgtaataattttccccaaaagttagtgtcataaaacaatagcaatttatttgttctcacaatcatgtggattgattgggtggttctgcttcatacagtatcagctggagcactaggatcgctgtaagatacaaaaggggcccagatggtttgcagtcagtgtcctgctccatggcatctctctgtgtctttgcctcttccttacttctaccccaccccttcccttcttgctggctctctgtctctctgtctttttctcttgccacatgtctagtttgggtcttttcacagtgtggtagtcttaggtgtattagtctgttctcatgctgctaataatgacctatttgagactggataatttataaaggaaagaggttaattgtttcacagttctgcatggctggagaggcctcacaatcatg

SEQ ID NO: 114900 - DNA, 1057 bp, Homo sapiens
gataaaatatagaatttgattttacctcatagtttgaattaggttatgcatttttagaaggactatgacagaaatgatatggtgtcctcctttcttcatcataccaggaagtatgtgatgtcagcttcagtttgtccttgcattggtgatgttaacctagatcacttgtttaaggtggtgtctaccaggtttttccactataaagttactgtcttctcattgcaattactaagtaatttgcagggagattttgaggctttgtaaatattcattttcaaacttttctccacaattttagcatctattgatgattctttcctgaatcagttattactgtgatgattgcaaaatgatgatcttttaactccatcatttattttatgtttatcagtagcattctactaaaaggaagagctttgtttgtttgtatatttattatattagtatacactcaatggtccttgttttagtgaatggtttataattcgttactatcattatttattgtgatgccctaactattccagatttagccagcagaaggctcttcaacgtgtgctttatccttttaacatgtctccatcatctttgtagtactttctttttttttttaatacaacaaaatgttccacgttcatcttgctcgtttcctaccccatctctgtaatcaataatttttgcaagaagccctggttccttttaaggagaggtgattgttagagaccaggatctctgtgttagttttgctggaatatattacttctagacattcttaacatacagaattagagaataactaacacatatatacatatacaacaattttatctacctattaaaaatcatgagttcacattgatacccttaatttctatttaacatcagagagttcattctagtcttccgccttttcacttttgtaactatcttctccaacagggctaaaccttactccagttgtccccagcacatttcctccttggcttagttcttcattatattgaaggcagtttcagaattgctaatgcataccactgcaaaaaagaaacaaatgtat

SEQ ID NO: 114901 - DNA, 1048 bp, Homo sapiens
tgaacataaatgctgaacaataattcctatatagggattatatactgtagaagatgcaaatcagtattttcttttttatcctgaaatcaatatgaaaaatagttaatattatcattagtacatcttgaagtgttaagtcaatttgattttaaaatatttatttatgaatttagaccagatgcggtggctcacgcctgtaatcccaggactttgggaggctgaggcgggcggagcacctcgggtcaggagttcaagaccagcctggccaacatagtgaaaccccgtctctactaaaaatacaaaaattagccaggcgtggtggcacactctgtagtctcagttcctcaggaggctgaggcaggagaattgcctgaacctgggaggcagagttgcagtgagctgagaccatgccactgcactccagcctgggcaacagagtgagactctgtctcaaaaaaaaaaaaaattatgtatgtgtttatttttaaagaagaatgtagaagtctccaaagagttggagagtatacttgtttacaggtttccctatattaacagaggatttgatagaggttgggttgaatttcttctagggatttctaggtcaggcaaggtagcatcaaggacagccaatccactgcatgtttaaattcacacatgattaaataaatctgttcatgtatgatgcaccagtattcttgtgtgtggtgaccctgttggccatttatcaaatagtagtatatgaaggagaatgctgttcctatgaaaattcatgaattgaatttagttgcagggatggaaataaaggtatttccatattgtggactttgcagttcttgaagttcataaagttaaaatatctctttgttttgactttgacttttctgcaaagacttgcatattataataagtgggttttctttttaaaactgtcctttaaatttctaagtttctgtgacttactacatggcaaatttatttgtatactatttctaaatcccttcttttctgttatgtttttatttttaaagtttattttattttttgtggg

SEQ ID NO: 114902 - DNA, 1063 bp, Homo sapiens
tggattattaatttttcttaccctgatacttactgtcataatttggtgtattctttttttttttttcttctttttctgtttttgagatggaatctagctccgtcgcctgggctggagagtgtggtggtgtgctcttggctcactgtaacctctgcctctcaggttcaagcgattctcctgcctcagcctcccgaggagctgggattaccggtgcccgccaccatgcccagttaatttttgtatttttaatagagacagggtttcattgtgttggccaggctggtctcgaactcctgaccttgtaacctaccctccttggcctccctaagtactgggattacaggcgtgagccaccatgccaggccaattctgtgtattcttatgctacactatcctcatcactaagcaagatgtattgaacttttcttataatttggcctggcataatttatcatatcgaatttattcttagcccttctctactcttccactctctctcttctacctcctttctgtcttcctcccccacttttcctctctcatgctttttcctttacccattctcctcctccttcatctcacttaacacaaatattaatccagagcatattcctgtaaagttttatagaaatattgatttatttgggtgttgattgccagaaatgtgttagtcagtaggagtataaagctttttgaggccgggcgcagtggctcacgcctgtaatcctagcacttcgggaggacgaggcgggtggatcacctgaggtcaggggttcaagaccagcctggccaacatggtgaagccccgtctctactaaaaatacaaaaattagctgggggtggtggcacacacctgtaatcccagctacttgggaggctgaggaaagagaatcacttgaacccaggaggcagaggttgtggtgagctgagatcacgccgttgcactccagcctgggcaacaagagcaaaattcagtataaaaaaaaaaaaaaaactttttgaaagccttaggaaattatgaattgactcttactgtcccttaataacataaactaattgtttt

SEQ ID NO: 114903 - DNA, 1053 bp, Homo sapiens
aggggatgagatcaaccaggcagggagcttttcacttttgagaaaaggacccaagactgaatcctgaggaaatgacgatatttaagagacaaagaagagtccacagagtgctaagatcaaccaagaaataggaggaaaactgagagtactgtcacagaactaagagaatgtgtcaaagatctgagaatagttatcaagatcaatggctgctatgaggccaagtaaagtgttgtctgaagaaatgtcttttggttttagtaacatgttcgtaccctttgtttctaagcacaacttgttcctcccacttagaatgttctttacccatttttgtactggctgaacacccagtcttccttccagatgtttctcaaatagtccctcctctatgaagccttccccagcaaaattattttcttgccctagtttgatagctatagtaacacatataaggttctcatagatggttttgtgtacatctctgtgctctgacaagatattgaattcctgagttcaccaagtttgtatgattttttttttaggactggcatcttgtgttactcatctttttattcttaatgttccacacagtggctggcaagtaggtagtgcttgaaaatgtttgtggatttgaaagcttgattttgaatatggccttaggcaaaaagcagcgtttcaaattgcatattaaaagtcacttcaaaaccgaaatttctaagtagcgctgcctattggatgaactttatcatatactcttttctctaacaacattcaaatacaaattgcaatctattccaaaagatgcattgctattgaacataggagaaggaggtagataggtaataatctataattggccaagaatagactagtcttgtactctttagtaagtgtttggatccaaaatgatctttcaggaaagtgccacaatatttaacagtcagtcaaagagtctgttgttgcctagatgttggaataaatttgataacttctggaggattattttaagtccatgtattcatttgtttaagttaagtatattaagccacttcctac

SEQ ID NO: 114904 - DNA, 1118 bp, Homo sapiens
tttgttacagtattagttagtaactaatagttactaggtatagtaagggtcattttaagttatagaatgggtcatttttagaatgggtcatttttactgttgcattctggtcctcatttctggagtaaatttaagagttgtgctgtccattgcatttagactagttaactatagggataggtgaaaaccaaactatgaaagcaagccttttaatatttcaggaaaacgtgtattgattacagcctctggaaactggactaacaatactgtaggaatacttttcgaagtccctgtatcagatttccctatatcagcaatataacataagaatgctctgcttgcttagcagtgtctgacccaattttatataatgattatacaaccatagattcacacacagttatcttttagatgttaaagtagaagggtatgctttgcaaccaggttgacctggattagaatcctaactctgctactactaactgtgtcaccatgggcagattatataacttctcacatcatctctcaaatggggataataaaagtaaccatggtaaaatgctgagcttagatgagataacatgtgtaaagcccttaacatagtgctgatataatacagacctaacacatgtttagctttgattcatattattgtacctaatggtggagctgtaagcaacgagcatctctgtgattgttggtgtaatcctaaaggtcttaagtaactggaaaacatatggagagtatgccaagtttcatcttgtttcagcatgggctgtccttgtgcgtagcacttctttaggatgtcgccaccagtactttttatcaaatagcctgtttctgatggtaaaatgctgcttaggtggttccacttgctctgttgatcctagtagttcatagcctctgtgcaaagttttaaaagcttttctggatctactttattttctcatttgaactctgtgccttagctgttggtgattttttctcctacatgcagttcttccgcccgtacacatagaaaatgtatccccctagagttatttaagagaatagaggctgggtgtggtggctcatgcctgtaatcccggcactttgggaggccaaagcaggtggatcac

SEQ ID NO: 114905 - DNA, 1142 bp, Homo sapiens
gccatgctggccaggctggtctcaaactcctgacctcaggtgatccacccacctcagccttcaaaagtgctgagattataggcgtgagccaccacgcccggccccaaattcacctttttacatatggataaccagttatcccagcatcatttgttgaaaggactactctttttacattgaattgttttggcatctttgtggaaaatcaattggccataaatgtaagggtgtaagtggttatttattgcagcattcattcctaagtctagatatcataagacctttttatttttccaaaccctttgattgaatgaatattctgagtatgttccagagccatgtaacttaaataactgtaagtagaaaacatgagcaccaaataaatttctcctaaatgcaactgtattcttagtgcaattactgtgtacatgtataaaaattgtgtccaaagtgtttataaacattactctgggttttatatagaagttagaacattttcccatttctgtgaattttaatatcttaatatttgggcattttttaaaagaaggtcttccttgttagattcattctgccaagcaagcctgcaagttttagacttttatatcactcaagttgcttatgtagtccttcaagaaaaattaaaccaagatctctaaagtgatttccatgcaaaattaatgcttccctttacctctgccaaactctgtgatgcatttatgcggcagatgccagaaagttcagaacttgtaactggaaagaattcaaaattttaagacagaaagcatttgcgcctggggcaatgtaatgatcccacctgtgtcgttttcttgtcttctggatgttttcattgtgtgtccagaaaggcccaggcagatccttattctatttttaaatcttttttatgaaacacagttttaattttacaagaccagatctcactccaagtttcaaaatatgtgttcttcagcataaaatgttttgacagatatctaatggcctagcactttagcatccattttttaggcatagactcagagaactggagccataaaatcatagtgtaattggtcactatcagatgctggataaatttgtacttctaggtgaactgctttctttccctttcccttattgtgaaa

SEQ ID NO: 114906 - DNA, 1050 bp, Homo sapiens
ggaatgatagaatccatataaataatgaatacaaaagcccttggctagttctgtcaattaccaataagctgtaaaaagcttcttgttttatgtatagatggtaaaacaaagatgtttgttaaatggaatgagtctagacaccagtgttaaaataaaattctacacaaacacattttggatatccttattttataaaagtttctggccacattattaattcagtaaatgtttactacatactataaactaggcactgttctaggcactgataatacttatcaaaaattcctgtcctcatggagttttcattctagttaaatatatatgcatatattccacctttgtctatcaaatatttacattttgaaggggatcccaggaaacacaattgttttttcaggcagatgtgttggaagaaggttaaaaagtgttgatagacgggaaaagaatctatactgataatgctgaaaatatctttggcattttctgtttgtcagatctttttatttctgttttcatctctactgtaaacctcataaagcttcataacagcatagagatcttaaaaacttctttgaattgtaaactgagttttaaccaagcagtaaattttttagtaactggttttcatcatctctgggtgctgttaacttaaacacagaaattataaaacatgcagttttcttgtgtagctttaatagtagtgttttttgtatagtgtatatgtatgtgactttctcttaaaacccatactttttataaagttgaatatagtttttaaagatttgtcttgtgtatcttgaaataaggagtatctcctattttcagttttgtagaaagaaagccattggaatgccactttctaacaagtatctcttaaagccattcagctaattacagtctttgattgttttgttagaatgtatttaataaatgaatgtaagtttattataccatatctcatttgttatattttattcatatttttacatttggatacaaatgtgtgtcaactggaaacaaatcaagttgaaaagaaaaacttgccag

SEQ ID NO: 114907 - DNA, 1049 bp, Homo sapiens
tgcccaggctggagtgcagtggctcagtttcggttcactgcaacctccgcctctggggttcaagtgattctcctgcctcagcctcccaaggagctgggattaccaggtgcccatcaccacgcctggctaattttcatatttttagtagagatggggtttcatcatgttggccaggctggtctcaaactcctgacctcaagtgatccaccagctttagccttgacatagggaaaagtgaaggaggaagtgggaaaaggttgaggtgggtggatatatcagatcaaatagggctgttttggctatgtagagtttggatactcttctgaggttaatgagaaaccattacatggattttaggagaggagaggattggcattattcaagttacatttttaaaagaatcattctggctgttctgcatggagaataactacaagaagagaaaggtggaagcagggtgactggttaggggctattttagacataaaggtaaattcctggacaagggttttagtggtgaaggtaatgtttggattctgaagattttttgaagccagagctaacaaatggataatgtaaggcttattttttacagaattttaaattatgcctttttaaaaaagagtcaggcaatgatataaaatagataatttaatttggaaaatgattttataaaacgtatttgctcattccgtgtcatggtgccttattttttaatggttaatgggctctttgaaagtgaagaatttgggttgcatgaaataggggaagcatgttttgaatttgtgttattctagccaattttgatcagttaattttattattatctggtatcaattggcaatatggagtaaatgctccctaattcttaaaaaaaaaaaaaaacttttgacatattacaaagcacaattagtcctctgtggttatctagatagggctatgtcatctaaaatgttcagactctctgcaggatgactatagtctctaaaaagcctatataagggatgcctctctctagtagagatatttcctgagccatgtttctcagc

SEQ ID NO: 114908 - DNA, 1019 bp, Homo sapiens
ttaataaataggctatattgtgtgtggtttttttcattgagagaatgatggagttaaaaataatcacaataataattttaaaagaacatgctgacatttagatctacagactttctcctctaggctataaagtcttaaaagtaggtcatactttgggtttaaactctgaacagatacttgctctctatgttagcttaccttttgatcttaaagcagcatttattcttaacttcagtaaattttaaattgtccttccaaatttggaaattctgtatgaaatgaaaaatcaccagtcatttaaaggagaaaattaaagaaacaagtttggcacttttctgttctgtctccttgaagaattggaacttttctttctatcagtgatctaagctagaaatatgagacagttaaaaaaatacggaagttcatcttcacttgaataaaattgaggtttgggtagcgtccttaaattctctataggttaaccagatgatggtggaaaaagagaatgtctgtaggttacatcctgcctcactgagttagcataatcgtcaattcacttgcttcccagtactctattcattacaagaaaactgctgtgggtctttggaactatttttcctcagctctatgatcactacaaaccaatgacctttagccttttctcttttatttcccttattcacagcatgcttttttccccctgacacaatttcactctgtcacccaggctggagtgcagtggcacgatcttggctcactgcaactgcaacccaccccttctgggttcaaacgattctcatgcctcagcctcctgagtagctgggattataggcctatgccaccatgcccagctaatttttagtagacagggttctgccatgttggcgaggctggtcttgaactcctgacctcaggtgatctgcccacctcaacctccccaagtgctgggattacaggcatgggccaccacacctgtccacatcctttttttttttttttttttttttaagacagactct

SEQ ID NO: 114909 - DNA, 1009 bp, Homo sapiens
ggcagagcttgcagttagccgagatcacgctactgcactccagcctgggcgacagagtgagagtccgtcaaaaaaaagaaagagaaagaaaaagaaagtattggatgtaagagacagatgatatcaaggactacttggtaaagagtcagagatgatgcttagtgactgagaagagtattgtacattaatgaaaaaataggaagtcaagactgggagatgctttggaagtaaaaatgtatgcgtttagctctaggaatattggttggaggagatatagtacatgtaagtggagatattcagtatcattaacataaaaggctttgagagcaaggtatggaatagaatgagattttaatttagggattatttgcatggtaggtaattgaagccctttgcattcttgagctcttggggcaatgggtatggaggggagagcagatgggaaaaccatgcatatatttgctcctttacatactctccgtcctgtgctctggtccctgttttgaggaggaaaagaaactgttctttataactactacccatccacccacttgtttttaaaattctgccttgaaatgcaacatttccttcaacaaaacttcctttcagaacttcaatctacagaatgggcttcattttttttttttttatactttaagttctgggatacatgtgcagaatgtgcaggtttgttacataagtgtacacatgccatgatggtttgctgcactcatcaacccgtcgtctacattaggtatttctcctaatgctatccctcccctagccctccatcccccaacaagccccagtgtatgatgttcccctccctctgtccatgtgttctcattgttcagctcccacttatcagtgagaacatgcggtgtttggttttctgttcctgtgttactttgctgagaatgatggtttccagcttcatccatgtccccgcaaaggacatgaactcatccttttttatggctgcatagtattctgtgatatatatatgtgc

SEQ ID NO: 114910 - DNA, 1011 bp, Homo sapiens
aaataaagttttgctggattgcatagccttatccatttgtttatgtattagctatggctgctttcatgctacaacaggagaagtgaacagttgcaacagagtctgtatggtcctcaaagcctaaaatatgtattataagcccctttctagaaaaagtttgctagaccttgctctaggtatatgtttctccagtgaggtccagagaatgttagttcaatccatgctagtctgtacgatctgaaaaaaaaaaaaaaaaaaaaaaaaaaaggttctatagtcaaataagctttagaaatgttaaggaggttgatttattctaggactactacttaaaagactttggcttttaatatactcatgtttattgtgaatcttcaagacaaggccatggtgtgcaaataaactctagtttcgcaggcttacttggctgtagtcccctaatatgatgatgttacaaaaacaaacaaagcaaaacaaaacaaaacaaaaaacaattctctaggaacccttgctcttgggctttctctctggaaggactttctttctaaatcattcctcttggtgatttaggtgatatcctcatttggagacctacagaatatcatatgaaattctgtgttagttgtatcatttttttcccagtaaaaattatattttgcttagcatcagaacagtaaaatataccagatatttaagtcatctaatcagataatatctgcctttttgaatgattctgtatgatgtctgaagattataaattagagtctcaaagtccaagaaagacaggatgtttcatttcatgccttcttgaaattctaaaagcatgggtcttctgtaggacttaaaatgtttttttgcattcagatttctgaagcataaatttagagtgcctaagtgatataccaactggtctcaactagggtttataagaagagagattaatgtgaaggtaacttgtgcattagccataaggggtttgttttatagactaaagtaaacaccttcaatttc

SEQ ID NO: 114911 - DNA, 1007 bp, Homo sapiens
gtgaaattagtactttgcttataggtgtgtattattttcatcgtaataaagtgaaatgttcttgccacaaaactgttctcttctgaattgaggtgagatattaacactttgtttgtctttgtgaataggttcatcctaagttccactataaacaggctcatgactcgggcacagacacttcttgcgtgactttttcctatgatggtaatgtccttgcctctcgtggaggtaggttaaaagctttctttttgatgtatttctctatataaaataatcatctttaacaaatatgacaataatatcctagtgcttagtaaagcttgctttgatttttgttaatgcacctttgccagtctgatttcttcattaaaatacatttctaactttgcaacattgtttgtattaaaaattaccaagtaaaatgtttaaatatttacttttttttggcctaagtttttcatttagattcaaattccataagagtttgaagcctccacaaatgatccttgcttctgccttgggaagtttatagatgatcacctatattctttctataccattttataattctgtgtctggtacttcaaagtcttctatttgttgcttgaccattgcttttttttctctgccagttcaaatactaacccaatttagtttttttaaaaaagtctatatctagatgagatttttaaaaacagttctatatgatcatattgtaagtttacttatccacatttgtatggttggatatagcttcctaatttttttgctaaatctttatcacatagataggttgtgtattggtagaaggagatggagaatagtgaaggcagcattatgggagagtatgggacatagctgaagattttcctacagacctatttgtggggagagaaaagaaatagcatggtaagtagtttggagccatgttacagagggtcttaaatatcacataaggaaaagaaatactaatagcatggttaagtagatgggaactatgctacaga

SEQ ID NO: 114912 - DNA, 1002 bp, Homo sapiens
cagcactttgggaggccgaggcaggtggatcacttgaggccaggagtttgagaccagcctggaaaacatgatgaaaccctgtctctacgaaaaatacaaaaattagctggatgtagtggcgcatgtctgtagtcccagctactcgggaggctgaggcaggagaatcacttgaacctggaggctgaggttacagtgagctgagatcatgccactgcactccagcctgagtgacagagcaagactctgtctcaaaaaaaaacaaaaaacaaaaacaaaaacaaaaaaaaaaacagactaaaagcaataaagtaacattccaaaggtgagccttacaaagttctcccagtacaagcaggtcctgagtccagccaattgtggattagtgcacctgccaaaagttgggtttcagaggaagcttcgctgtaaaaatggggatttttactgaactctttactctcctcacttgcacctgattctcattccttattggacccaaggggttgaggcaggtctcagctgtgggcactggggagaaagaacagcgaaaacattatgtatataagtttggcttttctgttcaggaattcgtcctatagaaatattaaaaagggatttttaaaaatttatttttaagatacatatggaatacttcacaaatttgcatgtcatgcttgtgcaggggctatgctaatcttctctgtatcgttccagtcttagcatatgtgctgccaaagcgaacacaaaaagtgattccttaaaaatactcattattctttaaatagcttggcaaagctgtactccccagcaaagtgaagaatgatagctgtaggtagaattacactggagagaagggaatcacatggctcacccttattaatgttaatggatagctttacccatacaccagtgggaaaaggaatctgttgtggattgaactgttttcagtcctgatagttgttaaattaaactcttctcaagaagtaacgtatgctcaaatacacc

SEQ ID NO: 114913 - DNA, 1050 bp, Homo sapiens
tgtcttttttttttttttaaagcagaggaagacacattcagatctaagttttgaaatggttaattcttgttgaaatacaaggtttagttatataagatttggtgagtctgtgtagatgaagccagaaatttataatttgggagactgggtgaatgttcattgacgtaaaaatacatagagataaaataaagcagattttggaagaaagacagtgaattctgttcttgatatgttgagcttgaaatacctataggacttctgtgtagagatactcagtatgcagatggtttaataagtttggtgcataagagaaagaagagacagttttggtaaaaacatttatagtgcatagttgaaatgttgattgctgatgagtttgattaaggtaagggaataaaggatagaaaaatgagccctaagaaatgtcatcatttaagagacgagcaaatgaaactaagaaaggagaaatttcattaaataaatagaacatacaatattgaatcatctgagaaaagctggaagacaaattatgagatccattgtaatagatggatgaagagagaacttcaaataggaacaaaaccacacaccccaaagagtcctattaaattgttgatttagtgagggtgaaggcttgttgttattgttaacatcaaacagcatcatttttctgtttatatattagaatgctatgttaaataaatggggcttttaacagtccgtttgacctattgtcccaagttttacgtcttcttggaatgtaaaaaaaaaaaaatacatttcttggaatgaataaaaggtggacactttgctagaagagccaaaagacacctcttttataattttgtgttggaaataccacactccaaggtagtaaggaacttaactgtgttgagttttaatttgcataaaaggcagcatctcagattcttaatatcagcagttagtagtgtacttgtttgactaaggcacagacagtgatggcattatgtctatcctagatgtgttcatttactggacacatataattggttacgctcttcccacgcc

SEQ ID NO: 114914 - DNA, 2081 bp, Homo sapiens
ataggacagtatacctaacataggtgtgtggagcacttgctcactgagaacagaaaggtggagtttcagagcactggttgtttcttggtcttccaagatgtatgaatatttgataggaaaactgggagcaagtagaaaatgatggagttttagtgtaaatttgccagtacatgtttctttctctgcccctatcttttttccagggtcaagagccaacttctagcatggcttattaggacaatgttttactgtcaagaagtgcagtggtcactcagtactgctatctctaggagtattttctttaatcactgaagaaaagagatgccagtggaatatggtgaaaaacaatgttgcatttttgctgccttcataatttggactacaagaccaccttgaaaaacttaaatctttttggggaatttcctaaagcaagcagcatacacatataatttaaatgggaatttgaattcagctgggctcacctactaagccagcatcaataagacttgattaaattacttcttggttctcattcacctagaggtatcatattatgaaggttccagagcagttgttcttcagatttgaagaatacagttgaatgtttatttgtaggcacatgagagtaaagaggaaagatacctcagatttcttggtggtttaactgttaatatctacgatatcaaatcttaacatgtttttagttagggaagatgacaggaactagtttagtgctgattcctttttattattttaaaaaattatgatactgtaaaattgatctttttaagaaagcatacggttctgtggtttttaacacatgtatggattcatgtaatcactatcaacacaatcagtatacagaagagtaccccctaaaaactcctttttgctatccctctatagtcacacacacaccccctcttccacccccaactcctaagccctggcattcactgatgtgttctccataattattgtgttgtggtttcaagaatgtcatataaatcagcggtccccaacttttttggcaccagggactggtttcgtggaagacaatatttccacagacagggccaggattagggtgaggcaagtgagatgctttcctcaatcacaaagtttacagggacactaagacacttagtaatcaagataagtaacattttaatgcaacaatataaaaaatgcaaaaaatctatggtgaataaaataccaaattttaaaataaaaatgggatcagtaacagtgctgtgccaagctgtattacagcctaaggcaaaaggaaaactcagttggactgatcccgtctttatttaaaatgttgatgttttgtttgccatagattttttgtttttatttatttattattattattattggtggaggctagagttggggaaatggtaactcacttctgcttgactgatactttgaattatggacttcttcccaaatccacctactactgtttacttttcagagtcctcagataggtctctgaaaagtatgtaggtctctgaaaaaccctatgccttctgtcctggtttttaaacaacattcagagggagagactgaatggagtatgtttctactgtctacaatggtgatggaaaaaacaaaatgaaacagtacagattatagcaaatgtgcttaggaggaagcttctaagttagctgcacatttggagggacattcatatggtaggaaataaaataatgtcattgctcctagaatgagtcacccctcttacttgggcagtatgttcccttgacataactgtgccacaaggcagagctactggcttttgcttaattagctgccattggtattaagcatacttggcccagtttctcaatattattttccagagctcattcctcttgcctacctgcacactacgacgtaactctcctgtataaaaattagacttaacagattttacaacttccctaaagagttcatttctgtgtatgaaatcccttaccgtcagatcatttttttctttatttttagcctcacattctcatgtttagagcctacatcctttgctctggtcctcatggagttggagaacagct

SEQ ID NO: 114915 - DNA, 1051 bp, Homo sapiens
gtttttaaaaatcaatttggaatttcagtgcatatattttttcttttttttttttttttttttcttgagacggagtctcactcggtcacacaggctggagtgcagtggcacgatctcggcttactgcaacctctgccacctggattcaagcaattctcctgcctcagccttctgagtagctgggattacaggcacctgccaccgcacctggctaatttttgtagttttagtagagacggagtttcaccatgttggccaggctggtcttgaactcctgaccttgtgatccacccgcctcggcctcccaaagtgttgggattacaggcgagagccaccgcacccggccacattttcttttaggattgataaaagaagtatacatttattttaattgtctactactttaaaactttagatgatccttttttcagattcattgcaaatagccaggttttgggttcattagaggaaacacagatttactgcagatgcttaaaatactggtaatttaaactctagtgaatataatttgttttggttgttacactgttaatgaatatgatatgtttcctggatctattttgtaaaatatactctgtgctttgaagcaaaagttatttgtttgaatttgacactttattttatcagaagtctaatcattactcttcattagaataggggacaaatactgatgtgatatagtacttatcactttgtttttctcatctttattatctctttaaaaaaaaactttttaattttatttttattttttgaaacatagtctttctctgttgcctaggctggagtgcagtggtgtgatctcagctcactgcaacctccacctcctgggttcgagtgattcttgtgcctcagcctctctaatagctgggattacaagcgtgcactaccatgcccagctaattttttttttcttagtagaaacagggtttcaccacgttggccaggctggtctccaacccccaatctcaggtgatctacccagctcagtctcccaaggcgatgagtgagccatcgcgcctggcctcat

SEQ ID NO: 114916 - DNA, 1018 bp, Homo sapiens
gaagaacaagttctataattaaaatgcatcccgggatagtatttttcctttttggaaatgatagatagtggtcttgtaggaggatgggttgtgagacccccaaaggactgaataaaagagtatgatatttaaaacatctttacctgtactatagtaagataaataatattttacatatcctgcgtagttcgtctatacaggaagattcagcttttcctgtgttttcttggttttacatacttaatgatttccaagatctgattacatatatttcttatctagcagttagagatttaaaaagtttcatgcattactgttttatttatataaacataggattgatggtcattatctttatgcctatctctgttgataaatgaagaaatgtaaaggagcccaggtctgtgtagaccaaacatagaaaaaccaggtggagttgggtttacactgtgggtcttaaatgaagagaaatagccatatagtgcttcccatgccttctcacaacctggtctccataataaatgataatatgtcatataaacagataaggctcctcttctctagaaatgactagccccagtgccccaggctcctcttaggcatgaggggctccatatcttgatacacctaccatatcttggtatcccattctgtgcccaccagtgggaagctctgctgcatctaagtggatcccatgaggtgggacctctggggtcatttgccttgcaggacgaccacccacctgggtcactcaccctgtggactcctgttcccagtctcctgtttgtttcctactcacagactatcattaataagaataattaccagactttcttcagtctttacttatgccttctttgccttcacaaattcttctcaagtaacagggttggagcaaacttttactgttttgaattagatgaacaaaattgtatttaattttacttcccaagagaccttccattttctctgagaactttttctcatgatgaaattctttaagcaggtttattatcag

SEQ ID NO: 114917 - DNA, 1478 bp, Homo sapiens
ggcattttttcttttcaccattgcactcctatctggcctattagagaatttttcaggatagggaagggagaagattgagaagatttctggcaaaaaaaaaaaaaaaaaaaagacagttgccacaagtctggcccatggtagaatttccttggaactggaggaatgtggaggaggggaaaaggagaggcatatgctcacttagcaagatgtgtagagaaaatgtctgcctttaaacttttccattgaggggatatctgtagagatcaggaggtggtgatgagtcttagttattggagactggggcttactcaccatgtttgcttcctgaacttcagagggatgaagccaagtcttgtggcccatgcatgtggcaaggccatcccaagtttgagaaaagcaaggctttgggagagagtggagggaacaaagacaggacaaatagcctggaaaagttgaaacaattcccattttactctcatacttccctggcccaatattttaatatagaaaacagtttttctttctctgtgaagaatatcttgggcttgtggaagtctgaagaaagttctttctccagtattttttttgtttttatctgttttctttttatttgttttgggttcacatcttgatcttctttcttagtgtctggaatctgcacacacaaacacacacacacgcacacacacacacccattcaaatgtgttggatagtcccaaggatgtctgtaactctaagactgcctctatacaagtctgcaaaattgtgtaacagactccttcacggacaggtgtcaggcttttcatttgaaaattgtgaaaaatgcttgttcagggaatcactgcattagcttatccattcttgtactatatgacaaaaaccaaacgtgaaaaaaccagatggagtttggtttacagtatgggtcagcagctgtggaggatccggaaatggagtttcaacataatcatgtttaaggtataaagttatgaaggctgttggctttcttttagcatgtagaataagggcgttgtttagatatgtgcattgcagatccctaagatgttacgcaggcattgatttcttttatagtaacatttgtgaactgggaactagtgggctttttaaaaaaatgattttagtaataactcctttttaatacaaacttgctaaggtttctactgggttaggtgggtttggatatgattaaatgtcagctaccttctttctgccccatctttccaaatagggctttgcatggttaagtagtaagggaatgaacagtggagttggagaaacctgcttattgacccagctcctctatgtgcgagttattatgtgaccttgggaaagttaccactctctacagcctcagtttcttcatctgtgagatgggatgagattattaattttgtagtatttgtgaggactcaattatattaaataatataaagttccagtacctaataattccctttct

SEQ ID NO: 114918 - DNA, 1013 bp, Homo sapiens
tatcaggcctacattgtggatcttttccaattctgcaccctgctcacttgaaaacatatttgagaactagtaatcttagactgctgagccagacctctagagaaccaagaaagagaaataactctaatactgtgcccttaatattgtcctgggccatttatgggtggctgagatttctgaaagcctttgacagccgctttcattattctgtgattcatgtacattctctctctctaggaccacattaggaggaatctaaccctgctacatttgtaggatacctgagtataataatgatatgaggaaatcaaattatttctcatggagtaatgattttaatttgaaaattgtctccagctctacctagcaaagcaatccatttaggcatgggtgaactgtagcttttaattcattcctttggtgaacattttttgagcaccagacactaatctaggcacttgggatatgttgccaaacaaaactgactgagatctttgcccatgaaatatgtgttctagtggggaaggcagacaatcagcatcattaataaataagttatatattatattaaaagatgatacatgctataaaaaaagaaaagcagactaaggggagttctggggcacagttttaaattgggtggtttagatagcaatgacatttaagcaaagactaaaagagatgagtcttggctcagatggatttcttctacatagggtttcataaacatgacttcatgaagttatgtttgtgactctccttatgtttccatatacctggctgtggccatctgggaatttccagtggtctatctcaaattagtctcagtggtggagcacctagaagctgcactttgtagaccatgagctattgatatacttaattacatcttcccaaccaggagcaattttattaggagaaaatgtgacttttatatgtatgcattataaactaggttttacaagcataggtacaaagcaacaacaaccccccccccaaaaaatacccaaact

SEQ ID NO: 114919 - DNA, 1050 bp, Homo sapiens
gactcttttcagctttctccttagttcctctggaatctcaggtaagggtttgcagccatttacctatttttttttggcctatttttttgccattcacatgggagtcagaatttttatttctttgtttttttctttctttctttctttcttttttttttttttaagagacagagtctcactctgtcacccaggctggaatgcagtggcacaatcatagctcactgaagcctcaaactcctaggctcaagcaatcttcctgcctcagcctcctgagtagctcggactacaggcgcgtgccaccatgcccagctgggaatcaatgttctatcaaaaaggatctgagagatttcaagatattctgtcttaacaaaagagtggaatgagtagagacaaggaaccaaagaaattcagcccaaagtagatttaggagacgtagtcatgattttcattttaccactagaactataaaatgctaatatctaatcatacccttttcccctttagtccctatatatagtttgacaagtgatagattattaataaacattgaattaatgcttccactcatatcttgttctatcagagtgagttctatagaacctagtacatggggtttctgtttactaacattagcttcatcttttttccctttaattctgtccacgctatccctcccacctctgccctcttaccacagacaaaaattaaaaacaggttatagttctcactgagaacttgtggttcttttcagccccagagcaccacttattttccttaccagtaatgaattcataggatcataacttccagtgaaccttctcttaaacagcttttcatttaggttaatgtcaagtctttgtattctgtatctctgttttacttctgctgttgtcctgctgttttatctcatagatagggagacattattaaatgcctacaaatgtgcattgtttctgaaaaagctttatgagatttggatctttgtgaactaaaaacaataaccacctggtctcaatctgctgtccagagggacatattgtatgtgtgtaa

SEQ ID NO: 114920 - DNA, 1065 bp, Homo sapiens
aatccaattctttatttattcatgcaaaagagatttactgaacaccaactatgtgttagatactgttctaagttgtaggggtacagccattttatggagcttatatgctagtagagacagacactaaataaatatataaatattaaatggtaataatgctaagaagaaaactaaaagagggatatatcccttttataaaaagataaaagggggacatagataaaagagggataaaagggggacatagagtaatcaggcggagaaaaggcgctattttagatacagtggtcagggaagaacgtctacaaaagttacctttgacctgagtgaaatgagggagtgagccatgcaaatacctaggggaagagcatcccatgcagcgaacacaagaggcctttactgaattccttcatctctatgaaagtgatcatggaatttttctacttcgatctatgaatgggatgaattatattactagatttcctaacaccgagccatcctggcatctttgatacgaccgttatatgattgtagtttattctttctaaggtgttagactggcttcctaaaaattttgtgtatttttcttttctatatgtaccctcaaactgttttgaatacatttgaacttatccattttataaagatttgatagaattcacctgtaaaatgtgaaagcttttgtggagtggagggtgagtagtaattccttaatttttctctcttttccatcccctcctggcaaatagtctattctgagttttctgactcttctgaggctgcttggtaattaatattttcttggacagtcattcattcagattttcaactttctttaaataagaattaattgcagctgaaagtgtttttgttcactttcaaaatatctaaagatatttttctgcattagagatgattcagttatgtttacaaatgaattcgtgctagcataatagcagctcttgcaaggtaggtagatcaggcattgtcatatcctcactttacatgtgaggaggctgtagcttagagatctgcaattaacaatgactgaaactagaactagac

SEQ ID NO: 114921 - DNA, 1047 bp, Homo sapiens
catgtcaaatcatatgtctgaggtcacagccagagagggctgcatgacagcacccaagatctctaaacatcagtaattaacaaatagccccaagttttctgttccttttgaaaaacacttcattcagaatcaattacagaccaatattttgttccagctgcttagaatgtataaatttattacttcttgaataaaatttactgaaagcatctcacattttcccccatcttaacataaacattgcaccatatggaagtattcgtcttgtacagccaaaagttgcagtggagggttggaggaggaataaaaacttgatcatagtggtcttggcggagtcagctatgatgtaagggaagagaaaggcaaatttcgcacgaagatgattttctcatcgttacccacaacacaagtgggccttttcatatttaagaggatctgtctcactgtagagagttttataaagaattattttttccacagaagattggcaacatgcacatacggatttcaatttcaaatttggtaagggaggagtttagaaccaggaatggacaaatagtgtgtgttcatttgacctgcagtcctgtcaccagagtgggcatcaacagttatttatcttacagtccctcacactccccatgtccctcaggcctcgttatcttcccccatgcaaccttgtatttggtcgccttcatttctagttgctcgaaggaactggcagtcatcctaatgactcctccctcaccccccactcccacccatttaattatttgccagtttcttcccatgctgtcttctgaatctctcatatttgcccttcctctctttccctaccacccctctagaatttagaccctcttttagccttcaccagcaccactcaggagcctcctgcccaaatgatcttcctgtttttcattaggtcctcatctaacccatctttcattctgtcatcagagttggccttctaaagtcaaaatctgtcatttcattcttttgcctagagccttccagaagctctatgtcagtactcatgcgtttatgtgg

SEQ ID NO: 114922 - DNA, 2379 bp, Homo sapiens
gtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattact

SEQ ID NO: 114923 - DNA, 1500 bp, Homo sapiens
caattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagactt

SEQ ID NO: 114924 - DNA, 2386 bp, Homo sapiens
aataatcttaaaactattaaatttactgtaataattttttatttaaaggattaaagaaaccttctaccctgatattccaaatccagaaaactgtaaagcattacagtttcaaaagagtgtctgtgaggtaatcttttattttcttatatttatctttgatgtgctggcttctttttttaatcttttgtgaaaagtttttaacatgcaaatgtcattttaattaaaaagtattgggaaaattatatactttaaaacatctcagtttctaaaattattaattttaaattatacagtgctcttttttctcccacaagtattaataacaaggaaaatactgatacggaagaaaaaagtggctgtgctgttgtgtgaaatacagagtagtagagacacctgtttacaagcagattggggaaaaatgtgtccctttttataggaggagcattgcaatggcatttagtgctatttttaatcactgtgtttaaatttatttctagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcct

SEQ ID NO: 114925 - DNA, 2589 bp, Homo sapiens
tttggttgtggtggttttcatgcttttagtagcagaaatgggactattattgattgcctgctgtgtgccaggcattatgctacagaatgtgtgtgaaaacttcaaacagcttaagtcatgatattctatttcatcagtagaaaaactccacttgagagtggtttaaataaggggcccatacgacacagctaatgactggcgtgggggtagagcttgaacaaggtagtggcagctccagagtccttggctgggatggcctcagctagacccacttagaagggcagttggtgagacaggtgtgggtaaccatgcatttgaaacgggttagagattagtgctaacatacttcattttaaaaataggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattgtaagtttcaggttgctgttgaggtgctttccatcctgcatgcgtagtgttctagtgattcttggtttatgtaggaacccctccccgccctttctaaaaaacattcacattttgttgcagtttttggctggtagagggaagggttaaaaagctgtaagattacttcatgtttattcttgtcagttatttgaagttatttccaaatgagtacctaagaaattaatgaatttgggatacatctgaagtctagaggtctaaagtcatattgaatttatctaacggtcaacatttaaaaatattttgctccagctgttatgtgatttctaacatatctagggaaaagtgaaggagatattcttaaaaaaattttttgtaaagcacaacactcaaatttgagagaagagtgatggccttgactatctttctgcggtaaagaacttcacttcgatcataggcttatcctctacccctgagttggagttcacacacagctcttatataaagagccatgaggatatggttctataaagcagtgattctcaacggagagtgattttgtcacctaagagatacttggcactgtctcgtgtcatttttggttgtcataactgggggatactgctggtatctagcggtgagaggccatggatgctgttaaacttccagtagtgcaaggactgtctcccctgatcctctagtgaagatctgtctggcctaaaatgtcacaagtatcaagattgagaaaccctacttggaagagtttaagtatttgtataaaaattatcacaatacctgaaagtttgattttaatagtttttcagtgtccctgcagcagttaattttgtttttttcctaaataatttaccaacctaaataccttctaacatacatctattctgtacttcacactaaaaatggcgattttaatatttgcaatactctcgtttcagctgtgggattaattattgccattctcatcccagtggcagtggctgtcattgttggagtggtgacaagtatcctttgctatcggaaacgagaatggtaatagttctgcatttactcttgctgttttcttcttaaaggcatgattataagatttgtaagattagtttatgtattaaataagtgtatcttttttgttgtaataagttagttaaaaaatgttttaattagaattaatgttggatttaatattaagaacatgacatattatttaaaggtcttaatagagtcaatgtgtaaattttttctactatttttcctaataatttaaagtcatagcagttactattataaaaaatatttataggctgaaatatggcaatagctatctacaagattaagcataatttaatgattaagatctcacttgccctggtgacctatttagaaaatctggtcattttaatcatttgctcatttattcaacaaatatgaatgacctcttccatgtgaagggggatatcatatcgtggtgcacaaaacaagccatggctcttatagacttggagcacagtgtgggaagagggacagtaaaccataggcatccagcaagtgtgtgcttgcagagtgtgagtgggtgctaggaagactgaaccaggtaccctgaggagaccagcagggggctacgtcctgcgagctggtcggccatggcccgtcacggctggtctgcggtacagttccaaagggtaaggagagggaaaagaatgttacagacagataattatttctttgagggccctgaaattggaaagagtcaaaccttcagagaaagtgggaggagctgtgtgcctggtgaaacaggaatgagtgacatgaggtgaggtcagcgggagctccgtgggagagagggccatgtgcatggtcacctggcaagagctgtcctggctgggtatggagccagtggctgcattcatgcttagaccagtcctcaccgaccttaaaaatgccatcatttatgacaagagaacatattttagcaatcctggcttataaatcaaaatagtaatagttgtagaactatagaatagtctattttggtaaccatattctcattaccaaa

SEQ ID NO: 114926 - DNA, 1039 bp, Homo sapiens
ataacactaggtaaggaagggatttatagaggcatgatgtggacctcgaatgaatggcttagtgaactgacccaggaagttgatgtagacttacattttgttcattaaaatcaagcagttgccagcactttgggaggccaaggtgggtgggtcacgaggtcaggagtttgagaccaacctggccaagatggtgaaaccctttctctactaaaaatacaaaaattagccaggtgcggtggcgggcacctgtaatcccagctacttgggaggctgaggcaggagaatcacttgaacccgggaggcggaagttgcagtgagctaagatcatgaccctgcactccagcctgggcgacaaagcaagactccgtcaaagaaaaaaaaaaaaaaatcaagcaatgatgatttcttcctggaaaaaggaacaaaatgtaagccttaaatcatcgttgttctcttcaatgcaatcccatcttatattactaaactttttgttaaaatagaagtaaatttaatttttgtttagtcaattttcttttgaatatttactagtctttaaaatatatatgtattttttaataagaaaacatctttaaaattagctttggaaattttagagtatgttatgaacttgatgtttctaaaatagatattcatagtaatatatttatgaaagtttgctgatatgttcatcctatagatgagtttcgaccaggtataagatataattttttcctgtatggatgcagaaatcaaggatatcaattattacgctccatgattggatatatagaagaattgggtaagttaaatgggtacttatttataagagctcaaggcaacatgagaaattataaattggcaacaatggtatgattgaattctaaaaataagatgtataattgaaggaaggtaaaataatttgataaattaaaaagtatttgattactacttttttctcctcctcctctttttttttttttttttttttttttttgagagagggtcttactctgtcacccaggctggagtgcagtggtga

SEQ ID NO: 114927 - DNA, 1013 bp, Homo sapiens
gcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatggtgagtgcttgagatgatttagtatataagaacgggaaactaaagtgagaaatgtctgatgttacttgctcttttgtcatgtcagccttcttctcgtataccttgttgctgctgacctagaaggcagaatgagcagattgatgtctacagttcattgagaaagaagtcattagtattgacttgaagcatgtgcactgatggatacaatcattactgtactcagtaactatagtggataatattggagagttacagtggtggatagtacttttaggaagaaatattttaagagtttattcaaatgatattcagacgcttctccaagacacttccccaagactaggaaagtttattttaggtcagctaggctgttttgcaaattgttgggcaggaaaaaaaaaaaacgcttattttaattagcaccttttttgataagaaattccttattaatagaaattctttattgattaaaaaaagtcttcttaaggtataaattagatcttcaatataggccttagaaaaacaactgtggtgtagtttttaaaatttagtgcctttctttaaattttacagatgtccagtgattaatacattcttcccagcttctgccttgacaactttgagagttatgagctttaaacggccacttccacctcttcttccacagacctctgtgctccagtcattttctgcctacccacctttgctctcttgccccgatatgggagcacctttctgtaaccacagctcctagaggaagaaaaattggtccagttagggtcctctaagtagctttcc

SEQ ID NO: 114928 - DNA, 1049 bp, Homo sapiens
agaagttctaagtgtcatattaacaaagatgcacaaaaggtaatgcctgcctccaagaaacttccaaatatcatccaaataatacatttattcctcacagtcatctcaaattataaatcacattaaggtttattgcatcaccattagccctttgattatcaaaattatataatcctttagataatttaattgaccattattacttagagccagtatttggattaaaaagataacccaattttttattactattacagggcataatttcattggcttggcaggtatataagaattaaaatattacagtggataaactgctttgggtgttacatatacaaactcattgacattccgttggtttgtgttacaaatgtgaaggctttcttaccaaaaaaaagtgtatgtatgtgtatgtatatatatatgtattcatacacataatatatacatatatatatatttatttgttttccaatagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtaagttaactaagtgatgtatggctaataattactgtgtattctgaagttttacaacttctttaaaaagaagatgttggccgggtgcagtgggtcacacctgtaatcccagcactttgggaggccgaggtgggcagattacctgaggttgggagtttgagaccagcctgaccaatatggagaaaccccatctctactaaaaatacaaaattagctgggcatggtggtgcatgcctgtaaccccagctatttgggaggctgaggcaggagtgaatcgtttgaatctgggaggcggaggttgcagtgagccaagattgcgccattgcactccagcctgggcaacaagagtgaaactccgtctctaaataagaaaaaaaaaatgctattagagtccttaaaggtggggga

SEQ ID NO: 114929 - DNA, 1097 bp, Homo sapiens
taagttaatttctttgaaaagaaaattagtacatttcaaatactgtcctctcaaatttttccccttctgtctgtccttctatttatctcttatttgctcttgttatttagattttaatatttcaacttaatatctaccaaatcctaaaataaccagcattttaaatatattccatatttttggtatgtggttttaatagagtgactgaatatttggccttagatttaaaacaattttcagaataaatatgtcaatgtttgtttacttatctaattgttaaactctcatataaacactcattaatcctcttaatgttacctgaaatatcattgaaggatgttatccttatctctggggaaggtatgaaattttccaagttttggttgataaactaaggagtattttttttttaattcagatttgtgaaaaaaaaattttacagaatttttaaacaagtagtttttttaaaaaagaacttttacctaaagtgaaagatagtttggataaatatgagagaggaaataccagtttctatatgtgtatggttaaacatgattacagaaatatgaatttctacaataagcagtgtcagactgcagacttttaatttatcactttttttttttttttttttgagacggagtatcgctctgtcgcccagaccagattccagtggcacaatctgggttcagtgcagcctccacctcccaggttcaagcggttctcctgcctcagcctcccgaatagctgagacttcaggcaccctccaccacacccggctaatttttgtatttttagtggagacggggtttcaccatgttggccaggctggtctcaaactcctgacttcaggtgatttgcccaccttggcctcccagagtgctgggattacagatgtgagccactgcacctgggctcatttatcactttgaaggtctcgtcttaaaaaaaaaaaaaaaatttcttttaatttttctagtcctgccttaaagctggggagagcagttttgataaagagaaaaacaacaaaagagccgcagtcagtttgtatatactgagatgcagaattttaccaagagttttctaaacaacagtac

SEQ ID NO: 114930 - DNA, 2073 bp, Homo sapiens
gaatgtttcaatgaatagcaacatcttatataatacattagggcctaaagttgaagaagtaaacaaatgaatcatgattattgttactctgctattataccttacacaaaactgagttgtattaaaggacaaaacataaacttagctgatgattgtatggaatctattgtgtcttttaattctaaaggaaagcaaaacatattgctacttggaaatacagttttgtgtttgtgttcatttttaggtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttgtaagcttatatttaaagaatgtttgtttcagatgaattaaattagtctcacttaagagtaagatttagtttgagctttcacttctcataacctcattcagctgcatgaggattacctgggagcgtctaagcccaccatccctggagattttgatcaaaaagtctgagataggcttcaggaatctgtattttgaaagaactttctgagtggttggataaacatccaggtttgaaaatcactgtcataggaattgaagagcattaaaaattgtgtgtagatgatactgagatgaaatctatgtttaaaaaaaaaaaacaaaacagttcccaatttctggctcacagagcagacccctagaggctgcatagttattgccaggaacacggggatctgcaagcataccaaaaagcatccgtacattaagtaaaactcatatacagggagaatgttggcagtttcgaatagggggcctggaaaattgttgaccataaaatgaaatcctgaaaggctggtagtcattgtagagatagatcactctatggataaaaggattagaggaaggaaggggactagattaaagtaagttgttttttagggtgtggagtacttgggcatatatttaggctgatggaaagtaagacatatgccctaaatacattgaataaaaggaatggaattatttaattagtgatttttggggggtgtggattgttcacatgtatatataaacccactgaatttcaacccttagacttcttagacataaacctgtggcattaactttagacactgacctgtaatctgcttctgcttcctcaccattatcccttcataagtaaataaaaccacatacacttttaaaaaatttatcgtatatatcttgctcctacaaaacctgtggaacacaccttatctttggaccattatcattacaaagcacctaacagtttgtagtgtatatactgggctattttaaaagtcatcttatgaaaagaaagtcttaaaatgcagaaaagtttatgtaaaatacttctatataaaatgtttataattcctctttttctttctagggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatgtaagtatatgattttaaagagagaattcctattaacctgttttggtcttccttgaaagccttaattcttctggagtgggggggtgggaggagtgattctgtttctttctcatttctttgttctttaatataaaggctatacaaaggcactagaatatttgcttgttttaaaatgaattgcaagcttgttttccacataacctgtatctgtgtaatttgttggttttgtaatcagatttgaaacatctagcttctaatgtttagtttaaattcttagttaacagctttgttaaggataggatataatatttcttaaccctgcattgtt

SEQ ID NO: 114931 - DNA, 1101 bp, Homo sapiens
gagcctgacatgtttacacatttggtggaacttaagcacggggccactgtgaggaggtgcacagagatggcactggggacttaggctggcatgaaaaagctagagcctcatgccctgttcaacttgggacctttccctgtaggccagggagagccatggaggattctaggcatacaaaactgaatttgtgctatgggaggatcagaagtcctgagaccggttagaagcattgcctttgtgcaggctgagggaaagaggccccaactaggcccgactctggaggtttgtccttatttacctggtaaagttgagggagtggcacaagtggtagtcataactagaggcatcatgctgcctctaccgtcttctatcatgtcctttttataaagcttctgattaaacttacataataaaaaaggatttgttatttaaagctctcaaacacagatttattgatgccttaccctcaagttgctaaacgttcaagtgtccccacatgtgggtacttcttctatgaaataggtagtagctggcacttatggtgagatgggatttactagagtaagatttacattgagcaagaatttatgatgacttgggcagtaataaaaccaacaatcataatttatgtttcatgttaatactttgatattagattatctacttatttttcaaactaaaatgaatcctccaattttaataccactggaggacacgattttagacattatgtgtctgataaagtgagaagacaaaaaagtagtccttcttaatatttttatggccatcttacaatattggcccagcttattaacctttttttgtggttttcccgtgtgttgctgctaaatcatatctcctcccatctgtatttgttcattttctgtgtgttattgttatcaacattatcatttcattttggaccctgacatccatgctgaatttattttattggatttatttattagaatcctattattacaccctgtatatttgctattttgcccatttttttccatccacagataagttggatatgattcctatatcttcatgcaactcattaatgaagataccaagaaaaacagaagtttttgatat

SEQ ID NO: 114932 - DNA, 1070 bp, Homo sapiens
tggccatgatttaagttttttaacttatattaataatcttccatggtgcataactgcacactagattcagtttattcatccattattcagtttacttaacaaatatttactgcacactttttgtgtgccaggcagtttttctagctcttgggggctatagcgctgaagaggagtgctgaacaggagcctgctctctgtctcttcctccccacctatgctgaactctcaggtcatgctggatattcagtactggatactcatagagctcagcatctaggtggggagggagggacaataagtcaggaattatgtatgcatagatacctctaggtattgatgtgtacgctgaaggatataaaataggataccacaaggaagagtgagcagtgtgtggttgtggtgcgggatttgggggagggaggcaagcagggaattgtccccctttctaggtgatgagtagaggccttcctgaggaagtgagtgttaatttgaatgatgagaagagtcaggggaaggtgattccccatgataggaatgacaagtgccagggcccttggtggatcaagcttggtgcatgtgaggaatggaagaaggccctggaggagactggaagccggtgaccaaaggagagacgtgtatgtgaagagtgtggaaggggatgcaggacagagagtggggtgtgcttataaggagaatccactagacggttttaaactggggagtgacatgatctgatggctgtttttgaaaggttctgctttgtgcggagtggattggtggggagcaagactggaaacaagaggaccacttcagaggctcttatagcagttcaggcaaaagaggttggtgcgcttaatttgggggtggcaatgaggatgatgggtgttttttccttcggcatgcatttgaaggtgtagcagctggtagtacatggggagtgggtagaggccgatagggaaggaaaggaatgactcaagggtgactgctaggtttttttgcttgaataaattagctatattttgagagggtgtaggttaggggaagaacaaatttaggagggttatgaatca

SEQ ID NO: 114933 - DNA, 1051 bp, Homo sapiens
gagagcggcctcaccaccggaggctcggaggaagcaccaccctcggcgtccggggcccgtcgcgcggccgcgttcctccgactccttggagcacccgcgcgcgcgggcgcgcggccggggatcggcgggggcgcgcgggttggggcggggccggggccgggggcaggggcgggtcaggggcggggccgggcccgctgcgcccccagccgagcggcgtgcaggcgccgcccccgcgcgccgcagtcccggctggagcgactcggccgtggcggtggccgttaccgttgcctctgggaggctctggcggcggcggcggcccgcggggttcgcggagcgcagcgggccgcccttcgcccgtggccgcctcaagcagcctcgcgccgacacaggggaggcgagacggcggctgcggaggcggcggcgcattgtgcccggccccctccttggcggctcctgcccccgggcggctgtgggatctgggcagccccggggcggcggccgaggctacagagccggcggcaggggatggcaagatagcggcgcgggagcgtaccgtgagtcctgggggcgggtgggcgcggcgcggagcaggggagccgcggagccccgagcggggtccccaggggcggcccgggcggggtggggcagcgctcccagctctgcggagcgtcctaggggagtgaccccggagagcgccgctccgggtcccgccgctctccgcgcgcccttgggtcaccctcgtgtcctgggggacgcggactccagcgcccagaacttctgccccacgcagggcagtgagttctgaggccagaggttacctgggggatgggagggagcttgaaatgtttttccttcggagaggtgacctgccaggtgatttcgtgcccctctgcttcaactcccctttaaacctgttcctcgtcctttctgtatccgtagtgcatttgacttacctgtatttttatgtgctaacttccgaaggtggtgtactggttaaacccaaagttaaagtgttggaggtcaaagttaggctttgtgaaagatgccattt

SEQ ID NO: 114934 - DNA, 1063 bp, Homo sapiens
caatattgggctatgcaaagtgaaaaatatttttaatgttcctaagtctgcaatttatactaaagataattactgttatgcaaaaggatgtggaggtatttatgtcttttacacagaccctccttagaagacatttatcttcttccctacctgccatcctttcttcccacactcaattcaaatggaaggttgaccttttcaggaggcaagatcattattccaaaatcagtgaagtaatcatcattttcctggtgtgccttctctgccattcttagcttttgtgagcagagccctgaaaaccaggctttgctttgtcagtcacacagacagaaagtacatttagtcctttcatagacctatagcttattgcagacagcaggaacgaccccagatcttgttggaaacagcaacatagaaatagaaatctatgggatatggcttccctctgtagagttttaaaatgaagccaagaagaaacaaggttcatatttaaggagaatattacctcaaggaactcaaccccaccttaaaaaaatatctagtattcatttgacaagaaattagcagttacaaggaagatctagcaaatgatggtggcttttcattgtacattctttctttttcttttcttttcttttattttttattttattttttttttgaggtggagttttgctcttgttgcccaggctggagtccaatagcatgatcttggttcaccgcaacctccgcctcctgggttcaagcgattctcctgcctcagccccccaagtagctgggattacaggcatgcaccaccacgcccagctaattttgtatttttaggagagatggggtttccccacgttggtcaggctggtctcaaactcccaacctcaggtgatccgcccgccttggcctcccaaagtgctgggattacaggcatgagccaccacacccagcccttcattgtacattgttaatactatattcacagacctggtccagggagtctccccagcctgagtgagccagagccacaggcacttctgtgtttgcctggaaaacgcactgcttttttttt

SEQ ID NO: 114935 - DNA, 1360 bp, Homo sapiens
caattgtagcatgtatcagtattcagtttcttatggctgagtaacagtccttcgtgtgtgtataccacagtttgttcatctggtcatccactgatgaaagtttcagttgtttccacctcttggctattgtgaataacgctgctacaaatttgtgggcaattatttgtttcaattcctgctttcaattctttgggatatctacttacaaatggaattgctgggttatatggtgattctattttaacttttttgttttgaagacagggtctcactctgtcactcaggccggagttaactttttgaagaactgtcaaaacgttttcaacaaggtggagccattttacattcctaccggcagtgtacaggggctgtaatttctccacatcctcgccaacacttgttatttccattttaaaaattattatagccatcttcatgggtgtgaaatggtacctctttgtgattttgacttgaatttccttagtgactaatgatattgaacatcttttcatgtgcttgttagccatttatatatcttccttggagaaatgttcattcaagtcttttgacttattttattttattctattttattttattttattgtgacagggtctcactctgttgcccaggtggagtgcagtggtgtgatcacggttcactgcagcctctgtctcccgggctcaaaccatcctcctatgtcagcctcttgagtagctgagactacacgtgccatgacacccagctacttgttgtattttttttggtagagacagggtttttccatgttgccgactcttttgcccatttttaaattgagttctttgtctttttgttgctggtttgtaagagttctttatgtagtatggatactggaaccttatcagatatatgatttgcaaatattttctcacattctatatgttgtcttttcacttttttgtgattgttatttgatgcacaaacttgtttattttattgtctatttgttgttgttgttgttgttgctcatactctggattcagatctaaggacccactgccaaactcagggtcatggaattcacgctgagattatagttatcaccctagcccttcccagcatcacatttacaaaatatcacaaggtaactttcagggaaggtagccattgtggctccctttccttttatgggcattcttgttcatctcactttcatagaatgagttttctgaggtgttcctccaaattctgaggttatgcctcatttgaatctgaagctttctactatgtggaccaatcacaagaaaaacatcatgtttgtcttgtatccaccaggaatgctcctcagtttatctggctccatgcagagccccatcct

SEQ ID NO: 114936 - DNA, 1035 bp, Homo sapiens
aagactgctttcttgactgagatttgaccatcctaatccaaaccttgctaaagatgaatattttttaaaaacaaacaatctttttttttttttaaaggatgactgtgttaattctctacttttcaagaactttcttagcagattctctgggactggcacagtgagcaccttctgtctctgatctgttcccccaagacctgagtagcttctgttttctctcccgcttattccacatgagtccccgggaattggaagaccatagtgattggaagctgagttttcaaaaggcaggaggtcatagctggctcccatgcgaggcatcagaacatggggaattgactagcagaagtggaattcactggcacatatcgtggacctgcaatggggtcttaggtttgtgctttgggataagtcaagtcaagctattttataggacaagatggctatgtgtctccaattgttttctctttgcttttaggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtggtaagaagtgaggtggttacaagagtgaaaagggttaatatattttttaatgaggagcaatagtcaaatagtggaaatctcctttgaggaaccctgggtagacactgacattattttcctttggctcctatgggaactaaaaaacacaggtgtgaaacttggcactggaagatatagtctgaagtcttgctcctgaacttactcattgagatagttgtgcagattcaggcaattttgtatttgttttcaaaacatgtaaagtttgtgtattataaatgctaagtgaacaaagcaagacataaattgtacatatgtatttatttgagcaacacaaaatgtgtatgcgtctagagtagaggttgggaacatttttctgtgaaaggcc

SEQ ID NO: 114937 - DNA, 1011 bp, Homo sapiens
gatacaacccttgtcaaatggacatagcatcagccacttgcataacatggaccatccatgcccatgacatctcagaaaatcacaagggcaggaaggagaaggggccaagatgaggtgacccctgaaaagtgacttttggaggctgttgataggtagccttccacctcagtgaccccttccttgttcacagtaactctgtggcttcagactctaaacagagctttccatttggcttatcttccaataaaaagatttaactaggtctgttttcctttgtatggacagaagtacttgaggagcccaaggacttttcttgtgaaaccgaggacttcaagactttgcactgtacttgggatcctgggacggacactgccttggggtggtctaaacaaccttcccaaagctacactttatttgaatcgtaagttggctctggttacattattgacaacttcttccttgcttgaggtgcttgtgacaacatggcaaaaatctacacttagatgttgcaggaaatttgaacaaatatttcagaaccacctgccaaggtcaagaggaaacctttaagtggtgacaagtgtctaatactttctacctgaggtttttaaaaaaggaacatttagcatagcatggtaagaaagacagttaatgtataccttgacgtgaaaatagtcctgtctgataatctgggtttacccaatttctgactttttaggaatattccaagtaaattaagggatgttcttgccacccacggggagtcagtgattcatgttaagacatttcagcacgtatgtcaaatttgtagaaacaatattttcgttattggtatttgttggtgatggatggatcaatgccattatggggaacatagtttgacagtcactgagtatgccctgagggataagggatacatttgctttgacaaaagtaaaaacctcgtaatggttgtgttattttgttttgtttttaaagattttctggggaaaagaaactttgtacacacaaaaa

SEQ ID NO: 114938 - DNA, 1031 bp, Homo sapiens
ctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaac

SEQ ID NO: 114939 - DNA, 1678 bp, Homo sapiens
ctaggcagcaaagacaggagtatcttctgtacactgttccgcagttactggtacatgaacagttggaactgctgactttcctaaccaaaacaacttccttctctcctttgttgagccttttgaggggttcatgattcattaccacagttttaagagtttcagttaccattgtatgcaagagccaagcactgaatacctacataggttttctattttctttcattttaaaagcataatgacagtggaacaataatgggatatgcagaagcacccttcacaagttatttctgaatgatttttagggtaaataatacagatgccttgtttgttaactaacttgtggaaagcaggaatcagtgtctctaaggctgcatcctattaccacaatggggtgtgctataactgctggtattagagagggaactttggccctttcacgtttttcttaatgtttgtaacactacttcagaggtttataacctcaaagcagaagaagagcctcaacaacccgggacttataagttatttttatgttactagacttgcataaagattcttgttttccaactcttcattttgttgcaatgtgttattacaggatatatgaaccaattaaggtttttcactacagttcttgaataaaatttaaaaatcattttttattttaattaaaaatatttcccatttatagaatgcatatatttgcaatggacttccactttcatcaactttccatctcatcgctttaaacaggaacttgaacaagcactgttagtttagacctaaaggataggaaagcattaaataatactttggatctcctgaggaaaagataagtttgcttgcaatttacacattccatggggaaagaagagccatatttccttaaaaaaaacattaataaagcttgttattgagaaaaattgtagtgaaaagccttaagtaccaaattttaaagcagcagtaacttaatttttatatcagtgtttttgttttgcacaaactaaatgcagtggtaggtgggtttatgagtatattaattgcctttatccatttgtgaagttaagttgatgagggcaaggtttttgtttgtttaatttgtatatgtctaaaggtatttggaactttttacaggaattaaacatatatgcaaatttgtatataaaaatagcatggccatcatttgaatgcttgtaaatgaaaggattatcttttttgagatctatatataaatagaaatagaaaatccagctggactgattaggattcttttttaattcatttgtgtataacatttttattacaattacacatcagttttgacacagtcatagcaacattaatattttcccatgatgcagatcctttttgtaatgggcttgttctttgagatctctgtaaagaaccctgtgaactagaaaacataactcacagagatacttttttaaaaaatttatttactggaactgaaagttccagttgggatgaagcatttcatctcacttcataacacctctttgactgcacttcagtgaattgttcttatgtgcactgtgtagcaacttacattataacaaagcagataagggctgtaagctgctgcttatgttgaaaagtggttcttcagattttctctcataaaatccagttgaagataaataatttttttatactttat

SEQ ID NO: 114940 - DNA, 1014 bp, Homo sapiens
gccatatgtggtacccagtaatataaggtgaccctaatcccaggagatacccacagatctctagatggtatatagtactaaagaacacattttcttagaagttgaaagacattttagataaacgctaaaataattaatgtccatttagtcactaataatataataaggactttttgggttattttgttaagttttggtagttgaaccttcagtaaacttgattataggttcatatgctatggtaattctattttaattttattttgtttaattttgctaattttcataaagtgggcttatttttatagcaggacttaccatggtttatatctttttttaggtaaaggatattccctattttcagacaaaaaacataccaccacatgatgatcgaggtgcaagagcatttgcccatgatgcaggaggtaatgcattgtgcattgtacttgtgagatgcctctttatattaaaaagaaaactcttagttctttctagtaggataacactaaaaatttaggaagactcacttttggatcaactttaaaattataccaaaacaattgttaaagtcagcttaaaattaaaccacatttttgtgtatgtgtgagggacttaacagtgttttcagtgaagtactcaacctttcaaggaaatagaaaccaaattagttgtttctgttttttaaaagtagcacatgaacaatgtataacactaatcctcatagatccaggaaatagctgtttgtttagagtaaggagaaagaaatgtacttataaaatacacggtctttgttttgaactgttatattttaatatgtaaatataagccacaggttttatagctttatattcttaatgactttttaaacaaatgcctctttatacttagaattattacatatctttaggcaaatattgacgataattgaaatgatgtattatataatctcaattttccattttgtatttaaaacactatatattaaaataataaacatctgctggctttccttat

SEQ ID NO: 114941 - DNA, 3680 bp, Homo sapiens
agaagcactaaattttaaaatagtgaaattgttaatagagtaacaaaaatagttatatataaaatgatttgtggttttaagtcctgtgctaagtggtgttaggtgtacaaaatttaaggcatggttcttccttttaagaagatagtgtcagctttatcagactgtgtatttcaccaaatctgagatgccatgaattatgaaatatgccaatattttatgtaccacaaaagaagaagaaagaagaagtgctgcctattaaactaggacatactacaagatgcatattgattttagaatcagattctgtgtgaaaatagaagggattaaatgtgaaaagtgtgcatcttagaattgacaaaatatagaaatggtaatgcagtatgcaaattcacttaggattttcttttaccttctttgaaaatatatttgaagtatttgtaattattcaacagaaaagttaataaaagaaaaatcgtatagatgtcattaggcactcacttgggttgcgtcttctagtagaattgggcactaaatttaatgagtttcttagtatctaaggtaaaatgagaaataaacataatttaaacatgaatttataatgttaccacttggttctctgtaagtatattttaagattgggaattcatttcttacaaggtgaatttctcctgcttatagtaatttaaagaagaaccactaggaatctgtagtaattgagtaagcatccatggccaagtctcctttttccctttaatttcatcctgaatatttggagaatcaaaagaaacttcatgtaacctgtgccatagtgggtcttataataatttttctttggaaataacaggagattctcataaattacataattttacattttattcaagtccaaactctgggtttcaagaaagatattttcaagtagctgaatggtttaaccgtttatttttaaattttttcctctagatgactaaaaaaaaatttcctgaaatgtgatgtcactaatagttatcatgaatttgtcattttatatgtgtttttattaattgatccttcaatcataggtatgttcatattggaggatgaccggtttggcagcagctctactagcacatttttccttgatatcaatgaagatacagagccaacattttatgaccgatctggacccataaaggataaaaattcattccctttctttgcttctagtaaacttgtgaagaatcgtatcttaaattcgcttactttgcctaacaaaaaacatcgtagtagcagtgatccaaaaggagggaaattatcatctgaaagtaagacaagcaacaggcgaatcagaacacttacggagcccagtgttgattttaatcatagtgatgattttacacccatatccactgtacagaaaacattacaattagagacttcatttatggggaataagcacattgaagacactggtagtacaccaagcattggagaaaatgacttaaaattcaccaagaattttggtacagagaatcacagagaaaatacaagccgagagaggttagtagtagaaagttcaacgagctcacatatgaagatacgtagccaaagtttcaatacagacactacaacaagtggcataagttcaatgagctcaagtccttcacgagagacagtaggtgtagatgctacaactatggacacagactgtggaagcatgagtactgtggtaagtactaaaactattaagacaagccactatttgacgccacagtctaaccatctgtctctctccaaatcaaattcggtgtccctggtgcctccaggttcttctcatacgcttcctagaagagcacagtcccttaaagcaccctctattgctacaattaaaagtctagcagattgtaactttagttacacaagttctagagatgcttttggctatgctacactgaaaagactacagcaacaaagaatgcatccatccttatctcactctgaagctttggcatctccagcaaaagatgtgctatttactgataccatcaccatgaaggccaacagttttgagtccagattaacaccaagcaggtaagcaaatatatgtttagaagtgaccaataatggttgcattttaacaaatttaaatacaaaatgttagccaggttttacactatgtgagcctcatcactgacctattataattgtttactatggtaggctataagctccttgttacccgatatgacttgaaatggattcttgcagctgcgaggggggaagaaaatcctataggccctgaaaataaacatacatgctttgcaaaggacatacaagtcacaagcttttttttatttatttctcgcttctgcaaggatcgattttaaaaagaagcatgtcgggggaatcaggagcttaagacctacaataacaaacaaccttttcaggtaggtcaatttaaggctccaaaagttgacctctttattatttttttaaaaagataaatgaaaatttcagtgaaattattttcactttaagtagctgtgattattaaataggaacctaataaacactaaatgaaatacttggtcctcatgactcagcagggatttctataccatatttagattatatcaagctagtcaaagtgaacagtttagattttacttttaaaagatacacagtatttgctgcaaaaaaattttgtacctataatttttgtggttggaccaaatgcttctaaacaactttccttagttttaaattattcatttacatttatttaagtggattaatatatgtcaggtacttatatgtcaacaatatatgttagaatactttagcacatattaagcactcaataaaagttagctatttatcatcatcattggtagttatttaatgtaatccatctagcccttacattattcttaataacattaagcagttttgtttcaataatgcttaacacatttaatagagggtttcttggtagcagacaatgaattgtgtacccttacaggatttaagaaattatgcagcaatgtctcatctatctggaactcactagctttggcaaccttgtccaggacaaagccagggaaagttctcaacagctcactgttacaaatctatgcagtaaagttcatgaattttgaacattcctaagcctcagttacctcatctggtggagattgcactagatcagtggttgtaaacttttgtattgttgttttttaagcagagaaattattttttcacataaagatttctgtggaaacccaataggtagaatagatagaaagggacctatactggttgaaataggaattgggaaggggaataatccaataattgttttcctcccactccagtaatccttgaagagttttatgggaaccaaagaaatgtaacagattacagtttgaaagagtgttttttgggtggaaattaggagcatggtttttgctatgttaatagctactatttagaaagcatttcttttgtgtgttttacaaaataattatttgatttaatattaggctgcattcgtacattttaaagacttggttttccaaacaaaaatatcttcatataaatgtatataaatgtggaaccttgcatagtgccttgtatatatacagcagataccaagtaaatattttagcatgtctgttgcataagtaagaatctgtatgaga

SEQ ID NO: 114942 - DNA, 1042 bp, Homo sapiens
ctttatttttaatgtagttagatatggtatgctttttattctgtgtacatgtgtttggttaagttttattttaaattagcattatctttgctttaatattctttttaaaattgttgttattaaatgctttctttccaaaaagcttgtttatattaggaattttaaaaatatacgttgaattgacttcatgctcttcccactccagcattcaaaatagtaactatgtatgatgattgatgtgttcattgattgtggtaatcttcacaatgtatgtgtatatcaaatcaagttatacactttgaataatacaatttttatttgtcatttatacttcagtaaagctggaaaaaatatttgtttaattaatgtatcaatatagtaatttcttttaaccattcttattttttttttcttttaagtctccttaatctttgctccttgaaaaaccaagatcacttgctaaaacttactgtttctagcttggactatagcagagatggattggctagagtcatcctttccaaaattttaactgcagctactgatgtgagtataacatagccagtaaaactatatttataaccaattaattcactactttatgaattttgggctaagtaaaattaagttctaagaatatgatatggaaattgagtttactttaaaattttagtttctccaaggaactgcatatagtactcagatttttgtatcgggggaagaagctgctagatagaaagggaagtattctatttcacaagaaccaaaaaagtattcatatcaagggctagaccaccaattccaggcattcttcccttttcaagtagcaggactatcccaaaataaaatcaaataggctatttatgctgaagttttttttttttttaatgtattcatttatccttataggcctgcagactctatgcaacaaaacatttaagggtattattgagagctaatgttgaattctttaataattggggaattgagttgttagtgacccagctacatgataaaaacaaaacgatttcctctgaagctc

SEQ ID NO: 114943 - DNA, 1058 bp, Homo sapiens
aaatataccatttacagttacagaccaatgtggaaaatagagactgttcagttgatactgggatcattgattatccatatgggagtacagtgaaattatttcaacctcatatcataaacaaaaataagtttcaggcggattaaggatttatacgtgaaaagcaaagctttaaaatttcgataagaaaatatagaaaactaggtttctgaccttgtagttcttaaaaccaatatacaaaaaatacctaccaccatagaagaaaagtttagtaagtacatgttcaattgcatctaaataatcagtgtgtctttatataaatcagtagtgttattttttgtatttgtctctccaaatttgatgaaataatttactttatcaataataatttctagccttgatcttacgtaagctttaataatttaccaaggtaatctcttaaattatattggtcttgctactgtattgattgaattgtttttctcattaggcgagccagtgcagccttgaactgtttaaaacgcttccatgaaatgaagaaacgaggacctaagccttatagtcttcatttagaccacattattcagaaagcaattgcaacacaccagaaacgggatcagtatctccgagttcagaaagatatatttatccttaaggtgctgacatgaaatcatgattttcatcttaaacacaacatcttaattccttaaccactggattttagtatgcatgtatttgagtttacacttctcttcatgcatatgaattttcagatggcttctgagttttataatttggagatgggtttttataactttaaagttaaaaaaccttgatctatccttaaatggaaaagctgcctttcattttttcaaatttgaacttagttttctgatatgaggacagtttgccttaatttttcttattactttctgatgattttaggatacagaggaagctcttttaattaaccttagagatagccaagtccttcaacataaagagaatcttgaatggaattggaatcttatagggaccattcttaaggtatgaaaagatac

SEQ ID NO: 114944 - DNA, 1038 bp, Homo sapiens
cgatgtacttgtcttcattgatagctggttgggtggtgaggtttttgtttggaaagtagaaattaatatttcttattttaaagattatggcatatgggacacatctattttgagaaagtagtttttaaaacttaagaagtcaactcataaatttggatatggcatctagcattttaaatgttattttaaacataacttaggttgattcctgtaatgttttgacatataatcccttctggcatttaagaattgagtttaactgggtaccacttaaaaccataatattataataaagaatctatgaaacttaatggttatgttaatatgtgtgtatctttatattccatccttgttgaaagtattatagatatgataaaaatataaataagcatgtattggggaaaataagttaattttatgagtaaaacctcagaatttgtaatagtcttgaatacagcattatatgtgcaggtaatctgtgacataaactctttctacttctgaaaactcatgtaaaatgttatgcttcattttaggcaaacacaattcttcctcattcacatagccatcatttacactgcttgccaaccctaatgaatatggctgcatcctttgatatccccaaggaaaagagactgtaagtatcagagctttagcaaagcttttgtttgatatatttaatatcaaattagattattgtctcttctttttaaaaaaaatagtatggataggttatggtgggaaattcttttaaggaatttgctaaaggaaaaattaatagttctaaaaatatttaataatttgtcttttaggctgcaaaatactaatagtgtaataaaatcacttttttctagcatgtttgtagacaaggacatagaatggttatcatattactaaaaatgttagctgagaggtttttggactcctttatgtcatgagcagcaattctggctcttttttttatgtctatgaactatttcaaataaagctttacagtattaatatattcttttatttgcgtggttaaaaatgttgcaa

SEQ ID NO: 114945 - DNA, 1870 bp, Homo sapiens
tagagatggggtttcactatgttcctagtctcaaaattctggcctcaagcagtcctcccaccttggcttcccaaagggctttttttttttttgttttgttttttaaagtatagaagtacactctaagataatggtaaaaggtatagtatagtaaatatgtaaaccagtaacatagtcatttattatcattatcaggtattatgtaattttacataattccatatataatgcttttaaacaactggcagtgcagtgggtttgtttactccagcatcaccacaaacagttcagtaatattgccctgtgacagacaatatgactgctgctacagtttcactaggcgataggaatttttcagcttcatcataatcttagggaacgaccatcgtatatatggtccatcattgactaaaatattgttatgtgacatgtcattgtattaatagttctgtttttatcattttaaaaaatgtgaataggacatttaaaaatcttaaaagtgtttcataaaaataaatgaggtgtatttgtttgctaatttagcgaggtctacttgaagtgctttatgatatatttcgtcttcctctacctgttgtgactgaggagttcatagaagcactactcagtgtaggtaagtattgaagtacatttgtatcttttcatatattgtaatttttatttaatggagacagttcctaaaaggagaaatactaaattattgaacactattttcttttcttgctgcataattgtgacaggaaattaatataaaaataaaacctcaagttcctaagactgagaaattttaatttcttctttatcaccttggctctaagagcaattaaattaataggaatgggccaaaaaaggaagagaggagacagtaagaaacctatgtaatcctcagattatctaattctcatcttatttgagccaaatgacttaaagtaccgaagtcccaaaatgaagaaaattagatctgcgtgtatttacataactaatttttgtctgtatctttttgaatgtatggtatttaaccagcactttttaaagttctttatagcctggctagctgatggttttatacttatctgaaatgtttcagtgatatctaatcttttccctaccatattttaactaatttagatccagggaggttccaagacagttggaggctttcagatggctttgtggcagctgaggcaaaaactattcttcctcatcgtgccagatccaggtagaatttaaaataaaaagggtttcaatttattagaattcgggtttttatgttagactgtgtaatctatgaaactttatttaaattgtttctgtgctgttttttccaggccagacctcatggataattatttggcactgatactctctgcatttattcgtaatggacttttagaggtaagacttataaaccttattttattccattttgtttattttctctaacagattctttcatgccaggtgtggtgactcacgcctgtaatcccaacactttgagaagccaaggcaggcggatcacttcaggccaggagttcgagaccagcctgaccaacatggtgaaactgtgtctcaactaaaaatacaaaaattagccatgcatgatggcatacccctgtagtcccagctactcaggaggctgacacacgagaattgcttgaacccggaaggcagaggttatactgagctgagatcttgccgttgcattccagcctgggcaacagagcaagcctcttgtcttaaaaaaaaaaaaaaaattttgaaaaataaatctgatgcataaatgttttcatatgtattattttgcaacagtggtgttatctttttattttcaaagggtctagttgaagtgata

SEQ ID NO: 114946 - DNA, 1052 bp, Homo sapiens
actcaggatgctgaggcaggagaatcacttaaacctgggaggtggaggttgcagtgagccaagatcgcaccattgcactccagcctgggcaacaagagtgaaactccatctcaaaaaaacaaaaaaaagttgagttgaaaatatgaactttattatgctttattcattaaaacaatataaacaacacacaagggcattctcactataaaaggttcaagcactacagactacgtttaacaaaaggtaaatgtatttatgccttctaacttatgttttgtaatatgtggtgagattttattttaacgatggtggttttgattaaaatggaattgttaatatttctatatttattaggtatatttctaaattatttgtaagaatttgtattatacagttaaatcgaatttgaaggaaaagagaattcttaaagtgatttttttcctttctccttaaatgtttttatttgttttaattttgtttctttcttttgcccttccttatatgaaccaaacctggaggtgaaaaatattattagaaaatattagccaggtgtgccttgtttaaatgtgaaataaaaagtatttagataatggaaatggaaggatataattataaatggaaagatctgtaagcaggtaacaaacttgagataattcacttcttactgtaataggtggaaaaagaacatggtctttggagagtctgaccaactggagtttaacctctggttttatttacttttttgttagctccatgaccttgggacaattgcttttttgcacaattaggttaatgaaaaatttaatgactagattaagtgatgtatgtagtagtaagcatttagttatcccttctctaatataggccttatacagtttcaaaatatggtataatcatgcattggttaatgataggaatgtgttctaagaaactcactgttagatgatttcatcctgtgaacatcccagagtacttacacagacctagatggtacagcctactacacacctaggttatgtggtatagcctgttgcttctaagctacaaacctg

SEQ ID NO: 114947 - DNA, 1027 bp, Homo sapiens
taatatttcatgcaatgaacatttcagtttttgttgttcttttttttttttttgcccttctgttactagatttgactattcaaagctcctttatcaaagataaagcttctttgagcaattccatacaaactttttttgtggacatgagttttcatttctcttgcgtaaatacctaaatggaattgctgggtctgagattggatgtatgtttgtgtccatgagaaactgccagactttttcccaaaatacttacactattttatactcccatcatcagcatatgtgactcccagttgttctgcatccttgtcagtatttggtgttgtgagtctttaattttagccattctagtaggtatattttgatttcttgttattaatatagtttgcatttccctgatgactaatgatattgagcactttgtgtgtgtttattggctattcatacgtcttttgtgacatgattttaatatgtttaaaattgttcaacttagttctgtaacttaaaaattttgaatcatataatttatttgaagtctattacttatactcatgtgcattcagtatattttagaattgaactttaataaatgccaagtagagtttttcactttaaagtgaggagtataaaagaggggagacagaccattgtctgatttttctcccgtgttcttactcccagagaagagttcatcaggcagtcagactcatgaactttctgggtattaaacagatactgaagatggaatttaaatgacgaaattattggtaatctctaatcaatagagaaatacagagtatgcttcaaatatatttcagttatataatagttcttatgatgaccaaatagtatcataatcatataattttgcctagaaaaatatgacaagttttatattatacattgccatagaaatttttttgaaattcatgtcagtgatttttttttctttctgtcctctttaggtattattaatttatgtaaacctggaaattctgggatccagtctctaataggagtactttgc

SEQ ID NO: 114948 - DNA, 1351 bp, Homo sapiens
agaaagtagctggtgatgttaatatgtagttatttcataacatttcagtgactatataggttgttgaacttgcttgttggaaacgttcaaataagtttagagcaaagattgtgaagtaaacagtgtgtgtgattaaaattaagaggtttttgtgataattttctttgctaaggggcagcctagtaccacagatgcttattaagcagacttaatgcttaattaaatcttatctaagaatagttttcagggagcaggaatatagaactgagtagaaaagcagaatttatgacttaaacgatgttgtgagtttaagtttgaagtcagtttataattggctaatttgctttagtgtagatctgatctttgtcttgttttaattttatgtgtaaatgtttaaacattagtgatagctcttattgtgatttagtagcaggaaaaaactcattttaacattttatttcattgattctccccgctgcctccccacccccaacagagaagacagagaagcacgatttctagccagtaaaatgggaatcatagcaacattccgatcatgggcaggtaggttactctacattgctttataacatccaagaagaaaaactagactgctttttcaaatgttaaattattattgtagcacctaattcagatgctaatctagtcttactttgtatattattattagaaccaaaggaactcgtacaaaattattaaaatatggtgaaggaaatttgtaatagtcaataggaattagctaatattatgatcagtatacacatatttattatttgccagtcactgtgctaatgattacctgggcaattaaaaaaatttaagcatgatctttaccaaaaaaacctacaaaacttgagtgttagctgtgtatgtaactaaagtttgttacttaaagtacagtgtagtgtcatagatacaaaataagcaagataggccattaatagttccaaatttcttgagaatagggattgtgcatgttttatctttccatggaataaaaagtaagtattgtttttaaaataataccaccattaaatgtgttgttaataacattggggttttgccattaagagtaattgagagtaatggcaaaaaccgcaattacttttgtacccaatgtattaatgattatcttcttccttcttgatttagtattattgtgaaggggtagcatggaaaagaagtagcaataagcaaaaaaaggaaattcacctaaacatttctgtgtacctaggtaaccctaacttaaaaataccttttccatacaaatgtttactccagccatttgtatgggaaggccacttggcccctaaccagtatgtttccaggg

SEQ ID NO: 114949 - DNA, 1158 bp, Homo sapiens
accattttaatcaaaatctgaagttaaatcacaaatgaaagatttgagacagataaatggctaatatccctactttataaagaactccctgcaactgataggaaaaaaagccattccgttattatatggacaaagggtatgaaaagacaatccaaagatattttaaatatcaggttgtggggaagtatattcagtgactcttacattttccacttgtccttttatctacctgttcttataaatgttggtattagaaagtttttcaagtcagaaaggcaattaagttttaaagcctagattttttattacttttaataattaccccaaatataatatgttaagtttttctcttttagcacttcagaatccagaggtggtggcccttcgaggtggactaaacaccatcttgaaaaatgtgatcgattgccaattaagtcgaataaatgaggccctaattactacaattttgcaccttcttaatcatccaaagactcgacagtatgtgcgagctgatgtagaattagaggtaggaactttaatattcttttctagttttaaaatattattataaatgtatacttttactttgaaatactaaattttatagatgcagcaccacattaattatcaagcctaaattagccgacactaatttattcccagctctgttttacagatcattcagtttggactgaattgaaaacattactcttaagaatatttcatcaatgtgtaaattttatttttgtattatctatgaaaagtttatgaaccaaattagagtacaaataaagttatgtaacaaatttacctatttaagattaccatttgtttttaaggcctttagtacattgtgtgtgaatagctcctgctaattatacaatatttatgaaacctaaaattatctgaagttggaagcactttgttagcaactaattatatctacttgaaagaaagcatgtatgtatattttgtaaatacctcttaaattttttactgattcaagtaaggtttattacagttagtcaaaagtaacagggctactgtataccttataagaaagtatgtcgtggaggttggaacagaattatgcactgtattatagtttcttcgtgtgcatgtattgcattgttgtcctttgaatatagtatttggagt

SEQ ID NO: 114950 - DNA, 1060 bp, Homo sapiens
cttgtaactattaattagcattattttaaaacttttagccaggttattagccaaaataaaatatgtttatatattggaaaggagacagtgttactttgtagatggtatcttatatatagaaaaactctgaagcgaaaaccaacttaattttaggtagtaggactatgtgaaaacacagatttgacagatttttgtgtttcaacaataatcagtaattagaaaaagcaatactattttaaagtagaaaagaaaatatataagacaaattttataagaactgtgtatgacttgtgtgtgtgtttgggaagtacttttgaatttgtcaaattggttcttaagaagacacaactaatctataagggtagaaatgagaacagtggctgcctgtgcaatggaggaggactcattggaaagtaatgtgagagatctttctaggataatgagagttctgtgtgttgagtgggacattgttcatagtttattgaactataccattaagatctgtgattttactaaatgtaattatgcctcattttagaaaatagaagaaaagaaacttgattctaaaattttctggaagaataaacagtaaagaaccaaccatgaaaacatttttgaaaaagagtaaaaataaacatttttgaaagagaatatatttatatgtatatgtatgtataaactgttaactgtttatatatatatatgtatgtgtatatatatgtatatatatatgtgtgtatgtatgtataattttaaactgttaacctaggttgttaagggagagaaaaatgaaagagaatcaagagttgctgaccctgataaacagaaaactttaatgtatcataaagtacaaaaactagtttgggaagcatcccaggataattgattcaacatttggaagggggaaaattgagtttatcatcttaacaaaactcagcttcctaacagattgaaaaccgaagtgtaactaattcatgaactcttttaaaacacatatgtacacatgcacgtatgcaaataaatgcctgatctttggagcaagaaatttttgagcttaaaa

SEQ ID NO: 114951 - DNA, 1031 bp, Homo sapiens
gtaaattggtaggacttggtgatgatggtatatggagagttggtcaggatcgtaaaagtacagtagtatattgactactattgtcccctctggtttaccttgtctaggtactgaaaaactgtttaagatttaggccctattctagagtaatttaaaatctcagaaacatttggtcagtgaatttatagtctgtactgttagaaaaaaatctaacacattttccatagtaatggctattaacatttgttacatcaattattagttatattaatcttttgaaatatccataagcaaaagattaaaattgatacctagatcttattctggatcttattctgttattaactacttcagtctggacaaaataggtttaagaaatgtattactaaagtaacttctttttctgattccttctgttacagatgattactgtgaatgcttccttgtttcctagttctgtgaccaactcattaattgcagttggaaatgatggacttcaagaaagagacagaatggtccgagcatgcattgccattatctgtgaactaggtcagaattttcttcaagtaatgaaaatgtaatattttagaaaggatatataacatttgagatatatatatctatcatatatctatcatatatatatcatatatctcatatatctcatatatcatatatctcatatatctcatatatatcatatatctcatatatctcatatatatcatatatctcatatatatcatatatctcatatatatcatatatatgatatatatcatatatatcatatctgatatatatcatatatatgatatatctgatatatatctgatatatatcatatatctgatatatgtcagatatatatatcatatatcgtatatatatcatatatatcgtatatatcatgtatatatcatatatatcgtgtatatatcgtgtatatcgtgtatatatcgtatatatatcgtatatatatcgtgtatatatcgtatatatgtatttttttaaattatactttaagttct

SEQ ID NO: 114952 - DNA, 1023 bp, Homo sapiens
cttccaatgcaggcagctcttttctggctttatctccctcatttttaatgtaatttttccactagtcagttactactattcttttcttaatcttatttaaattctactcgctgcccacctaatttgagctgtcatttttttcatatatagtttctttattcatgtaataaggaattccacaaactttttacatttgaaagagattcattggctggtatctcatgcccttgatacatagcaagatagtggcaaagccagagcaagaaccctcttctgcaaaatttccaaacctacattggcccatgagtttgaagttcaacctgccaactttggccttcagagcccagttttggtccagccaactatttttatctgacatgtcttttgccaccatgtgtaggcaaactacccaccactactaccacaattgttacttccttcctactcttcattttcagcccttctcaccttacatcgatcttctagtctgagctcaaatattagatattccccttaggtaactcagtgcttctctaattcctttgtgtcagttccacaaatttattacctaatcatgatctttaatttgttttatatgtctgccctgtcatgccagaagagattattaaacttttacagttttaacagtgactgcattttatggcttctcccttactgagcattcattgatttatgaggaaagcattctctgatttacacacaatttaagagtttctttgcatatatttacctggaaaataagaagagtgattttatttgtaaaaattttatgtatatatttcatagcacaatctggtgaattaagtatatgtttagtagacacaagatttatatagaattttatacttgaaactttagaaatcatctgttcatacatatcttcattttacaaatgaggaaactgaggcacaagagaggattggtttagccaaggtaacatagtttattatagcagacttaactctaaaaaccattttgccggttttttcagccagctcttta

SEQ ID NO: 114953 - DNA, 2499 bp, Homo sapiens
tcttcttggttgtttttgggaagacagtcagaacctctcatctctgacatggccaggaatggaattctaagtccatttgaattttaataggattgccttagattaattgtattcagatagaagaaatgctttttgaatcacagactatctatatataaagcattgattagaataatgaactgtctaaataaaaattatgcttctacataaaagactttcaaaactggataatttaataaattttacaaagaaatgtcagtttggtgctatttgtttggacatcaatatttgaagtgaattcagaattcaaattatattttggtaagatagaatttttatggatagtgcctaatttagtttaagccctggtcaaaattgcaattaaatgaaaacagccttgaattatttttcctttacaatttttataaaatgtctgaattttatcagagataagtgaatttttttagtagactttttacactttatgtttattattctttctttatgaatagatgtagtcttgtaaattactatactgttctttcctaacgttttaaaagaaaaaattggtcttttaaatgacagatatttatccctcgagatgtatgggttaattaaataaatatatgctggtactgagaaatcatataccaaaacaataatataccatattgacattgtgaaaatgggtttcatctatcagtattgtgatacaaaaagttgtttaatagaattttatcaatgattaatattttgtgtattgtttaggtgcattgacatacaacagagcaacgaggtagagaggacacaagcacttcgattagtcagaaaggtatgctctatgtgtgagagtaaaaggcaaatttatggtttttatgttaatatttacatttttagattagacttttgtgaaatctttattaagattaaagactaaacttttattaaacatttttattaaagttttatattaaataaattcattaaactttgaggtaaacaaatattttgtggaattctatgtgattgggtataggtagggcaatatttcttataaaatgtttattttgaagaatatttcttccttcagtagacatgtaaatgtagttactgctttgataagttactagaggaagaggattacttgctccccatcctgattttctcttaattgcatacttagagttaatagtattaaatggaagtcacaaatactaagaagttcattgttttaaaggtgaatttggatacaatctgtgggcagttgcaataaacaattcaggcccttgtacaggataaaaggtcacagcctacactccacaagagagggtgttaaggacaatccataatgcttctcttgagaggccttcagggaatgctttgttgtttttacttgataccctaatggtggaagaagagagtgaactgagagtaaatatggttgggacacagcctgagtgagacaagtgtcagtcatattttatcttaatgttcatgagaatcatgaagtatatgtttgtttgcataaaaaatctaaaaatattttccagttgaattttttagttctttttttctcttcctatctttcaactcagtacacaggttccaaaatggtgtactgttcaatttctatgttagctagggttccctgtttttcccttttcttaaaattgtctaccttttggttagtaatagtaatagtactcacaggtgaacaagtaaatggatgagttaagccttaaaagaagtttgaaattcgactaagaatgataccggaaatagattaggagactcttgttataggcgaactgttacactaggattgtaatttgacttttcaaattcagattttaaaaatctatggtttttatttatacaattcttccttcttccatgactgagaattcaagataaaacaaaatttgtttctgaagaacctagaacaattttttggttatttgggttatatgtcagtatttataatgttagggactaaaatatatattaatatgtttaaaataataaacacattaaatacaaatataaataacatttttatgaaaaccatattttattttattttattttttcaataatttttggggtacaggtggtttttggttacatggataagttatttagtggtgattgagatttttgtgcccctgtcacccaagcagtgtacactgtaccccgtatgtaatctttttatccctcacctcctcccaaactccccccacctctggtccccaagttaattatatcattcatatgcctttgtgtcctcatagtttagctctgcttataagcagggaacatacaatatttggttttccatttctgagttaatttgacttagaataatggcctccggctccatccaagttgcttcaaaagacattatttcaattgcttttatggctgagtaatattccatagtgtataataccacattttctttatccactcattggttgatgggcacttaggaatgactat

SEQ ID NO: 114954 - DNA, 1052 bp, Homo sapiens
ttgaaattttgtgttgagtttttagcatgcctgccataaagtgtatagatttgtactgtagtgtaactttgatgaattttgtgtgtgtgtatatatatatatatacacacacacacacacacaaccaagtaacaagatttagaacattttcagcatcccagtaaagctctgttacatctccaatcagttgtaaacattattctgacttttcccattgcagactagtttttcctgttcttgagcattgtgtgttggacgtatacagtaattactctttcttcttctcattattatctttgagattcatacatgttgattttttttttttttttttttgctgtgtaacatttcattttataaatagaccacaatttattccattctgttgaagcttttctgggttgttttcagtgtttgactatttggaataaagctgccctgaatgttcttgtagaaggctgcaagaatattcttatagaagaggaaatgcactcatttctcttaggtatatgtagaactagaatttctgggttataaggtacatgtatgtttagctttagtagatattgctaaatagtttgctaaatgattgcactgattatacttctactattatgtataggagtttcagtctccccgtgtccccatcaacacttgctattttcagtttttagttatatcctttcttgtgtggggtctcattgtggttttaacttgtgttccccggtgagtgatgatgttaggcacttttcatttgctggttgaaagtttggatagcctatcttttgctcatttgtaaattggattatctttcttgttatgtaggaattcttgatgtattctggatatgagtctttacagatatatgtattgaaaatgtcttgtttcagtttgccttgcctttgccttgcctcttcattcttttaatgggtctttgatgaacaaaagttcataattagtgaaatccagaatgctttttgtctatttggaagagatctgtgttttcttttaaaggttttattcctttatacgtgtttaagtctttgaaccat

SEQ ID NO: 114955 - DNA, 2009 bp, Homo sapiens
aggttgcggtgagctgagattgcaccattgcgctccagtctgggcaacaagaatgaaactccatctcaaaaaaaaaaaaaaaaaaaaaagagtctgagaggcccagtgcggtggctcacgcctgtaatcccagcacttcaggaggcttaggcaggcagatcgtggatcacctaaggtcaggagttcgagaccagcctggccaacatggtgaaactccgtctgtactaaaaatacaaaaattagctgggcgtggtggcaggcacctgtaatcccagctactcggagggctgaggcgggagaatcacttgaacccgggaggcagaggttgcagtgatctcagatcaggccactgcactccagcctgggtgacagagtgagactccgtctcaaaaaaaaaaaaagagtttgagaaataaatgacatgactttcaaaagagtcaacaataagactgatggcagacttcacaactgaaatagtggaggccatcttgaaactgttggaggaaaatagcagctaacctaaacttctaaatatccagcaaaatattcttcaaacttcaatgtaaaaaaaaaaattatttccagagaaataaaaaccaagaaaatcattaccagcaacctggtctaaaattaaaacactaacagaacaagtcaacagcaacaacagagttcttcaggtaaaaggaagatatcccaataaggaaccatcaaaatgatgaataataaaaagggtaaatatgtgaataaatataaactgatattgactaaatactgttaaaacccattaacagtaatacggtatagtttttaaaagatagaaaaaacaattgtaaagtgaaatgtgaggggagaaagtgaaattaaagtgtgagattctggcattgaggacattgtgaagtgatactttttgttagataagtcaacaatgcatgttgtaatcttaatagtagccactaaaagaaccatttttaaaacagtaaattattgagaaggaaaatggaataatagaaaacaaatgattttttaaaaggcaggaaagataaaagattaaagaaacttaaaactggcaggtcaaatgagaaatagatgatacaaataaagctgctgatttgaacagtaaaatcatatttttcaaaatattattccataaaaataccttattttccagtgtaaatatataatgtatataaatatgtgaaaatatacaacacataaatgcacacttattttgtttttctgacagcttctttgtgatattggccacagtgaagaaaaactgggctttcactatgaggatatcataatttggtaagtgtggttcattcccccctcccatccctttcagattttagtaattttaattttagtaattttaaactagaaatagaataatacagcacctcatatttgattttatagaaatagttgcttgaacattagaaaaaatctaagagctacagtagttttgtttttgtgagtctttgtgatattttctaattactaaatatgaagaaccaaagtgaatgttcaaaaatatctggacttctataatttaaacttttaaattaaatctgaaatttgcagactaaatttctcatattattcccaggaacaactataactctaggtcttacctaagagaaagtttgtgcttacaacagacttgatttgcccatgcacactaatagaggcatgttatatggctttataactatcttttaggtactcttaggaattaaaattgatataaaaggtctgtgcctgctattggcataaattattattatcattgatttaaaccaatgatttttgggaggtatggaaccaggtaggcagagagaggatattcgattgtagagacacaaatggtacagcttgaaaaaggctgtaccattgtttatataaaacaaaggctgtttccattgtttatataaaataaagtacagaaggtaagaaagaactcaataacattttcttgattggtaagaatgtactaaggaggcacagat

SEQ ID NO: 114956 - DNA, 1484 bp, Homo sapiens
aaagaaaaaattggacaggaaatttttacagttatcctaccaatagggtagtgaacttttatcagctttttcttagggtccatgcttctcgtggatgtgatgtgatatgttgatcactttggttgctttatactgtatggttacaatgtttataacttcatactgagaaagaatattagcactttggagacccttcttggtcttcagtgttaaataaatgatttatcttctctttaatccatttcagttagccgcaataaatcaattaaggacattatatgtaacttttaggtaaaagtcaattctccagactcatatctagattaaactggcatatattcatccaggtgggatccataaaggtagtattagaccaccgctctcaatgaaaactaggaaaacctgtttgaaggcagcaggaagctgctcgggcaacaataagtgcagacaccaacctttcagaaaagagagaatcttgtacaaataagctgcttcaacaactttttcccaggggacacttgctgatgttaagtatgggcaggaaacgggattcaagcattaggcccagaaatactgttgccgaaagtcaaaaaacagcacagaggttttggtggagtcctacctagatgcatcaagcatgaggagattctcccctcagttcagttgtttaatcctggggctacctgggatgagaaacttaaaacctaagtagaaaatctttgaaaatcaggaatggagtttgcaggacaaaaattaaatttttcatcctccttggactagttttcttaacaataagctttcagttgaaacttcaggtggcagggaaaaagcagaggtaggcctggtcttaccagggcaaccacctaacgtggactcaacaccatctagtggtttaacagaaagaaggctgaaccttctgtggagacagataacaccatcaaatctttgcaagtttttatatacaatcaaagactaaggagctaccaaaggacaggattacatgactagaacaaaagggaaaacagttaataacagatccagagatgatccacatcattcaggtttattagatgaaacctattttcagtaacaactatgtcatgaacatagaggacgtatggagaaaattgatgtgaaatgaagaatttcattagcacattggaatggctaaaaggattaaatggaaattcaagaagggaataatacagtatctacatttaaaaactcattagatacatgtaatagaagattagacacatcagaaaacaggttatagaaaatattcaactgaagcattgagataaaatggaaaaaaaaaaaaagaggatttacggatttgtgatacacatgagaagatctggcatacatttaattgaattaccagaaggagagtttggacagaagtagttttgaaaatatattgtatagaatttttcaaaactgcagaagtagatcaacccagagatttaggaagttttgtttac

SEQ ID NO: 114957 - DNA, 1087 bp, Homo sapiens
acttcaattaagactaactacatttccagtgctcatagtcacttgcaactagtatctactaaccacattggacagtgaagatacacagctttttggaacaggagtggcttaaaagccttcatttctaggaatctgttgaacacctctggccttcatttctaggaatctgttgaacacctcttattctcccttctcattcttcatttatttctgtctaggtcccaggttttcttgcattaggattagtttccctttttttctttcttcttctctcttcagtttccttgttttctgttggtctaaatttcccccacagtatttcactaagttattcgctccacctcctctctctttcttgatttgtgctcccccactctcttctgccctttctccttctcatcccttctctacttcttcctttcgccccttcatcttctcactcttttcttcacccttccttgtcacctttctcttcctccctcttttctcagttccctctccccccttctctgttccccctctccttccttttctccgttgtaccactgtagagtatgcagtgtatctctgtaatgaaggctctaaactttttgtactttttgtcttgtttgttttttgttttaccatatcctttttaaaatgattttcatatatccctctggccttggtgcaagctttgtagcagcccctttctttgctatgttgccatgattttaaaatcctgatagccaaacttattagaatttgtctattctaagagtgagtacgccctgagtcaggatcttaggggctgtcccatgaataaagtccatgaactttggacttcataaaatctattttggctgcttagtgatgtgctgggaaaagcatgagctttagatgaaacagatggagacttgcagcccaactgtgattaactgtcagggcaatcttaggcagatttctttactcagaggtaatcttgctttctgtagaggcaaggtctcagtctagtgcctgacacataatatgtgctctgtaataggtagtgccttgattcaacctcatgtttggtttttgtgttttgtgtttttttgttttttgtcac

SEQ ID NO: 114958 - DNA, 1988 bp, Homo sapiens
aaacctggtcagtcattaactgtaataatcattgtttctgaacagttatagatgataaatggaaatatatttagacatttgcttcaagattctagtcagcctccagcccttcaagaaaacattttataagtgattttaattagaaggagctcatgagtgtgaaaaaccttgtatgaagcctagaagaagagataatgacaggaactaaagctttgttaggttcatgctgcctgatagccgttatatgcatatcaccctcctttcacatactccttttgtagttgtttctttttccttcttctctgtcctcttggtgttttgcttcacagggcaattggaagggataattagcaatacttactggaattggtacatgaccagacatatacttcatgcttagtaaatgttggttggaccctcctcctcctgagtactgttagcaacaacaacctggtcttaaaaaatgtttactcacatatttattatttaatatagaaaaataattcttgaaagcctactgtgtggcagagactgtggtaggcatttgaagataattgtaagcaagatgtccttgtcctcataaagcttaaaactcttcatagaatcttggttcatgttatataactgttcacctgtttttttactgtcctgttttagagtgaaaatattagaaattacagagctacacagataacgctctagagtaaatgacatctcatccaaactactgagagtttaggtaagagtgatgggaaattaaaggctaggtaagtgatgggatagtgaataagaattgagggatccttgaagtgaccgtaagatgttggggaatatattctgagaatatacttatgacaacatagtggcctgttgagttatcagcatatttggctttattaaatttgtactgactcctttaatttattataatttactactcttgcatgactgaaaaaagtttttttaaggatttgtttgaggtttcattaataacagttttagatagaattatgtatcaaaaagtacgtcatatgttatataagcaaaacaaattctacctgcatattaaatgatttcaggtaattcacactaagaggaagagggtcataatttctagtatttgtgtagcactttatggtttgaatatttctatatggaatatctaatgtgatcattaacatagctctggaaggtcattattgtttctactttaaaaacgaattaatcttggatcatgaaagtaatgtactactaaaaccctcatataataaaagttaatttaaatagactaatgtgttaaacacttgcctgggccagctgtataaatttcacatgattactctgtgaaaattggttatgctaaacaaataacttttaattatagtcattatttattgagtagctgttatgggctaggcactgtgctaataaggaagttatatctcacattttgcaaaagcatttttaaagtaggcaaatatttccactttacgtagagaaaatggatgctcataaagttaagtgatttagccaaggctacatggtttaggggtgaatgagctagacttgaattcagttcttttttattccaaaggttttttttcctttccattactcccaagtagcatgtgcatgccatcagtttttggtcattaatttactataggtacttggattcagatttgtttaaaaatcagttttgtgttgtgttatttattgacaggtaaagataacaatatagtttattgcagcaagttataaagcagcatatattgaagccaattttatattaatgtttacacacatatatacatatgtgtgtgtacatgtgcacatacagagaattgagccaagaaataaataaatgaataattagtgaataatggtttatatgttagttttctcttggtggtgtatgtattatgtatctttgtatatgtgtgtgtttaaatatgtaaagtgttttatgattagtgacttaaatgcat

SEQ ID NO: 114959 - DNA, 1083 bp, Homo sapiens
ttagcactgcgtgaatatagtgcttgagagggtggaatagaaaaggatcagaatgtggttttctgaaggtagacagcaggcttaaatttttgtttgcctttttctttttgttttcctatgcattgccatgttaaaagttttgtatttgacaaatttgggtgaatgctattgcattgttaattatatttaattaggtttgttcttaccttagaaagtgagattccttttcaaagcaatagaaataagtttggttagggtttttggaaaattatattatttcatatcttgttgctcagagtttgggaagtagatacattttgaagcagcatagtttttttttattccctcttttgtgtatgtccatattataactatcattattataactactcataagatagtaagtcccttgtccattcttatattttagaattcacaggtatgacctagagacttcttctgttataaatgccagattgttaaaagtcaatttaagaagcatagtcttgtttactataaaaggacaataaacatagtctttaatatctggcaaaataacaaaattttttttcgttcttgctttttaactatttattgaatagagagacatgaatttattatacatgttttgctcaatgaatctttgacagattgacacctgtgaaaccagcacccagatcaaaacagagcttggtatattttaaacatttttaaatattttggttttaattgacacataataattacatatttatagggtacagtgtcattttgatatgtgtatacattgtgtaaaagtcaaatcagggtatttagtaaatccattaatggattaatcagttttctgtcgcttataaaagaatacctgaaattgggtaatttataagaaaaggaattcagttcttaccgttatgaaggctaagaagtccaagattgaggggctgtctgacgacaccttcttgctgtcattgaagagtcccagggtggcacaggttatcacatggcaagggggctgagcgtgctaatgtgctagctcaggtcgcttctcttcttataaagccaccagttcctctcctgtgataa

SEQ ID NO: 114960 - DNA, 1026 bp, Homo sapiens
tcaccttatcatcactgaggccttctctgatcactgtgtctgaagtagctcctcttactgtcacttgtcattttttttttttaatcgttttgccttttcttttttgagacagggtctcgctttgtcatccaggctggagggcagtggcatgatcatggctcgctgcagcctcgacctcctggactcaagtgatcctgtcacttcagcacccccacgtagttgggagtacaggcacacgccaccaagcctggctaattttttggtattttttgtagagacagggttctgccacgttgcccaggcttgtcttgaatcgtgggctcaagcgatccatctgtcttggccccccaaaagtgctgggattgtaggtatgagccactgtgcctggcattattgctttttctttcatagcccttgtcactactgatattacggtatatatttcttgtctccctggaatgtaagttttgtgaggagacaagtactttgttttgttcaccattgcatccttggtgcttagaacagccctgggacatagtaagtgctgggtaaatatttgttgactgaatgattgactctcaaatttgtgtttaagcttgagggctcctgaccaattttgctgcttactcagcatcgtaaccatgtcgtcaagtacatcaaacctaatatgtttcaaactggctaattatctcattattctaaaaatctttctgggttaagagaagtactttaattgggccaaataagacacccaggagacatcttaacctcgttccttgtccttattccacatatccaatctgagaccagatggtaatgattttatctctgaaatacttgcaaatctgttttttccatttctgttgccatgcctttattcaggcccttattatctttcctgatgattctattgacttcgtaactactctccctgttctagttctgttcttttccaatctgttttcttctctgtaaccaacaaaaagtttcccaaaaagtcaatcttccctcgcagtgttgaacatc

SEQ ID NO: 114961 - DNA, 1156 bp, Homo sapiens
ctattttgctatttctagcctttcttcagatgaccctttaaatagagtatgctatatagatgaattacatttttcttttgttgtacttgctacctctttatgttccctgatttaaaataagttttaatatttagatttttttgttgttttcagtgattatttgccccctaagaaatagtgatgtgagagttggaatagaaaaagattccactgcctttcttttggtgcttgtctccgagaaatttaaaccgggtattttgtaggaaattgattaaatacctgacagcaacttggcaacatgtgttgttttagcatacacttttaaaataaagaaaatttttacttatttcagtatgcaaaagcactagagtaaatatgaaagtgaaacaaaaatactgaagtgtatgaaggtaaagaagtttctgatgaagtacattttctaaatgctgataattaactatgagtattaatttattttaaatacttgaagtgtattaaatttttatacatacactctttggaagtgtggaaaacagtgagttgggaatttcctgaagatgggaacacttaatataaccttgacagatccttgctgactctgagtctagactatttaaaaagttcactgagcagatttaaactgagtgtagattattagctaccaaaagaatacttgtttttagtggtgaattttaagtgattgcttgattctattaagagtgatataatgcagtaaatgtatatttttaaccaggattatattatttattgctcttatatatactggcacatcattttcctttttccaaccattttaaatgactttccttagaataaagctgaagtagtgcagtaaaccagtgaccgttccacatgatctgaactttgtctaaagtgataatttgattattaaaatattactaaatgtagtttatggagtgatggattaatttcgcagacatcccagaaattatatacttactaagtagatgtcgttttcttttaagcattcttcttgcaagggacaggatcaatggaaccaacatcaatggaaccattgatgttactattgttcaaaacattttaaaattctacttgtgaagattgctaaagcttgtaaggcctttaaatttatcctatatattattagtccttc

SEQ ID NO: 114962 - DNA, 1039 bp, Homo sapiens
atttagttactaagaaggaacagcttgtcagataaaagtgtatttagctgttttagatgtgtgcacatacatatttttatcagtagtttcatacttcaaaaaatcacatcttaaaatagtattgctatttatttccatgcttagtgtttgaccctcatataataaaatttttaattacactttttttcactcataattctataatgcactttctaatgtttaccacactaccgtcaccaccactcccctccctcaagaagaaaaaaaaaggaaaaatgaaaaactctgaggggaatggagttgcagggagagactccagtggttggaaacacattttgaggtaggtgagctgtgaactcttaacatttagccatgtggtagtttctggatatgtaatcaggtagcaagtggaatattgtgaaactgtttgttcagtgtatgtgttataagtttttaatcatatctgtcacatgtggtattagtataaaattataataatggatgtttgaatactaagctatttcctaccttgtttatttagagtgacgtattactgtaggctataactttcagcggtgtttttaatggcataacagtagaaagcaggtcagattaattcttatgtcatataagatttcatatgttatataagaataattcttacatgacaatttgtagtgagttaaattttagattggaatagttttaaaaatgcttaaaccaccttattttaataaaaaccttaacattgtctttcttttttctcatgggaaagtttgttgtttcatggtcatatttcaacattgttttgaatacacaagtatatgttattattttacctagcagaatgaaaaaagttatatatttgaaaagattctggttgttcttcatatcaaaattaaaaggagatgattaagattcaggtaaactgtggcagttgccttttgctatgcattgtttcttctaatagttattttgttttactaaaaaaactctacttgatttttgattccgggaggaattctttgcatacatcaat

SEQ ID NO: 114963 - DNA, 2126 bp, Homo sapiens
acggggtttcaccttgttagccaggatggtctcgatctcctgacctcatgatccacccgcctcggcctcccaaagtgctgggattacaggcgtgagccaccgcacccggccctgaactctaactttttattttccagtttcttctggttaggagttttctcatttgtttaatcattcagttagacaaaatggacattgactgaacatttatataccagatgctgaattaactgctggaagaataaaaatgaggaaactctttcccccttttaagggtttcattggaatagacataaggaaatgattgcaggtggaaaaataaattaagtaatcaaactatataggaaacagaggtaacccaatagtagccagaggagagaatgattaactgtctggtgggtaaaaggatcagagaagtctcatagaggggttgacttcttaaaagaataatggtggacatagtggaaggaaatatgtgctctcttgggaatataccataccctgggaaggggaaagttaggaagcagaggagctgcctagggtgctgctgatataatctgacggatgatagaagactggaccatggcgttggctacagaaatgaagtcaaatacatattaaaatggaagaattatctaatttgctttcttcagatttcagactgattttgtagtccccccactctatgcagtgaattttatttctttattaaaatgtagaggctgcccatccagtgtgaattcctcaattgtctgcccagacttactgtctttaccctgattcaaagaataaagcgttgctattcttttccaagggtaacttggaaaaacgtttatgcttctaatactgtttcctcaagattctttgtagaactaagatcttctcttcatttctcccttacagttggctcagttttctcatgttcagcaagcaatttttatgttcttcacatggaccaggtactatgttaggcatgggctgaaagtgggagatatggaatgataacgacaatattacaaaaacttttttttgaaggctctacagacagaatagtttgtcttcactccacaactttattgcttaacaaagtcttgtaagcaaaactctccctctgtactgaaaataatttcttaaaagatgctagtaacctcttgcaaaatttatgggcatttttaagttccacattctactattatacatactattactataatactagttttgtgccaggcactgatttcattattttacttaatattcagctgttttagctacacttattgtctctgttttacagttgagaatataggctttgaaattttaaagggctaaaactcaaacaggtaacttaaccagtgtcacagggcttagtgagtgactggtatgtgtctgataatcatctcagagttgtgatgtgtaaaactttgcaccccaaagtgtacccacttttcacattctaggtatttccgccatcctctgttattcaagctagagatctgctgcttatcctctttgttgtattgctaaactcctctgattagcttctgaaatagctgttgaattcagtctctccttctgttcccattgtcagttcatatcctcattatgtcatcgtgtggcagtaatatcttctcaccttttttcactcggtctactgtatgcctgccaggattatttcccagaaatctagatctgatcttgttgttctcttaaataaaaaaacaaaacaaaacacatacacacattttctaggctaatttttgctcacagaatacagtccacatttctttagtttggcattcaaggccttttttgatttactcccatatggttttcttctgtactattttaaccatacacatctcaatatatctgcctctctgcatagttcacttcattacatacagtccttctcagagaggattggggagagtttgccagtctaaagcaccaacccccattccacctctttctccgtggagactgtatgcccctacttgagaatctttcagtcaaagaagaatgtttgctattccttgaacatggcatgtagtttaatattcgcttgaccttgcgtaggtatttcctttgccttgaattgcatttccagcacagtttatctatag

SEQ ID NO: 114964 - DNA, 1664 bp, Homo sapiens
cgggcgccgcgagggcgcgctgctggggaggagccgggtccggggctgggggccagaggcaggggcgggccccgcacgggaccggcggggtgcgggggccagagccggagccccgcctgccggcccgcgggaaccgagcccggggccgcctcgccggacccatccccctacccagcgcccgcttccctcgcccgagcccttctccgggcctcgggctgctgcgggtgcgggggagccccgagtggaactcggcagacccggcgaccctctgggctcgagctccggcagagtggtttgcacctatcccggagtccggcagcccaagctaggggcagctggagggaggtagaggctgttatttaggttgcaggaggatgtttgagggaagagcgaccacatcctgccctccccgtccccggagcagaagccggacctgctcggtgcttgccgactgcgtgactgctttcccctttgcccaccgtcctgtggggacccgcagcattgataacttggtagtgaaacctagaactggtcattactgctaaatgtctggtttatgctgtttcccttctgcttccctttcccgggccgctgggactgtagttggctaaagaccgccccctcaccctgctgcaggttcattgtttaccttctgcagtggagatgggtttgtttacaccttccgaactggggaaactcgggtgatatttttaatgacctaatcccgttactagccagtgtttcctctatcacttacagtactagagtttattcgacattatctcgttgaagatttagtagttacgtacaagattcttttctcttccacggtaaacaggattgagcctactgattccgacgaagtcatatttcacacgggctgtagcttggagtgtaacccggttcagctgtacagaatcagtttctgaggtctataaaacaccttaggaagtaaacaaaaaaacttgttgtagacattctgtatgagatcagttttttaccctatgtcgtacctgacgtaatgactgttatctacagtaatttgttaaagctgggctccttgttgacaacggctagagtgaaagcatagtgcattttctaatttgttttattttgcttatcacgatgtaagattactgttttataaactgaatggtcagctttcacttagctacaagagtacatttttataacttaatattttattctgaaagttcagggacttagttttgggtgaactaggtccttttacaagacagtttctaaaatataatacaatatagtagagcttaaatcctgaaaatggctactaattagattatcaatgcactaatttccaccatttttttcagcagatcggttttgagaattagtatagaaagatgtaaagcttttgacttctgtgcaactgtttggaaacttgactataacacacatgtgaaaaatctatataaaatagattcactagaaaacttcctaacaaggataacttctacaatttcaggtctgtaaaagatgtaattagtgagtgatttaatttatatacaggcatatgtgttttagatgaaggtgaagggagcccttaataaacttgagtttaacttgtgcattaaaaacctgctcagatgtggtgctggaaatatatagttgtattttaaattgag

SEQ ID NO: 114965 - DNA, 1037 bp, Homo sapiens
atactttgataatcatttatagtgactcacaatcaattccctttaagactttcaaagtcacaaattgaaacaatgctcataatgaattaagccagtctgtatgtgtgaaccagggtgagcagagacatgaagtaagcaacagtaagatttcacctaatgaggttgagacttaaataaaagggcatgatattggggaggaatagaaaggacctagtctatagctagggagtaatggactacgggggttgatggaaggaggtaatgatcaaccgatttatcaagaccaaattcaaatggaaattctgataatcctagtcatcttatgtaattttctcatttgaagtcacaacatggactaacactttctttttttttctttccaaatgtgataggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaagg

SEQ ID NO: 114966 - DNA, 2953 bp, Homo sapiens
aagtttaaatccagtaactctactcaaaccttatattgatatgaaaaggggaggggaacggagggcagaaataatatacaagacttattcttgccttatgcctgtgaaccataggcatacttgtttgtgtatttaactccctttcactatgaatatgaagatcactgaatatgtatctttctttttagatagaggaagccagcaaagcagttgaggtaaaattgcatctttacttcttgttaatcatgtgtgtgacatgcgtaagcccctgttttctacctgcccaaccactctcgccacctcgcttattactatgtgtttatgacttctctgatcatgaaagatgtttagttaaaagatgataccaaaaccattgctgcttagcagactaatagagtggacaaatacattttatagacaaagctcaactaaatccttaaatatttgctatcttttcagaatgggagtgaggccctaatgattctagatgaccaaactaacaaactgaaatcggtatgtattaatatgtgacgtttgacagttcttacttatctgaacatgggttctacttcctgtagatgttgctgataccaaatctgtattgaatctatatgaaaatccaattgagacaactgtttttcaaaatattagtgtaacatctatgtcaatatacaaaagtagtcaaaaaaagattagaaaagtaatctttttagtagccacacctgaatctaatctaatactttttaaggatgtggacaagatagatttgctttgagacatgtctacacttcctgacctaaacagcttaatatgaaatctattagttaaatggaaattaaattgtgacagctactttcctaaactttaggaaacaaatgattacaatatacgaagtaatcttttttagtagacacatctgaatctaatccaaatacttttttaagggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcaggaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaataaataccatcaaaatatatactctctgataaccaaaagaaggctaacagatctaattatgtgctggttaggctttgacatgttcttatctattgactctatagtcataggtcaaaaatagatttatctctacttggtaaagccagcatgtttaaaaatattcaactctttcaacaattgctctgaaatatgtaaa

SEQ ID NO: 114967 - DNA, 1051 bp, Homo sapiens
ggattctacttagacattggtgttccttagcgctagcctttctgttttttgaatttaaaaatttagtactatggcactatgtgaaactgactgaataaataatacttgttcaatagttcaaggcctagaagaaacatctctaaagatcttctagttgagctttaccagtgactattctgaggccaagagaattagagtgacttgtccgagttcgcacagctaactaagggatgccctggttcaacgtcttctatgccgtcttgctgtcccggatgaaaagtgccgaatcctctcatcgatggcagatcaagtcgaaaacaaagctgactgactttgaaaattttaatattaaaaccattgtaggatgtttttaaaaattcaacttctcttgtttttccaccctcatcagggaatggcggcagctggtcggtctcagggacaacacaaacaaaggatctgggtcaacatttccctttctgggataaaaataattgatgagaaaactggggtaagaattcacatttgctgatacctctctgaccacctgagtctgaccaacaatttgctacttgaatttcggctccccttcttcgttctcaaagttctgtggggaacaaatatatcatatattacatctccagaagtaacaggcagaaaacagaataggaggtaaaagtcaagatacttgattttgaatttgtgttctataataaatgtgaatctaagtctgttaagtctgttaataggcttagattcacattatgtctataatatataaatatatatatttttgaaattaaataaatatatataatttatataatatacaaatatacattaaaatataaatacatatataatttataaagtaaaacttctatatatatatatttttttttttttttttgacctcgggtatacagaactagattaattttaacccctagtttgtgacacttttatgtattgcttacatgtgaacttaccggctaacctaaagctagaacctcacccataacacatctacctctttttcatttcttttttccct

SEQ ID NO: 114968 - DNA, 1143 bp, Homo sapiens
gcattaggttttgttgttgttgttacttgattttgttttgtgttgctccctgccccctttacctctaaaattaagcgacttaaatgcaattcatttttgaagtagaaaaaacaagtatgtagctgatagaacaggcttttccatcaattgttggttgctagtaaggagggtcaatattgatttctgcctgggctaaggttcaactatagctgaggcttttcagagagcatacatgtactagaattgaaatgatagacagttatatttaatgtccacgctgtcttctaaaggatagcttgatgcagaaatgcttgcttaactgcctgaaaacctgttctttgtgatttctgatttgtctaactggtctgaagttcccaatgactaaaagttgatagtaattgaaagttgggtgcaaatatttaccttagagggacacatatatgacaagagctgcctataagatagttagagaaaatagtaactactcaactaacatatgattttattgtagttaagtggtacagagtgttgtgtggatccagagggagaaaaaggccattggtgttaatggatttggcttttaaaggaacaatggaagtcaaataagcaaaggtaagaagagaaaatgcattttaggcagcagcgcatatgcaaatcatgcagttggatgaacttaggatatgcctaaagaactctgactggtcagtttggccaagaaacagtacaggtggcatagggctgagaagtgtctgagtttgaaaagtagggatgaattatactgagccatggatgtcaggataagaattttgattttttttttttatttttatactttagattctggggtacatgtggagaacatgcagttttgttacataggtatacatgtgccatggtggtttgctgcatccatcaacccatcacctacattaggtatttctcctaatgctatccctccccttaccccccaaccaggcgccggtgtgtgatgttcccctccctgtgttgatgtgttctcattattcaactcccacttacaaatgagaatatgcggtgtttgccaagcagatccgtcattaaagcaggaaaaccaaatgctgattgggataacttaacctggctctattggcagaatgtgtttga

SEQ ID NO: 114969 - DNA, 1059 bp, Homo sapiens
actatgcagccataaaaaatgatgagttcatgtcctttgtagggacatggatgaaattggaaaccatcattctcagtaaactatcgcaagaacaaaaaaccaaacaccacatattctcactcataggtgggaactgaacaatgagatcacatggacacaggaaggggaatatcacactctggggactgtggtggggtcgggggagtggggagggatagcattgggagatatacctaatgctagatgacacgttagtgggtgcagcgcaccagcatggcacatgtatacatatgtaactaacctgcacaatgtgcacatgtaccctaaaacttaaagtataataataataataattaaaaaagaaaaaaaaaaaaaaaagccgctgatatttgtttagagtttttaggccaaccaatttaaatggatacttaattgaaaagtacaattatttctatggcttggcagaaagcaatcttagagctcattaagaattgaatgtcaaaggagaggtaggtgggcagatcactaaaacacaaattatgaaacagatttccacgaatagttttgcctaattttccctgtacttgctgcattttcttgtttaaagtcattggaatgaagtgctgtgtttctaagtgttacaaaagagtgagaatgataatacattttatcacattgggaattatctttcttaccgatggtatgctgtttgccatgtcctttaaattaagcattgtaataaatagattaaggaagatctttgtacttggaattatagttttgtagagcatgtctgctatgctttgaatgtctcctccaaaactcatgttgaaacttaatctctaatatggcagtattgagaggtggggactttaacaggtgattggatcaggaaggctctgccttaataaatgaattgagtcacacataaattaatggattaatgggttaatagattagtggtttatcatgggagtggaactgtggatttataaaaagaggaggagagacctgagctagcacattaacagactcaacctccttgctatgtgatgctct

SEQ ID NO: 114970 - DNA, 1049 bp, Homo sapiens
tttgaagcacactctttgatcaaaagtaaaactttcattgtcttagtggggctgtttttattttaaaagaaatgaccttcatacattgcaactattggttatagaaatgaagcaattaaagtaatactaaagcagcaacattaaaataattagtaacactaaaacatgaacattaatataattagtcacaatagtgagaatgagtcaaagacttcagcaaaaggcacatacccagtgaatattttattacttaaagtaaacacgtaggtttgttcaaataaataaaagtgaattcctggatatcatagagagacttgagtatcatttttgggaaactcagactaagttataatgcctttggctgtctaaacataatgagaggatagcattcggaactcagtcatgccagaaacaaagtgagacagaaaataaagcaattaccagtacttttattttcagttatagcttcagggtcatcttcgggaaatctgtagcgtcatgcacgagaaggttgtgcagtattcatatgtaatccattcaaaagctccttgaaaggttctaatttgtttcaaagtccctgaacactattgtcaaactcaacgttataatacagtagagaaagatgagattatctccctttgtattagcccactagggctgccataacaaaatacgcagactgggtggcttcaacaacagaggtttgttttatcaccactctggaggttggaagtctaagttcaagggccagcaggttaggtttctcctgaggtcattctcattagtttgcatatagtcgtcttctcttcgggtcctcaagtagacttctctctgtgcatgcacatacctggtatctcctcttcttataaggacatcagttatgttaaattagggcccacccatatgacctcattttctattaattacctcttcaaagtccctatttccaactacagtcacattctaaggtactgggggattagggcttcaacctgggaattctagaagtgggtacaattcaacctgtaaccaccgcacagatattatgt

SEQ ID NO: 114971 - DNA, 1028 bp, Homo sapiens
ctgtactttactatctaaagcatggtcatcgcatcatcacctagaaggttattcgaaatacagaatctcatgcctttcactccaacctactagaacacaaagtgcagttttgaaattccagatgattcatatccacattaaaataaggaaaacattgatttagattactaaatgttagcacctatcctaatttatctcataaggcccaatcctgtttccactgtcatttgcttgtggaatatcttcacctgtatattctaatgaggaccttgaattcaacttgaactaacaattgaactaatcttctttgtttctccaatcgtgaatcattttttcttggtctttatcccgctagtcatatgtctattcatcctggctttatacctcataaagctttttttttctttaaatcctccacacacagtctcaatgtctgtttatattatgcttttccatatctttcatgttttattcctttttatttgtaccactaattcagacataattgcctctcacttaaacttttaagatagcttcttgatagttcgtattgccttctgtcattcatcattttaatttatcatgcatagttgggttagcttaatctccctaacacacatcagtgtcagctggcaaagaagaggttaacctaagagtagtgatctataaaagagacttctcatcttacctgagctcctcacttgaaaatttcactttaattgaattataaactaccaccatcttaatgaccatattaagggaattttcacattttctgatttttttggagatagaaactaagtgatcaaaaaacagtgcagattagcaaaatctaaagcagtcagtttgagaaagccacaataccttttgagagtaaatgtaatcataattattttcactttctattaatttagaaagaggcctgtagctcttcttttcatcatttataattcaactaagaaattggtaacatttctagttgcaagtaagagtattttatgtatttcctcagcaacataatgtaatag

SEQ ID NO: 114972 - DNA, 1047 bp, Homo sapiens
cgcttgtagtctcagctacttgggaggctgaggcaggaggatcacttgagcccagcagtttgaggctgcagtgagctatgatcacaacactgcgctccagactaggcgacagagcaagaccttgtttctaaacaaacagacaaacaaacaaaaaacgtagcattccccagatttatttgatcaagcactctttcatcaataacacccattaacatgaaacagattagaattccttggaacacctggagagaatcttttcaaatacagcaaaggatggtttacttttctgaggagtggttcaaatgcaaacactgaaacttcaatagatacatatttgtcttaatgtgttagaaaaatacacatttcatgtatcattttattaatattgttgcttaggatgaagctaactttatgtaaagaagtatatagatttaaaaaatatataaagtgagtaatagtagagatatatgaatatgacagaattataagctggaaggtgaatgtctgaaggttggaaaacgctgacttagcctataaatataaattcaatacagtgtgcttaaatgggtgcagtcatttggatacatatattcagactggtcttcaggaaacttggggaagaggagtgcttagttagctctctggttctgccttaaaataattttgtgagctaggaagggaagcctgttctagacctcagtttccttgtctataaataaggagagttggattggagcatatgttgaattcagctcaacaactttgatgtaagtggaaggctacagtggtgatatgatctgctcatccaccgcaggctgtcacattgatgacagctgtggcagaacccttcatttcatggcctaccattcattatttggggttcctgattaatcctttctcttttgcaagaccttttctcaaagtagcttaaccagattcctgaattttagctatctttgtatgaccggagcaccatgcacagttccatctccagagaatttcctaagtgacaaatggccaaaagatgagactatctggagggcaagg

SEQ ID NO: 114973 - DNA, 1041 bp, Homo sapiens
tagctttaatatttttgtaactatcttatgattatcttccctagagcaaagacagtatacaaaaatgcaatgtgagtgcaggtcacatatgtataaagtgttcttgagaagcactttattaacttcatttctgtgagtgcttttaagtttttgtaattctaatgaagtaacttttttcccccaaaagctactgatttcttattccagctgtcattttacataatttaaaggaaactcattttataagtcaattaaccatctaatcaccagaataaggccaagattcttttattctagtctagaaagaatatgctgaaaagttttacaccaacagcaggatctcctgttacccagaatgaccagagaatagtttttattttctctatgactctgttccccagttatagtaatcacaacggatgaatgagaatttgctaaatttagaaggaaagacatcacatttcaaatagaggtagctccatgtgcaaagtcatggaagaatgaaatgatatgtcaacatctgggaacttcaaatgattcagcgaatggagcatgaatttgtgtaaacttacatgatcattttaatccttaggggaaaatgcatttgttaaatgtacatgtatatatatttttgagacagggtctcactctgtcgcccaggctggagtgcagtggtgtaatcattgctcactgcagccttgaccccctaggctccagcaatcctcctgctgtagcctcctgagtagctgggactacaggtgtgtgccatcatgcctggctaactgttattatttttgtagagatgaggtctttctatgttgcccaggctggtctctaactcttgagctcaagtgatctgcccgctgcagtctcccaaagtgctaaaattacaggagtgagccaccatgttcagcctcaaatttactcttaaagtattatgatttttttttgcctagatattacttctaattccactgggatcatttatataaaaatctcatctgtaattaatatagaaatagtagtagtggtaattcacat

SEQ ID NO: 114974 - DNA, 1074 bp, Homo sapiens
ggttaggctggttttgaactcctgacctcaggtgatccgcctgcctcggccttccaaagtgctgggattacaggcgtgagccactgtgcctggcctttctttttctttctttctttctttctttctttctttctttctttctttctttctttctttctttctttctttcttttcttctttctttttctttctttctttcttttctttctttcttaatttttcttcctttctttcttttctttctttctctttctttccttccttccttcctttctttcttttttctttcctttctttcttttctctttctttccttccttccttcctttctttcttttctttctttccttccttcctttctttccttctttgttttctctttctttctctctttctttccctttctctttctctctttctctctctctctttctttctctctttctctctttccttctttcttaccatggggacatcacagagacttccctcctgcctcagtatggtttcactgtgctcttgccctattgcagagctgttgccttgagttcttgttcattgttcttggaattctttttgctcctcctttgtattaaatcctgtttcaccccttctcaagaaagagaaatacttacctaattgttcagattttagtgtgtagagttgctgtggttaaacgttcttaggaaaagtgactggtgttctcttctgtccttctcttccatggtgggaaatggggttgatggcctggcaaggtaaagggaatggataaatgattgaatggtagagatgttgatagaaggaccaaagacccagctatctttctctcttcctttctgccaaggtacttccagtttggggctaaagcaccagctgtagcccagagaaaccccacagtaagcaatgggaccaaatgctctctcttgttgtaagcgtcttgtttttttgggttctatttctcatgtgtctggatgacaatcttgagatcataattgcagcatcttagattcaggcttggatgtaacgggagaagggcatgaggtgggggcagtattggaagaaaccaaacatggt

SEQ ID NO: 114975 - DNA, 1965 bp, Homo sapiens
gaaaattaacaatcatttcttttaatttccttgaatcagagccattctaaagtgactctggaccagcaattctgagctatgatttcatgatacatgtattaatatctaaatgagttgtgagttgacataagaaccatagttccataataattatcttcaaatcaatggatatcttaaatgtgtttttttcttccttagagattattattaaactgatgtatttgataataaagaattttaggactgagaaagttaagtttttcttaccaataataagatattgaaatatataaattataaaacagaaataaaatgaaataaaggaggttatccctaaagtcatttaccttagtcacttgcaattaaatatggttacttcggaagaagaagtgtggccctaaagctactgtaacatgaatcatgccctaatgtgcactatatatgaactactttggtcagaaggcagcggcgggtaaggatggcttcctctcacagtgcttcttaggctatccatttaccaaggaattctaatctctttctctcacttcaccaggaaaggagggagtttaagatatagaactgggcatgctagcctcttttttcccttttgtggatttgtcataactgcagagaaccgatgttgtggtctcttgccagctacattgtgaaccttgcagtgaaagttctttgcctctgcaaagggagatttgtgcttgtgcagaactgcccatgccttagtaagcaggtctgtctaattctaagttcaatatctggtggctattgttggcataaacttaaagtacatcctctaacctagcctttttcagcagtaaacttaaaatattgaatctccatctgtctgtgtctcaagtggttcagaggtcaggagaggagagggacattattttatgactccctcaaactttaacaaagactagtgcagattatatttcgaagtaagcatgagatatattaaaaaccacatgtgggaattctttcctaattttagaggttttttttaaataatggaaattctattgaaattgagtagtgttaattacaaggcaacaggtaaacatttgttcaggatatttaaaaggtctgctgagttggaattgtgacagaccacattgttgactctagattgaattggaagggaagaatgtgaaatgaattaggatatcctctgttcacctctattaactttcttaaatgagtataacttagaaataataaaatgcaagtattttaacgttatagttgggagagttttgacaaatgtaaacacccacttcaccaccactaccatcctgatatagtgtgtgtccatcacccaaaaagttctctaaagcccttttgcagttggttcccctccacctgaacagccatccctagtcaactacttttctgctttctgtggctatacgttagatttgacttcagaattctagagtttgaaataaataggccatataatatgcactctttttgtgtctgactttttttttgcttaacatgatgcttttgaaacccatccatgttgagattcatccatgttatcatgtgtatcaataataagttcctttttattgctgaatagtattctagtatatagatataccacaatttgtttagctgttcacctattgatggacatttaggttgtttcaagttttgatctattatgaataaagctgctatatatataaatcacaattctatgtgtggacatatgtgttcatttctcttatgtaaatacctagggatggaattgctgagtcttatgaccagtttatgcacaactttaaaggaaactgccaaacttttccaaattatctgtaccatttgggatttctgctagcaatgtattaaattaatttcagtttctccatatccttgtcaatgattgatattgtcagtcttttaaattttagacactttagtggatatgtagtagtatttcat

SEQ ID NO: 114976 - DNA, 1476 bp, Homo sapiens
aacgctccaggagcagcagaaggtagcacagaggattaaaaaaagtgaagcaccagctgaagtaacacacttttcaccaaagtcaattccagactatgactttgaaagtgatgagattgttgctgtttgtgcagctattgctgagaaagagaagacagtttcagcaaataaaacaatggttattgtgtctgcttctggggccatagagactgtaactgaaaaggaggatggtgctacaccaccagatggctctgtttttatcaaagcccgatgaagcagtatgcataggattatttgaatctgtctttttgattgcctcttgaagttttgacatagagacatttactctggagatagataggagaacgcctggttgtaaaatatgtttttcagatgaggcatataaaaactaaaatggcaggattattgtatagtgtttggaatatgctttgataagttatgatttatatttctcaaggttaaaattctgagtaaaatggtctttgattaataaacttagtttaatctgaatatgtaaatgaatacattttaaagacaaaacttgaaaaatgtattcttgaatagtgaataatttgatcaatgttactgaaatgctgtctcaacttttgttttatgataaaggaagtgtgtgatttccctccctctgagaaatatactgcgcttaatatttgctgtctttttcttgcttcattagagtaagtctgtcagaaagcttgaatatttttgacattcattttgattcaaagttgtcatttggttatatgtggaatctttgaaagtttggctgaaaatgcacacaaatgtgtacattctgaacattttctgaagtttctcttaattctgatttgtgtttctgttttgactttgaagttgtaacaatgatagttgtctccttcagtatttggtaaaagtgtaaagtattgataaatatgagaatgatggttttattttttaattgttacagtaagtaatccttaccacaaatgagtcatttttaaaatatgcatttttaaatgaatggcttttacagataggttaatgacaattgtactgctatattatcccagtcaaaaccaatactttcttttctttattttacaaagctttaaaaaccctggaaacaacttacttcttgcttgtgtctttccatttgatgactgggaattacttttctagataactttttttgaaactactcagtgaaatgaaaaataattacaattttaaatagctaattatatctttctaaaaataaaaaagtagggctgttattagagtgccaatgaataaataacttaagcacaaaatacatagaaattggaatgtgatttatagtacaatctcatgagtatgaaaaggctatattaaaaaaaattttattgaaagtccacagtcatattcacaaaccaatactgtcattgctaatctgaactattatttttatactatatattg

SEQ ID NO: 114977 - DNA, 1119 bp, Homo sapiens
actggaggaggtcttcatgaagaacggagcattttaacttggtcttagaggaggagcctttgaatagatgaagaggagtaggaaggcaatcttagatatgtgatatggtttggctctgtgtccccacccaaatctcaccttgaattgtaataatccccgtgtcaaggatgggaccaggtggagataattgaattatggcggcagtttctgccatgctggtctcatgacactgagttctcacgagatcttatggatttataaggggcttccctgtttgctcagcgctcatttctctctcgtgcctccatgtgaagaaggatgtgtttgcttccccttctgccatccttgtaagtttcctgaggcctccccagccctgtggtactgagtcaattaaacctctttcctttataaatttcctagtcttgggcagttctttattgcagcgtgagagtgaactaatacagatgtgtgtgtgtgtatgtgtagcaggggatccatactaacaaaggcatgatatgtgggtagggactataaaaaccctgctgagtggagcacaggtatgtgtagggagtggtagaaaaaagattggacaaacagtccaaccttttccttctaatgctggaggaaagacatttgctactattaagtcttgcagaatttattactgctacctttgttagaaaattgtgagtggaaggattgttatgaaggaatacatcaataaattaatttccaaagtttttcctgtcacatctacaataacatttggaaatattgtttagagaggcttgaaatcacccacaatatgcctaaagaagtgcaagtactttctttttaggtgatatagttactgcttttagaggttatatcattaaagcttagtagatgatggcaccacagtactaaatttatttaatgttgtatatacttttattattattataaataatcagaaatgggtgttaaattatactaagtattgtttagtggcatgtacttttttctcccttatctgttacatatgaacccatttctaagtttttctgagcatacactacatgatcatgtggattttgtactttagtaagttgctggacttaatttgctaatcctttattt

SEQ ID NO: 114978 - DNA, 1083 bp, Homo sapiens
ggattaaagagcaaagtccatgtaaaagcatgctacctagcacctaataagcaccaagtgaatgtactttagatataatattttaggattttatatgttcttggtatatttcctgtagtagtaatatatatttttgtaaattattttgttcaagtggctttttctagaattattacaaactaggttataccttctcaagagtcacggtgttagtcccaactttgacatcttggcttttaaagtttcagccactagatggtgatatttgactgtctagctaactggtctgatttttctgttagaatcagttgtatgtgtatgaagcaggaatataaattagaatttaccatgcattttgttcttgtctaggaaagtatacctactaatgtaaatttgagggtgatcttgctgtgtgacccacattctgcagattactcacatcagtatatttaatgacagtggttttgcctcatgctctgtggaaaaacatagatacagtcagtgtagaatgactttattttctcaccagcacatcttccaaccttactgtatttgtgcctatatgatctgtcatcattccattgtaattatcaaaggcccaccactccacttgtactctagaccccatccccttgtgccttctcaggaacgttgttctgaaattgtcctctcatttttatataatctgtttcttcttttctctcggtccttcttgctggcatgcaaacataccctgataacatccatttaaaaagcttctctccaaatgctctgccatttctctgctcccactgcactacaaactccatttcttgatgaaccatccagtcatatttctgtccccatgaatccactgaaactgcttttgtaaaggttatcagtgacctccatgttgtcaaatccagtcatcacttctctgttgtcatttattgtgcttctcatcattcagcacaggtgaccacagtcttcctaaatacactgctctctcatcttccacaccaccatgctatcatgcttgtccttgtctccatgtcctctcctttttaatctttgcttgctcctttccttttgctctccagatca

SEQ ID NO: 114979 - DNA, 1056 bp, Homo sapiens
acctgaggcaatagtggcgtggttttttcacatatggttgagagccaccaccttgggccataacttatacttgtccccagcatttataacagtggtttgggttggaagatggggagggtaattggaatctgaatgacctattaattttaaaagatgtgtgggtctgtttctcactttttcctttccttcccaccctatcacagcccctcatgtaatctacagatctgatcaacggtttttttttttacttttttttcttttgatcaatgatttttattgtagtttacctccagtaaacacactaggtgtcctttagtatgagtagggttcccacagtgcctggtgcctcaccttatgaataaagaaagtttcatttggaatcttgaaaccggaaaacgtggtcatcattcttgttaccattagggataatcataaatacaagacttctttttatcttgtcttacactgatatcttgtgagtctttcctaatgatctgtattttctcaggttgtcctcactgtgtgccttttaacttctgttccatagtatccacacttctgttttcagccatcttcccctacaatactcatagtcatcttcaaacatgggaaactcattctcctataatatgatcggcctggggagagagtttgcattgtccttattccccagcacagtttataatccattagtcctccaggttttaaaaaaaatctcagttcctgtggaaagtttgtggttcacttatattatcagcctgtatatttctttctttctttctttctttctttttttttttgagatggagttttgctcgtgtcgctcaggctggagtgcaatggtgcaatctcggctcactgcaacttctacctcctaagttcaagcgattctcctgccttagcctcccaagtagctgggattacaggcatgtgccaccatgcccaggtactttttgtatttttgtagagacggggtttcaccatgttggccaggcttgtcttgaactcctgacctcaggtgatccgcctgcctctgcctcccaaagtgctgggatt

SEQ ID NO: 114980 - DNA, 2078 bp, Homo sapiens
aaagtggtgggattacaggcgtgagccaccgcacccggcctccatatcccccttttaaaattctgtagtgtatggtaagtcatatcagatatcagacctaatttaaatttcattttagctttacaagtccaaaaacacagaatttatatattcagatactctagcactaattttagtcttaaaatattcccacgatattctgtacacaaaatgttctttttgttacaagagctgagttgcatatactgtagataaatcatattatttttgccaatttcacaaattcctctggcccatcatgtcagtcattattgagtatatgcacacattgctacttatttgattatgtatcttttaaattgattcagtgcatagaaaactatctcttacaaactttaagtgctctgatatgacttcccccccaaattttattatgaacatttttaaaaacagaaaaattgaaaaactgtttggtaagcacatgtatatctaccatttagattcagcagttgttaatgttttgtcatttgttttctctatacctatatatgtatagatacagctagttatgcatatatatgcatatatgtgtttgtttgtgtatgtatatatgcttttttccccctgaaccatttggatgttacagacatacttatcaccgtgaaaatacttcaagtatctcctacagataatgacattctcctaaaaatccgtaataccattgtaaaagtaataattccccaatatcatctaatcaagccatatttaaatttctgaagttaactccaaatttctttatagctgattatttcaaactaggatccaattaaagtttacatatgacacttggttataactctttagttggatataacattattattattttgataaaatatggaacaaatcaattctattaataagtggtcacatttgttttgggcttaaattactttttaaagatactggattttcctaagatttctgatttacactgatatttttttttgtcattcttaattgcatcacacaatagatgtaaatgaagatgtagtcacctcagataaaattggtatcgtgtatgataatattgtatcatttatatttgccttatgttaactttaagaaattgatttttttgtattaatcattttcccattgcaacagagctatattttttctattttaagaatcatattttaggattatttttggcaaatacagtgagcacttatgtaaccagatgataatgaactcaaatgtcatgatagcttgcataaatggtgactctagtagatttgactcaagcacttctagaatcatgcactgaattcaaaagaaaaatcttgctgctttttgtccagggcttgttctattcaacttctaatttgaaagctgtacaaagtaatagaagttccatttaaatatgagttcaaaactgtatttactttttatgtggccctctctttaggggattctaattttacttagggtctctaagtgcagcataatgttcctgatgttaacagaagactgtatttttaaagttacaaatttgtatatggaattaagtaatggcgctatatacgctgttgtggggaggggggaagaaaaggaggaaccaattaaataggaccttttaaaaattgttaattttgtaaactttgcttctcttataagttattgtgattcattttagttactgtgttttattttgaaaatatttaaatattgcacttctataaatagtatgataaatgcacagacaattgcagtaaattcttttttaagctaggatatttgaaatgacaacctttggttaagtgtgtcaaggttgcaacagaattttcacaatttttttgttgtttgcaaattgttactaatattgaagaggtaagggaggcaatgcaaatgatttttaatctttttttattatcttttcagcagtttatattttttgtgactttatgcaaccatatttttactttgtcttgacaactgaaagatgtataaggttttttgccagaaatgtactgtatacatagttttaagtataacagattttactgatatgtaaa

SEQ ID NO: 114981 - DNA, 1224 bp, Homo sapiens
tataccaattgaatgcccattttgtttttgtactgtgttcccaaccttagtttttcttcgatttttattcattggaattgttgctcttttatgaaatactaaatgaaatatgaagggaaagtggaaagtaaaaagcactgagctgagacttaggagagttgggttctagacttacctttctgttcatttgttaccttgggcaagtcatttctctgggtttgttttcttatcaataaagtgaggggctggatgagatggtttccagtataccctccaaattttaagtgcatcgattctatgattttaatatagagggattactttttattgctatagaataatatttattaatccctagattgttggtttactgggctcttaaccttggattgcaactgatgagtagctatactgtacccaactttggttagctatcttgagaatacatactatatgtaaaaaagatgaatagtttaatacaggctcattgactgttttagaaggtatttagaataagcgtgctcttgatagctggccagcagccccacttaaagaagcaaattcaatactgttacaaaaatttttgggagaaggtcatagactataataaattgaaattctttttacccagatgaaattacagaagccaaatcagggactgctactccacagagatcgggatcagttagcaactatcgatcttgccaaaggagtgattcagatgctgaggctcaaggaaaatcctcagaagtttctcttacctcatctgtgacctcacttgactcttctcctgttgacctaactccaagacctggaagtcacacaatagaattttttgagatgtgtgcaaatctaattaaaattcttgcacaataaacagaaaactttgcttatttcttttgcagcaataagcatgcataataagtcacagccaaatgcttccatttgtaatcaagttatacataattataaccgagggctggcgttttggaatgcaatttgcacagggattggaacatgatttatagttaaaagcctaatatgcagaaatgaattaagatcattttgttgttcattgtgcagtatgtatatagcataatatacacagtgaattataggtctcaggcttacttgatttttggctattttatatttagtgtacacagggctttgaaatattaatttacataaaggccttcatatattattacgtgttatatatta

SEQ ID NO: 114982 - DNA, 1437 bp, Homo sapiens
tcatataattgtttcgatgatgaggggagatagtgtatatgaagtgtttagcataaaacttagcatatagtaagtactcagtagttgtctactatttttcttgttgttacattatcttcacttaacattatatcaaaagagtattataatgaagctacctaatatgttctctttctaagctggaaataagctgttcttttcattgtttgtcgctgtcatttgtcccataacttttttccccccattgctgtgtcaatacattctccctcttaaaactggagggaaattggagcatttccctcaacatacacaatgaagtgcgagctagaagaggaaaatttcagtgcaaaaagtgacaataatacagtatgaatataaatataaattaagtcatattctaaattccctaaactgttactttcagtctcagctctattcaaagtccttctcctgatcctgccatttttctctcagggaacatgaatggtttaaacaggaccttccaaaatatctctttcctgaggatccatcatatagttcaaccatgattgatgatgaagccttaaaagaagtatgtgaaaagtttgagtgctcagaagaggaagttctcagctgtctttacaacagaaatcaccaggatcctttggcagttgcctaccatctcataatagataacaggagaataatgaatgaagccaaagatttctatttggcgacaagcccacctgattcttttcttgatgatcatcacctgactcggccccatcctgaaagagtaccattcttggttgctgaaacaccaagggcacgccatacccttgatgaattaaatccacagaaatccaaacaccaaggtgtaaggaaagcaaaatggcatttaggaattagaagtcaaagtcgaccaaatgatattatggcagaagtatgtagagcaatcaaacaattggattatgaatggaaggtaagaaagaaataacattttgattattagcatatttggcaaacccatagtctataaaatgttttatagaagaattacttttgacttggtttttgttataccatgtgctaggttgtaaacccatattatttgcgtgtacgaaggaagaatcctgtgacaagcacttactccaaaatgagtctacagttataccaagtggatagtagaacttatctactggatttccgtagtattgatggtatgtacatcacacaaaacaacatagattagaccttgttactaacttggtattttacgccttgattcttttgaggcttcttgacttgttcctagtaattcaactgcaaaggaataaaaaatgtgatttcttgtgcctttgcaatattaacatttatgaatcttatttttcttgtaatcttatagcatattgtccttttaagattatcatcttgtaaaatccttaaagccaggtgtag

SEQ ID NO: 114983 - DNA, 1454 bp, Homo sapiens
gtgttttgtttttttttaaaatagtaattggctaaattatttgaatttcttattcctcagttgattatttttatagggtgcatttttgagggagcaacagtttctttttggagtaaaactgtgagggaactttgaaattcaaaattactgtttttttttttttttttttttttaaagaatcagaacaggcttaataggaactttgaattttaatccttctattcatctgttatagattattttccctagtgatttctgtattaataaaacttaaacatggcaagttttttctaataagcaaaataaccaacagcttaatatatttgtattaaactctaacagtgcactaactttaaatgttgaaatagattacacattttagggcataatggcagaatatttggctacaatagaccataggattttgttgaagcaaataacaaaatgatgatttatcattttaatgcaaactcaattttattgtttaatgggattttaatttttgtctttgggaaatcttttgagtagctgattttgtgcactttcaggtctttcaaacatgatgtcagatggtgaatttttaagaacaagttgtggctcacccaactatgctgcaccagaagtaatttcaggaaggtagtatttgataccctgcctccctcaatacatttgaaattgtctttttctcctagattttgttagtctatagtgtcatatttaattctaatgaaaggaaagaaagataaggcttattcttaaccacatttatatgtgaatgagggttaaggactacaagtcaacattatattaaagttgttagaagagagtacattaatttttttcccaggtggaagaaatggaaagtttaaaactagggtgtttaaaaagtaggtaagacactggaaacttgaataatacagaaatatctagtagttagaaaaggattactatttacttagaggaaaaattaaacatgtaatgtgtagctttaattttttacatagatggcattttgtagtacctttatgtttcatgataaaatgtcttggggaactgggctgaagtaatctttagacttcatttatgttgaatctttgttctttaaaccttttagagactgcaatattataagaattttaacctctcaatttactaactaccagcattgagaacatgaagatatttgtacagtgtcgctttttgaatagtttggaaaacaggagaatttaatatttttaagaataactctttgtccttcactatactactgaaattgaaaacagaagctgaagtttgctagatttataatgaacttttaataacttttcacccaaaccatgcttatttgtgtgaatgttttgcatcttgattaactcaatgcagaaatactgtagtattttctatttttataagcttgttggcctagactgctcaaagaaatgagatttgtgtaa

SEQ ID NO: 114984 - DNA, 1050 bp, Homo sapiens
gtgcagtggtgtgatctcggctcactgcaacctccgcctcctgggttcaagcgattctcctgcctcagcctcccgagtagctgggattacagctgtgtaccagcacgcctcgccaattttttgtatttttagtagaaacggggtttcaccatgttagccgggctggtctcgaactcctgatctcaggtgatctgcccgcctcggcctcccaaagtgctgggattacaggcatgagccaccgctcccggccattaatttttgtattttttagtagagatggggttttgccatgttggccagattggtttcgaactcctgacctcaagtgatctactcgcctcggcctcccaaagtgctgggattacaggcatgagccactgcaccgggccagaatatgtgtaaatatattattaatcatacttagtactaatttattaaattacttcttttacagttggcaaacatgaattgactgggcataaagtagctgtgaagatactcaatcgacagaagattcggagccttgatgtggtaggaaaaatccgcagagaaattcagaacctcaagcttttcaggcatcctcatataattaaactgtaagctctgtttatattaaatatagtccagtcatcttttcatcttttttgttaacctacttaatgtgacaagtgagaaaaatgactgacacttctttttgtttcctaagggttttgaaaagtttcttcctaggctgtgtgcggtggctcacacctgtaattccagtactttgggaggctgaggcaggcggatcacctgaggtcaggagttcgagaccagcctggccaacatggtgaaaccctgtctccagtaaaaatacaaaaattagctgggcatggtggtgggcgcctgtaataccagctactcgggaggctaaggcaggagaatggcttgaacctgggaggcggaggttgcagtgagctgagatcgtgccattgcactccagcttgggcaacaaaagcgaaactctgtcccaaaaaaaaataaaagtttcttcccattcatgtatttttc

SEQ ID NO: 114985 - DNA, 1030 bp, Homo sapiens
cagatgttgcctccagatagtatttattactttattagtacagttcatttccacttattttcaaaggttatttgtattctaataaactctttaagtgcacatcattcgaacttttgttttaagaaaggtgtattgggtgcattgtacagcattcgggtgacgggtacactaaaagcccagacttcaccactatgcagttcatctatgtaaccaaaagccacttgtacccctaaagctattgaaattaaaagaaaagtgtggactctttcaaaacactattctggaaataaacttgctctacagtccaccaattctggcaaaaaaacgtttaattgcaagttttgtaaggcatgattttttttttctttaacatatttgactttgttataagggatgcagagaaaggaagtttggaactgataaaaataattcatgcattggctttggataaataatagactgacttgcatatactaagttcttggtaaatatttgacttgaaagaaaaaaagtttgccaaagtctgtacggtaactcaactgagccttactcttccagagctaaataaacagtttctgattttatttagggttagaagagaagaacgcttccttctcttgccattttctgagtcatagaattggaaaattgttgtatatcccacagggaagcaactgcctgaaccttcttatgaaaatctgcaaggcggacaatgtcaggaggaagtaagaagcaaatgccagaattgggtaataacagctattaggacaggtccatataaggccagtaagatgtttctgtgccatggaagttttaactttatctttggctatgatatttcttgttagcaattacaaactgctttttagtttacaagtgtttgtaaaaaaaaaaatgttcatttttgcccccatcccttcccagagttctgcctggattagggtgttcatcattcccctaatatagacttgaatgcttgaataaagtcaggtctatttttttttcttttttcttttttcttttcccgaga

SEQ ID NO: 114986 - DNA, 1513 bp, Homo sapiens
tttaattggtgtcaaaatttgtcaagacagtagtgaataaggtctggagtcaggcttggttcaacctttagtatagtggctgtgggcaagagtgctgtagaaaattgccctggttgctgctgttgccttgggctcttgttactcaagtcttggccttagagttataaatgcagaatctcagctccgccgtagacttagctgagagaacctgcatattaaagagtagtttctaagagattaacccatctaagatctcagctaagattcagaatgatgcagacttaactataaagctggtgctccttccgttactatgttctatttcagcaattctcagctattgatactttgggctggataattctttgtggtgggattgtccagtgcaaaattgaatattttgcagaatccctagcctctacccactcagtctccggagtgtccagttttaaagatagcaagacagttcagggctttgtagacacccataggtgtgttcatgtgctgaagcaactttctttgcatttagggtcataacgtttttgtgggcttaatgttgagtggtctgttagtacaatataggagttaagagcttgaactgaagccaggcttttaaaagtaggatagttgacctttcttagagtagatacttcttagagtagatacagatgttaaataagttaaaatgcaaagctcttggtttagaaaatgtctgccattaaacatgctaattgttttttccttgcttagtgaaagtagttgggatctattctcagtatagggaaccattttcacaaataatctgtgatctcttgccaaatatgaacaaacatactggcccaatgactagtatagccaaataagtttttgagcctttattgcagttgcagttaactatatccgaaaatgggtatctttaagcaaagtgaagaatttcagcttatcagtgatgttgtaaaaataaatgtctgaacatatgaatgcagtattgatttcagcatttaactgagataagcgcattgaaatctgtttaacaaaaattaaaatgtatgcatcgatgttgctgaagtaacttgttcttgtttttgacatcctgcaggcatggattccgtgaaggaacaacacctaaacccaagagggcagctgttgcagcatccagttcatcttaagaatgtcaacgattagtcatgcaataaatgttctggttttaaaaaatacatatctggttttggtaaggtatttttaatcaattaggcttgtagtatcagtgaaatactgtaggtttagggactgggctagcttcatatcagatttacttgttaagtgactgttttggaatgtttacttttggactgggtttgtaacacggttaaaggcaatgagaaacaagcagaattccaggagtccttgaagcagagggcactggaagacaatatagcagattaaaatagcacagctcatgtggcataggtgggtattttagatgtttgagtaaatttgaaagagtatgatg

SEQ ID NO: 114987 - DNA, 1652 bp, Homo sapiens
ctcctaaaagggattatcccaggcgcacacggtcattacacgccggggacgctcagtcggtgcgggtacccctgggcagggccagccccgcattccaggttctccatgtgcctagaagacagtaatcgacggtatagcaacagatctgactgctaacgtgcgaaaccgatcagtagtagcagtagcaccagcaacagcagcacgaaaagcaaaactgtaatctaaacggccctcagggtctaagcaggcccgacgaagactcgcccatccggtcgccagaaaactgggagtcccgcccgcctttccggcactgaaacgcgatcggccctgcctggtaccgcatcctcctcttgaccccacctacactacgacgacggacgctcgagaacgctgcaccgcgccccgcaggaagtgcttccctgggcggaagcttctgagcgtgatatagcggaagtgccttctcttccggtctttctggtctcggccgcagaagcgagatggtgagttgtgactgtggtgtttgtgaatcgcgttccatcctcgtcctttgtgcctctctgtttgctgtgcttggggggctggcaagattccggataaggggaactggtgggctggaaagaggcatgcggtggccctcaagagccagaagaatgactgctaactggtgcctgggggacctatcccgccgtaattgtggtgctagagccgcattgtgtcctttgcctcggtccaacctttggagacctttcacggctctagccttggttgggagccgagggaaggagtttgggaatgtttggctctgtgtaacaatgaaataattcattggtgatgctctctggccggagtctgtaaagataaggtgcatttcagaacattgcaactcttgcggagggttttaggtaacgtgaaatgcgggtagtggtctctgacttggcattcgtggaaagaggcttctcccgcagtttcgatctttacgattgcctttaaattttatcagtaattggtttcccggagaactcgagtaaatctagaagttgccaggtttcagaactatttattcctttaatgtgcagacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtgtaagtaacatttttcaggccaactgtgttagcttttgtttgtattgcacttaagtgggggcataggtttgaactttatttggtgcctatcttaaaactcgtacatctgtatgccgatgaggtggcataaaactcgtgtgttaacaacacctacaaggtgtgtgggagaacaccgtttgaaatcttttctgaacttatgttttagataactggagtgccaaggctaaaagacgaaataccaccggaactggtcgaatgaggcacctaaaaattgtataccgcagattcaggtacagtttgtatgttcgatcataattggtccagtgggcttgaatgaaaccctcgtgtttacttgtaaaaagataacagtaccctgatggttactggggatgagatgttggaagctttttatttattgttgtttttgaggcagggtttca

SEQ ID NO: 114988 - DNA, 1821 bp, Homo sapiens
ataatttgatttttttttcctcttttaccaggtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgagaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaaaatgacccttcttagaatgtgcaagttccatgagagtaatatattgatatgattttgaaaagaattgttgatagttacatcttcaaacttatcattccagtatgcatctttaagataatgtgattctaagtagatgactttatattcttgattgaagagtgctatacatgttaagaaatgcattaaggaatacaataaatattctaaagtgatgtagatcagtgtgactgtcctttatttcacttgggaatggcattgctaaatgtgggaataatgcaacagattgtcagggtagctaac

SEQ ID NO: 114989 - DNA, 1035 bp, Homo sapiens
ttgtatttaggccattttctacataatcctctgtcagacttcatataggaacttaatttcctcgcaggttttagaaatattaattatggattgtattaaaaacagtaccagctaacattcattaagcactaagtgctggacccttgcatttcatgtagaacttatctaatctttcaaggtagggtggatggagaagcatgggcatgtggctcttacagagacagtggggggcatggccaggttttacacacaggtcctttggctctagcccatgcacttaaccactatgctatagtgtgtatgcagagaatggtctagaaaaaggtctccattggtagggcacagccaattctgtcagttgaaatccttgattcctcctaaaatgaagttgattgttcattaaaatccaagtggctgctctcatgccagatgtagatcttgctcaaataatgagaactaagtaagagctccttgcagaaaatgttcttcagtggctggcagatagttcagtttgtttgaagtcaggcccagaattcattgtgacatgccttgatttatattaaatgtaaggagacctgacaactgtagaagttcgaatatttgtcattaatttcagctgtttaattaatttagcttctgtgtcgtgcagaatttgaaattttaaaagaaaaataattagaagtgaagtgaaaatgaagctttatttctgcaactataaattttcatatacagtaagatctggaaacatatgaattgttttaaaaggtgttatgtcaacttacttcatatgtatttagcaccagttttgtctgaactaaagtaatagtttttttaaaaatctatccaagattcccaatttacctctgtttctcttcccattcattcttacatgcctttattcaaaaactactgaatgtcttttattccctgaactggcttaagtacattaaagccccttaattactagtgcattgctgagttggcaggctatcacaaggaatgaaatcttaatggagtccacctatctgaaattca

SEQ ID NO: 114990 - DNA, 1051 bp, Homo sapiens
ctgattttaaaagttgatattgaatgctttcttcatcttctttgccttctcttcatcctcctttattctttatcattcttagttttaaaatctacctcttctcactttgagacctgctaatctgagtggaaatgacagttcatttgccctctttttgtttagtgatgcagcattatgttaaagcacggaactagaagattcacatcccacctgcttcccctgggaaagtttggttacagagaaatgtatgccacaaaatgattttgttgtgaaaacagctataaatatgtgttatcataaattgagtaaacagtgggaggtgagcagtggtgcataaatatggaataatagaaatggtaccagcacaggtgacttctgagaatgccttgcaaagcatccaaaatacttcatttcagaggcaagaggatgccaagcatgcaaatcaaatccaaatcttttctggaaaataatgtctatttggaaaaaactctttcagactttctttttgttgtgaaccttaatattgacacacgaaggcactgaagttcaacttattttagtttatttttgtgtatttgttttcaaaacattaggcctatattttgcaaattcttttcttccacccaagtcctttctttctcctcagctggaatttctgatagaggaaaataaatgatgccaccaacttcagactagaaatatcttattaaagctttccacagaagaaagatcatattttttacttctttccttctctcagtggggaaattagcactgagttttaaaacagaattggaatgaggtatttttccgtagatagtttcatttcaacaaaccaataaaacaatgtacttatgattaaaataatagtaatgaattattcacagtaaacagttaacctttgaaaaataatcaacagtttctcttctcacacattttacttgtggctctcgaatatgtagctgctactattttgttcacctggactcatggttactggcccagctcaagggaagacagggaacctgctatttcttttttgcatcttttg

SEQ ID NO: 114991 - DNA, 1031 bp, Homo sapiens
aacccacatcctctttgaggaatcagaaaataaactttctgagaacaagtatttcctgatgacaaaataaatagtaataattccatattccatgtgaacgagttgttgaggagattaatatattttagtacatgcagacacataaatgatgtttttccatttgtattttagtttcctattttgtaatgactattggagacctcctaaaagtataaacctttaaaaaattatgtgatagtaattgtgaccatttaaacctcaccattagaacataggttgaaccaaccatatgaaattcctgtatttgcaggtcatacatgctcctatgtgagcaatttcatatgattctaatgcatttctctcagcgattcagtggaaggaagaaaataacttatccctggatttttaaatatgtaatttattctgtttctgggtagtatacaggcccagaagctccagtgcttagctatattcaataaactcaaataacttagagtacctttttatttatcctgaaacacttggtcatgctctttccatcaatgccttctgtaagaggcctgataaaacaagctgaattcacttagccatattgtctgatgtttgttttcatctctgtagtattatgaatagactctatgaaaactgcaactgcagcttcagaacagagctaggagtacgtttttctcttgctgtccattttcaaaatctaacaaatagatcagagtgttagtctatgtgaccttatacaaagagcttaaccaatccaaagtgccttaataacaacaaaaaaaactttgtcacacattgattgtaccttgagaagagaaaatacattggtttcatagttctaactgttcacttaataaatacttattaatttcttatacagagatggagttaattaccttgtataattaatgacaattttgtatgcattggaattttttcttggagcaatgaggtttcataagtgaactatggagaccctcttgaatggtatttacattttacaaaatgagagaaattgg

SEQ ID NO: 114992 - DNA, 1115 bp, Homo sapiens
agggaatggggatggcgagaggctggagaggtatggacaatagaggggtgcatttcctgtagaacaggggtccctaacccctgggctgtggaccagtaccggtccatggcctgttaggaaccaggctgcacagcaggaggtgagcagcaggcgagcaaacgagcattaccatctaagcttggccttctctcaaatcatcagcagcattagattctgatagaagcccgactgaacccattgtaaactgtgcatatgagggatctaggttgcccgttccttatgataacctaatgcttgataagctgatgtggaacaacagttttatcctgaaaccatccccatcccccagtctgtggaaaaattgtcttccataaaaccggtctgaggtaccaaaaaggggactgctgctgtagagaatttccaaacaataagaaaactaaaagtggtctgcttttcattatcatcatgcaaaggcaagagcaatgtcagtgacaaaatgctttccaccacaaaaggttcctactgtgtccccccacctgctatgtcactgcattttggtaaagggagcttaagttcttttgggaatggagaagatgtggacctctgttcaccatgatactcttagaaatctaatagccttttctttcttttgtgtgtgtgtgtgtttaggcaaggaaacagttactattcttccaggagcctcttttttctccagcgatgaatcatttgcaatgattagagggtatgtaataacagagcccctcatgtttcagacagtatggaatgagctgagtcatcgtctgagtgtgttagcaaggctctgaaacacagccacatttcccagccagaaaactatcaggagtttgttcggctgcagggtgtgaaattattcacatcgaatgttgggcattgaatatccagcccactgttaggaaaagaacccccaaaatggaatccatgcctttgtgccaaccatactgaaataaacatttctaaggtgctttctgaggattctaacattttcttcaaactgtgttcactttctagctagtgtttgtgttcaagtagtcacattctgcctcactgaaggaaacagtcttcctgtgtacacctgt

SEQ ID NO: 114993 - DNA, 1058 bp, Homo sapiens
gataggaaaatggaatggaaaactttcttaatgaaattcattcccaggaaataggggcagtgaaatggtccaagtagactctatacagctaagatgtgctttacacagagtgtggtagatgctatacttgaaatattttcaataatggtaatataagttgaaggagatatatagcctaataattatgaaaacaacaatagcaacaacttctgtttataccatgcacttacatgtaaagcactttatagtaacccagtgaggtaggttttattgtgtatattttatagaagaacaaatgaggataaggaaagactttaagataacaaaattggtagggggaagagttaagatctaaacatttctttgtgcctctaaagcttatgttctgaagcaaaaacaaatgacggttggtatattttgaggtgcattttacattatgctttgcaatgttaacatttttatctaatttacagtctccttacttgcaggctcatagacctttagctgactgaatttttcagttaacttagtgtagccccaggataatgttaatactttcataaatgcaaaattaagaattgttcagtaatgttaaccttttagaaaatatgaaataggataatctcctaaaagctgtaaaatgagaaccttcacatttaggaagacagaatgtttttttccccccaattgaaaatgaggtagatagtattatatagttgtttgaattcaagatagaaactttaggattctatatagtaactactggtaatgattatttaaaaaatagccacttccaatttcaggcctaacgtgccaggaggttggaagttgccacacccattctcacaataagaaaaaagatgaataaactgaaaaatcaacaattattcttagatccgtcagaggattaaagtcacagggcaaaccactgccacccaaattggagagagacaggctaatacggagaatcacaactgactggagcagaagcctagtagcagaaatctccatgggaaccagtcctggggtagaaaagctcaaactgtaattgatgaatt

SEQ ID NO: 114994 - DNA, 1045 bp, Homo sapiens
taaagagaggctgattcatgttgtatagaacatttttttttctctgtaatattggttcacagttattacttacaaggattgacaaaatacagcccacggcctgtttttatacagtctgagagctaagaatatttttaaattttgaaaagaccattttttaaaaaagtatgtaacagtgtgtaccctgcaaagcctaaaatattatttaatccttcacagaaaaaagtgtgcagacccttcatttacagcataacttctatttctgtagtctgaatatattaaattactcagtatttcttaaaggatcaacatagaactgaaataactgatttgaagacaatgaatagaaaattaattagaataatgtgaatttgtatagatgtcgagaaatgactgcaattttgtgggactggttttggggcttctatgaagggaagatcttgtgcaaaaaatttgtgtatccagctgtagttgctgccatcttttaaaagcatgatgcctctgtcaatagatctgacattaatatgatataattacatattgatggactcattttattagaagcacttgcctttttcttggttatttgacttatacttgacggccagtttctcatgtatagaaatgtgtagcctggccatgtgcagtggctcatgcctgtaatcccagcaatttgggaggcctaggagggtggatcacctgaggtcaggagttcgagaccagttggccagcctggccaacatggtgaaaccccatctctactaaaaatgcaaaaaaaaaaaaattagccaggcatggtggcaagcgcctgtaatcccagctactcgggaggctgaggcaggagaattgcttgaacctgggaggcggaggttgcagtgagaggagattttgccagtgcactccagcctaggcaacaagagcaaaactccatctcaaaaacaaaacaaaacaaaaaaaaattgcacagccagatgaatgtcagtaaccaggatgatgggtggaatcttctccagcctgactagtgtccagcatgtggctgtagctc

SEQ ID NO: 114995 - DNA, 1031 bp, Homo sapiens
tttatactagtcccatatcaagcaaagctacatgtggctagtgattactgtattgattagcacaagtaaacattatcattgcaggaagttttattggacaaagctggattagaaggatcaagaataatctgttatactagtacaggaacataagcaaaacagctctttggactataggattattgtaagcctacccctgacacctgttcatagtagaaacatatagtatacatagtagaaacatgaccatagattgaattgtaagaactgtgctctcaaaagtggaaaataatttggaattggggttagtgcctagattgggcattttctgatgtgaaactctgttttggctttgtgatttgtattttgagtccagtgagtaccctggacctccagccccctgttctgtgctataccctatgcactccgttacctgcgctggcctccaggttgctatgacttttcaagccctatcttgctttcttttatgggagtcatagtgggatggatgattataagctggtctctgaagtgcaacatttaagaggaatcttcagggatcattaagttaactgcatattcttctgcatgcaaaatgccaataatgttagctactattcaggcatttatgatgtattagtcactaccgtattccttatgtgcattattttaaattctcacaatagtcctatgagataggaataataattatctttattttagagatgatgactttaaggcatagagaggttaagttatatacccaatgtcacacagcttaggtggaaccaggagagacccacagagaaactgattccaggctgtctactcttttccattatgtaatgaaatgcttccatgttatctatcaatggatgctttaaactcttggaagatattgaatctccagaagtagtccatttcattgctaactattagatacaagcaaataaggagtttttttttttttttgcccagcttatttttctatcccagaccttccttgacaattatttcaattgtagtctttt

SEQ ID NO: 114996 - DNA, 1066 bp, Homo sapiens
tatttttagcattgatctccactcattcaagtaagtcattgaatgttcattttaaacccaatacaatttgagtaatcatggaaaatataaagaaatgacagttttgggcttaggcttccaactatgcaaaatctactcagacatattaacattcttgaaaaagttgtagaaaaactgatttacaaagcaggaaaacaatagatatatagttaagtgcaaactgaggaatgagtagccatataaactggttgcacttggcttatacttgtggttcaaagactgggcagtgatatgtgatataatggtgcaaaacatttggatacagctatatgaccatttacttagctgctgagatatatctgtgtattttgcttagtagatctaataatgtgctttgttttatttcccttttaaaaagaataacacacacttctctgaaagaacattgttaccccctttacaaattgtttattttttgggcttaatataggttttgggctatgtggaattccagagaatcttatagatgctttactgaaaactggagtaaaaggactaactgcagtcagcaacaatgcagggtaagtgtgcattttaaaaacaattggctggagagaaatgccaattcttaatatttaaacagagtttatcaatgaaatgaagttttctcctattcacatgagcaatatgtccaagcatcaaaatctagtgtttaacaaggtcaagaggggtggttacatttatccaaatgtttttggtaccatccttcataagtaaagcagacttgcttcatctagtataaagatataaattaagactttatatcttaatgtgatgtgcttttatttttctaaacttaaaatgtattgaagttagaatatatatcttcaaattaagtcttgcattttaaaatttaaatgtattgttttatgttatttattagatcatttataaagcaaggtgggcatcaatttgaaatctgtttaaagccctttcttttagcaatgccatcattctagatcataaataaagggataccattaatcacaaaaacatggctggtctt

SEQ ID NO: 114997 - DNA, 1019 bp, Homo sapiens
gggaatggataccttaatgtaaaaagcctctataggtatataggggaaatgagttttcttccaacttcctctctatgtgggatttgtgtttctcagcatattgaaatagttagggtgatcttactgcacagactgttgagctgtggatgaactctttaattttcttccccttccagctataagggcctgactcttcacttttgggtggaggtaatgacagcagagttatacaggaagaaatagaacactcacaaagatttattttatatcaaaaaatgagaagtggagtatgagaggtttcaaaaaacatggagagaagcatattgtagtagaaaggccctgaggtagaaggccaaataaaaccttggatctggtcttgctttaatacagttttgggtaaagtacaagatccttctaagcttcaaaaatttgacctgtgaaatgaattggttggattagatatatgcactttttaagtgtgtctaggagatatcctcaactttatcttacgatccttctgttggcctgtttattcaggctatcacacttgtaatttctaatatattaaaaaatatatgtttaaaacagaagcagatgaatagaaaagagggaaaactctttgtggctcaagccctttctgtctctgcctagacttatttctcagggtttgagcagtgtgctggcatatttttaggggaagaaaagaatgatggatatttatgctgtcaccttgaccacttcaggttgtgtctgtctgggagactgttaggcagtggatgtgagctcataactggcatgttaaggtagcagtatatcaggattcagatgttattctttctttttagcctggctgtatagtgagaataaaggagaggtgatattgagtatgaatgattgctacagaatctgctttcttgttttcttttgtgcatagtgtggatgaagtaggggaaagggaaaagtttacaactgattgctcatgaatattcactaggtgactcatttgggaccaaatagta

SEQ ID NO: 114998 - DNA, 1052 bp, Homo sapiens
gtgacatactctttcagcaatggtttagtgagttcaatgcaaatctttacattgaaaataatcctgcaagttaaacaaaatatcaacacactctctaaagaagcacctaaggcatgtcatattccatgtaatttcagtttatagtagaatctttttctacattgtgtggatgtcacttctgggctaatgagaggtggaaggacagtgctaagaagtagatttcaactcaagtgaaagtggatcttacagcagtcaaaatgcaatctcaggctttacctgagaagacttaaggcagcagtcacatgattgccaacagacataacctgatggtgcttttgctccaacaatgaacaccttatctgtgtaactcctgaggctggatcaggtaggcctacaccaaatgctacactatctgttcattggcccatgaagaagaaagggatatattttagaatatcagactatgtttcagaagggaagcactgagaggtaaactcagagagtttagtgtcttgattatgggtgtatctaaatttgacttcatgaagtgctgcagaagggtggatagtaccttgaagtggacacataagaaaaggtgaaatcacagaagcaacaaagggattatgacattagagaaagggaaaaaaaatcaggagatggtgaaggcggagggagggtgaattgtgattagaggacttattagaagtatttagttccttttcttccaggttttgaggaaatgaggtaatttgtttctaagtttttaaaggaattaaatacacagatgtattatgtaattttaattgtagtagatataaacaattataaaattgctcataatgctggcattttgtaaggaatttgatttggtcaatcatggtcttttgaataacatttgcaactacatttatgaaatcttaagttttcagtggaagccctttctgtatatttatgtatattatttgtatattccagtaagttttaaatttgtttaattattttgagtgcattatcataaaagaagcataatgagaatacagactgcatttaag

SEQ ID NO: 114999 - DNA, 1050 bp, Homo sapiens
tatgttgatggtatgcttcctctattgggtggcaggatacatacgcccctcacgctggctctgtatttgggaacacaaatcctttgaaggttcaaaactggaagtagtgaccttaacttgatacagcaggcatttagaaaattttcaggggttatataagtagtagaatataataattacctttttcataattatatatgattaaattctgtaaattaaaacaaagctctattttcttttttgagggaaagaaagattatcattaattcagcactttagtgaaatacctatgaagttttctttaaaatctttctcaaattatatttacatctagacattttgcctacttctcaaatttacatactgagctagaagatttaaatgtgtaataaagcacctatgtgtgcaaggttagactgtaagaattgttttttttcaattttaagtcattgatagatatctttctttttttttttttttaggctattttggacatgacatattttgaggagaacaagctagtagatgaagattttcctgaagactcttcttcacagaaagtaaaagagctgattagttttctttcagaaccagaaattttagtaaaggaaaataatatgcatccaaaagtaagttttacattcctgttaattatgatggaatattgctggtacttgctgtcctgctttttggagtctatatttttttcttcttgattgtatctttgtttcttaaattaagattggaagagggagataaaagagcttaacacttcagaccaatgttgcaacaaaagtatcatattttactaaatgtatttcagaatatttgcataatagaattgtaatagctgtgcctaatcattttttttaatatagatattcccatttcgaccccctttacttttgcagatgctgttttcttgaaggtcactattaatctaattaccacgtctgttcttacagtccttattctctcgaacatttgctccccttcttaatgttgatcaccccctccctctgagaccctgcatgcttcttttccacttct

SEQ ID NO: 115000 - DNA, 1786 bp, Homo sapiens
tatattttttttctctatttatttatcaggggaggctgtggaaacatctccaaatttcaatgacaagccactttaaaaattttgatttattaaaattatttttgggtgtaaattttcattattttattccagcggtagtagaaatagatatgatctcacttcaagtaatgtatttgtgaaaagttacctttttaatgagatgatgactgcttatattgcaaacctgttaggggaatttgctagtaaaaatattttttaaattattttgtaaaactactagtaaattgaagttattttaattttcatgtattaatagaattgcatatttataattgattgaaaataaggcctccctgtgtaagcagctaaacaaagggaacattttgtgacttgagaatgtttttaatcgatgagtttttgaaatttaacttcaacttttatagacatccagtttccctttttagctatgtctttttttgtgtgtttcagcactgcaatttgcttggggatgagctactggaatgtctctcttggagacgaggagccctgctgtatatgtattgtcattctcttaccaaaagaagagagtggctcttaagaaaatccagtttgcttaaaaaggtaagaagacattccttacacatttttcattgttgacatttagaggtttcaaaaagctgtctttgttgtactactaagagtagtggatcaaagggtctgagtttgtattctgtgtcttttatttactagctgggtaatcataaataaattgggcttgttgtgaagactaaatcagataacatgtgaaagcactttgtaatctgcgaagttctttttttaaggatttgtattgttttaaatataagataaactatattaatttctaaacttttaaaaaatttttgtcctgaaagaaacacttgactgtgagcctgtcagcagatcacttctaaggaactcacatgaccctgcttctagaaaattgtggccctctgattcacttgaccattatgactgaatcattaaatccaaaatatgagtcttggtattgtatcactaaggattctaacttgggttaaatgtacacacaatttaggtgggcttgaaatgcgaggccacacttgcagatataaaagtttgatcataatatttctaaattataaccacatacatgtttttaatacattgttgttgagcacatctttattatctttattcttttcttcctctgataacatctttaacaagtatattactgaaatgtgtttctggttaatgtcttctttttttttagtactcttttttactactagagcatttcaaggggtatatttatattagcagagtcttgggatggtgggtctttataccattgaaatagaatagctgtaagctatgcctatatattaaccaattttctcttgagtaaagaatggaaaatattagtatttgaagtttatatatctctgcatataatactttcaattctttggctctgacttttatttagtaccttcttgatggaatcagttacttgctacagatgctaaattatcgatgtcctatccagttaaatgaaggagtttctttccaagatctagacacagctaaattactgagtgcaggtaatgtgatctctcattaaattttctaagtgttttaaagcttcttaagattttaggaagtttgttagatttcactctgatttaaataaatgtcaaggtagattatagacaaaaaagtaataagtaataaagggtttatataaaattcaaagataaaatct

SEQ ID NO: 115001 - DNA, 6149 bp, Homo sapiens
aagttctgaaggcaaaagtttgagaaccactatttatcatatagccatttgtattagtccgttttcatgctgccaataaagacatacccaagactgggaagaaaaaataggtttaatggactcacagttcctcgttgctgggaggcctcataatcatggcagaaggcagaaggcacttcttacatggcggtggcaagagagaaggagagagaagtgaaagcggaaaccccttataaaactattagatctcttgagacttattcattaccacaagaacagtatgggggaaaccgcctccatgattcagttatctcccactgggtccctcccacaacacatgggaattatgagggtacaattcaagatgagatttggatggggacacagagccaaaccatatcaccattcattcagctattctgctgagcctgttgtttctcttgctactctttataagcagaaattgaggtgaagtgaaggtgaaaactgtaggaacaaattttgatactttaaaaagcttgcaatagattcaaacagaaactaccactattttgaaagttgaatttttcatatccagtgccatcatagtcacttttgttgaatcatattaggtgaacaacagacattgtgatgctcatttatttgaagtaatcttttctaatcacagaagcacattagaatccatcatttattttttcttcaatggctttaagaagttacatttttatttcttttatgttctttaggaaaattcaggaattaagtaggggatgcaaactccttatttttcagatttaaaacctgagattcaaagagctttggtgacttgcccaaagacacaaagccagtaatttatacccagatcttttttattctaggtttatttgtctttctgccaaattaatatactttatgcaccataaatatttaattatataattgcctactggaaaaactacccataagaagaaagagttcaacttttgatgaaaattctgcagcatactctctttttttctggtaatacaaagcatcttggaaataacacctttaataatttaaaattgtatggactctcaggcatgattatgcatgataatttcttagacttttagagaatataagaggtctaggatacttgactttagctatatgaattatcctagagcataccccaaaataaagggtgtgtccatggatgtaattcagggagtttataagtactctgaaattgactgcagaatttggggtgtatattctgggagaagttctattccttaaattagattctcaaagaagttatagagtggaccccaaaaaggtcaaaaacacctaaatggttctctaaaaaaattctctggtactctgtttttctttttgtaatgggcctcctttatcagtaaaatcgatattaaaaaatgctaattaaatgaagattgtgttagtcatatttggcttttgtgttactgttaaagtgagaatagaaaatgcttaatgacaaaaggaactttaattagagtttagttaataactacggtttctttttaagcttttaattctaatctgtcaacctaaatgactttcccaggaatatttagtgacattcatctgctggctatgatgtacagtggagaaatgtgttactggggatcgaagtattgtgctgatcagcaaccagaaaatcatgaagtggatactagtgtgtctggagcgggctgcactacatacaaggaacccttggatttccgagaagtaggagaaaaaatcttgaaaaagtatgtatctgtgtgtgaaggacccctgaaagaacaagaatggaatacaacgaatgcaaaacaaattttaaacttctttcatcatcgctgtaactagtaagttcatctagtccttttcaaatagaaaaacaacaaaacccatgaaatggaaaagagagttccaaaaaagaagacctgttgatactgaatatgagaacattacactgcataaagatatccagcttgggtaccctactaaaacaacatcaccatctttttcattatatattagtaaacctatgaagggatgattctttaatttctaaagtgttgttcaaactcaccttaaaatacagatgttatgtcactaataatgagtagtaacccaatttagctttacaaagattttttctattactttttttttttattgtggtatatgtaacacaagtttaccatttttatcatctttagattatttttaaatctcactaccttgaagtttgccatgcttcagaaattaaagtcaagttacttcactgctttgaatacatactatggatataaatgtaggcaaaatgaaagattatgactaatattcagattccattttcaataaggtaaataatgaaagatctcacaaaggaatcattgtgtttaattattttgccatgtattactaattgtatttaaaatttctacttcccttaggcattttataaaaatttaaaaattatttttctattttgtttaaaagacaatgcatggcttttcaagtgagtaatgaagataaaaaccaagctaggttagtctaccattagttcatatgtttttgtagcacatcttttcataacatactgaaattttaatgttttttgcctttaataataggggtgagtgttaaaggccagagagcctaacttgatatcttgctcatggtctttctgtctacctcaactcctgttgtcatctttggatgatctttctgataccttgctgataccttggacttctgcccagtgactttattacattccagcagcttactcccgtggccgcactttgaatgtcaccaccttgagtttctctttctggtaaaatttcagtaactgataactgccctcttttcagttttttcacttccttattttattgacttttctctcctttatgctcattccacattcttcagttccttcttacccccttttcttgactgctccccttcctcctaaactgtcagcccctttcaggctttcttccctatccaccctcagctttatgggatactatatgaactaatctcaccagttattcttctttccctggtcttttagtctagtcctttggcaagccctcaacctcagattaatcctatttattatctaccttttcggggatgctgagttctttgtgatgggtagtccttcaaagtagaatcactacaagtgtctcacttcagccttagaaaagccctcaatgtaaaccttatgtttgttactagggtggcctctctcccatttcccgctgtggctgagccaaacttcattactttccttaggccctctgcccctcccctagcatatggctctttctcctattgaacagaaaattgagactatgaagaggtcaacttgtatttaccaactttactcattttcccattttagaggaaaagaggttgcctgcttcctatcaaaggcgactctgtgctacatgttggtttcatcttcgctgtctctctcatttccccacaaagtgttgtctcactttctgcctaccttttaggtattgatcttcactatatttttttctctctctctcttttttttttttactttacatattttatacaatgtcattcataactatggcttcttttaccacctgtaataacagactgagtctcaaacctgtaacttgtatcctgacttatctcttgctttctaaaccttgtttctaactgtctatcaaatatcttcattagacatcccacagtaattttaagctcagtgtttccaaacgtcaagtcctcatctgttatataaaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaat

SEQ ID NO: 115002 - DNA, 1034 bp, Homo sapiens
tctcactatgttgtctaggttggtcttgaactcttagcctcaagtgattcttccacctcagcctcccaaattgttgggattacagatgtgagccactgtgcctgccccccccatcaatttaaaaacagcttttcagagggggagaaagacacttaattgaatgtatacattgattattagactaatgagaaacataaaaatatgaaaatgagtcttagtcttgaggataaatagtagtagctgtgattatgcagctgctactgataagatgataaagttgttgatgatagtgatgatgatataaggactgttataagccttgcagtttttttctttctctgtatttttattgtcatgtgaatgaaagttacatacggtatcttttcttcaacgtatacattttatttcaactctatgtataagttgttatagaattttttctttactctttttgctttcaccgggtaattttcagtgtgatcttttgctatttttattaatgatttgttttggtaactgtgattttctttcttaggtattggatcaggagtcaattttcagttgaacaaccaacataaattcaacattctaatcttatattcaactaccaggtaaggctacatacttggtggcttaactgaaacatcagaactaaaacatttcaggtgagtggagcctgtttagtgtctttttatattctgtctttacaattttttttctagaaaggaaagagatagagcaagggaagagcatacaagtgcagttaacaagatgttcagtcgacacaatgaaggtgatgatcaacaaggaagccggtacagtgtgattccacagattcaaaaagtgtgtgaagttgtagatgggttcatctatgttgcaaatgctgaagctcataaaagtaagtactcatatgtacatttttaagcacattgttcttttcaaagcaaatggaaaatacctttttagactttactgtggcttcttaagaatatgatggcttattttatcaatgtgattttctgacccttactatt

SEQ ID NO: 115003 - DNA, 1039 bp, Homo sapiens
gtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtgttgggaagtcagagtagtttctgcataggattaagtattaagggctttaaaataactaaacgcattgccctgagtggctgaggactggaagtgaggttttggggagttctcaggagaactgcatgggagggcgtttgggaggtctaagggatgtgtaatatgtgtgagtacagaacttcggagacagacacaggttggagctatgaatttgaaattttcagggtgctgctgtccacagtccagggactggctggtttcagaggtattcaggctccctggtgtgtgtgcctgggaagacactcatcttttcttgcagacatgggatattgtggcaggtcaggctctgtttcctgagcaactggtgttccaggctagtttccacctgaatcaccctagaagtgtcttttttctgatgataaatgttgaaacctttccagaaattaaaatgctggatagaaacaaaattgatgcagcagacaggattgttgattctatttattcagtgattgggagctctttttccttttgagaaaagcaaagctcagtgtttccagattagatttcaaggagtcttcagctatctacagcttcccttctgggcctttggatggagctggaaggatgtgttttggcctaaagacctttggaagacatcatgtgtagcttaaagaggttgtcccgtctctcatcatcttcttccacccttataaactttttgttttgcattaatctaaggaaagttggtgtgtcaacatttagcttttttttattggagtaaatatatcacagtgaaattatagttatggtctcctgaagcccatggaaagccaacacttaatgggcaaaggtgtgaaat

SEQ ID NO: 115004 - DNA, 1130 bp, Homo sapiens
tggattatgttttttaaatctgctaacctgaagattacacttctcaggtcgtaccactggcaaattgcacaactatgggaatttggtttgcttttaaagagcaatttttaaaaagtatgtcagtaatgaaaataacttatatttcttaatgtgtttatgtgtgtccatacaagccaatactttttcttctttaaaaagaaccctataatttctgtggtaattatttaaatattatgagcattcaaatctcctaatcaccttttcaatcttcaattgataagaatcgaagtttggtaagactggagtcatccctcagccaattgtgtaaacaagacagtacagaatgtctttctggcaagtaatttttttcaacctgaaacagataatataaataatatgtcccataaaagaattacttaagatgataattactttagaggtaattatctggtgcatgaacctctatctgtgaaaatggtctagtctatctcttattggaaataatcagttggaaatctccctttttcattggtcagtccattctaggaaagattcatttctagaaagttcttatactgaatcaacattttcttccatccacttgcctatccttcagcagctgaccacaatgaatctagtctcttttccctgtgtttaccatacttgaaaacaaatattatcctccttgccgaatccccttttgcctactcttggagcagtttttcatccactatagggttccaccctcctctgccttgaacaagatgcccttgattgtacattctcattgtattagtctgttctcatgctgctaataaagacatacgtgagactgtgtaatttataaagaaaaagaggtttaatggattcacagttccacatggctggggaggcctcacaatcatggcggaaggtgaaggaggagcaaaggcatgtcttacatgacagcaggcaagaaagcatgtgcaggggaactgccctttatagaaccatcagatctcattagacttattcactatcatgagaacaacatgggaaaaacccacttccatgatttaatcaactcctactgggtcccttccaccacatgtgggaattatgggaactacaattcaagatggcatttgggt

SEQ ID NO: 115005 - DNA, 1050 bp, Homo sapiens
gggaactaccctttataaaaccatcacatctcatgagacttaatcactatcgcaagaacagcatgggaaaaactcgccctcttggttcaatgacctcccactgggttcctcccatgacacatggggattatggtagctacaattcaagatgaaattggggtggggacacagcaaaaccatattactgactgtccctcctaatgtgtgttttctaaacaaaagatttataatttgtagttctgaacattctatatctattaagacagtttaatattaatgaaattctttagccatttcattacgctcttgattaatttcatacctataaacaagataacttgttcttttcagattattaatcatccatagtcaaagcatttttataatagcttcaaaacattttttcatgcctgaatgtactataaatttatggaaagtataatactgtgtgggtaaataaaattctataaacagtgcaaatagtgacttaatttctccctatcaaggaatatcaaccccaaatataccgaaagtagaatgttccaaagataaacaagttgaaactacatgttatagacaggtagggactatgatgtatttttttcataggcctcattgtgtctgcttccatgaacatgagtcagtactagcaatcaggcatttattgaaggcttgttctgccaaagtcccagagagtatgccatctggccttaaatgaagtgaaagtacatcaaataaagatacttccttgggcaactgggatttaagatgtgcatgcaggacatgtctaagtcagccatctactttttctcaggaggtaaatggcttgccaatgccacaggaaagtctaaagtgttcacactccataagcaggtcccatgtcctgttgtaggtctggacaggagctggacaaaggccctgttactcttagcttaccaagtcttagctgccttggaagaagatagcaaatctggcttatccagaggagaggcctgaagtgtgcattgggcacctacctggtgtgactgatttctcttttatgtatctgtc

SEQ ID NO: 115006 - DNA, 1020 bp, Homo sapiens
cttcagagcctacactcctaatgctgtattcaattactcccacacttctccacttgcttaacccctattcttggtgtcctttttctaggtatacagaatttgaaaactatattgtcaaactacagcagacctggatgcatggtatacacttctttgtgagctggattaagtttcagccttgaatttgtggattattttcaaaacctgcctaacatctgtaaaacatgttgtttttttaatatgtagatatccacataaattgaccacaatgctcttcagaaagtcccataatccaataataaataaatttttgatacatggctaataacaggcacagaagcatctccaaaggacaggacattgatattgtgtaataatttaaagtattttatgattgtataatgtgcctgagttttggatagttgacctctatttctcagtctttacatagttactgcttttttaagtgttacatgagggatgtggaatattcagtgtaacatttgactaatctttatgttttgagtggcccaactgaaaattacccttggttgccttggaactctgggcatgatgttcaaaactagaaattcttgcaaattatttgagctttggctctgggaagataaacaacatgaataactaggttaaccagggctgaaatttctctaacctataattctaaattcagaaaagaatgggctttagggttttttgtttatttttgctttgattacaagttgttggaagcctagagttagtatctaataacacaatctatgtaaaacacaaattattggctcagaatgatatctaatttctaagaagatatgaggaggcaatcatgtaaaaacgtgcttttcttcctagaaggaataagctgggattggccaaaaggtaatccctttagagtctaatgtttagagcattgcatatttttaaagaagacatattaccttttagaacatatgtaggaaaccattttctttgcttatatggctacataaagttgtcatggtt

SEQ ID NO: 115007 - DNA, 1048 bp, Homo sapiens
aggctggctgtactttgccctcctcaaccctaaaccctatctgtttaccacagtggaccttttttctgaactctaacctcattatttcattcattatccacgtaatattcattaatgttctccaaggctcttagaataaatctttaacatttccccaaaaagtcacaaggtctgacacctgccttcctttttccagcttcctatcataatcctcctttttggcagtggccacactgatcttctttcaggttcccaagctcagcatttgcttttcattgggagccccttacatcatgactgtcagcctgattgtcatttctttggggaggccttccctgaaccctggaactggatcatatacccctatcatgtgctttcatagcaccatgaatgtctccttggtggcagtccccagtaggagaattctgtgtttatctgtatggctgtttcataaatgtttatcttcctcccaatagtctgtcagcactttggcagccagttgtgttttgctgttgattctacctccagcacagaatgtctcttagtatttatggaaggggacatgaaaaaagaaaaagtccactgcatgaagatttaatccagcgacactgaggcctgaacatctagctttagggaagccagcttctagcaggacagactggtagggactaggtaaggagaatggaaaaacacagggaatgagcatcactttctttaagactttgcctctggcagacccctccaagtaacagattccaaagagattgtgaatgttctccctctggtatgcagtctcctgtcctgtcagaaacatggtacccagaggccaaagctgctgcataagcaagttatcatgaaactattccaggacaggtttcagaagcagggtcttaaaaatgagtattaaatctaatgttcacccagatacatttccaacccacatatagacaccgaatttaacgatgaaagtggaagttactctgttgaggatttatttgaaatgttggttttctcttgtccatctgatacaggtcatagctctgtttct

SEQ ID NO: 115008 - DNA, 1057 bp, Homo sapiens
agggcatgaagagggcacttgggactactggattgcatcatcttggcagagaaaaatgtagcatatactggaactctagctgggtagggaattgacaagttgaaccacaagttgactactgttcagtcagcactagcttttatcttccagtcaccattccctgtggctcttcattgatcgtccacaagctccaggcctgggtggtgcctgttgtgatataagaagggaagagtgatggtttccaaaatgtgaacactcatgtgtacagttttcatgttgataatgaaatgctagaaggggaacagctagctgatgcctatgtctttgtccatacctggctacccatgacaaagttgttgttgttgtggttgttgtttcactccaggcacaggcacagagccgcaagagtagaaaacaagaattccatcctgcaaaagaaaactgaatcccccttgcttggtcacttagggaatcaagttcaggagggctggacatgttttctgttgctctgtaataggggctgaaacttagttcaattatggtgcttagctgaagcaccatgactgaatctttttttgagaaggagaaaggagaagattttaaaatgaaatgccataagtgtaacatagtacatatagaggtcacaaacttggaaagcctgtggtgtcttggaaggtcacataaatgtgtgaaacacgccagttgcacacaggcaagcatatgtcccttctagagaaattattgccactgaggaatgctggttctaatctccaccctcccttcccctcccctccactcctgtaaaaaccagaggtttggaattttgcgtgaataactcagtttgttagtgttgacaaccaggcatgacagtagctcatttggaccctttgtccaaatcaggaaacagcagcccttccttcatggcagccctgtagctacgccagtcgagtgtgggctggatttcagcccttactctcctccttagctgagactttgtgccagacacaagctgcccagctgtagacagtgggcccagaagttatcagtgttacatgag

SEQ ID NO: 115009 - DNA, 1037 bp, Homo sapiens
aagctccaggaaggcagggatgtgtctgtgttgtttatgactataacctctgggcctaaatcagtacctatcccatggtaggcactcggtaaatactgaaggaatgagtacagtatgaaaattagcatggctgatccttggaaaaaatataagtcaaaagggaatagcatgcatgtgtaactaaaacatcagtccacatgcttgaaatgtcatcacttttttatggtcaggacctgtttttttctgctccaattaaagaagaaaattgtaatgtgaaagaagcaagaagtgaagtatttggtattcatgtgttttgacatctgcagtaagtttaaaataaatttctaaatcttattgtattgaaattgtatgagtttcttaagtggtattattcattcagacttaaagtgaagttaggttgctgtcactcatagtggacttttttttttttggcattattaaaacaacatgtcttctgggtgttgtcttgtattacaaaagcttgcgtgttttctcttgatgctgtgccctgtctgttgccattgaggggtctaaggaccaaatgaggtcttgtttccttcctgatattcttttgaccagtttagaatatgccaggtccattcacacaactaagcggctcagttctctcagttccctggtcttctcatattagattgttatctatgagcttgaagtttagacatgaaaaagaatggttgtaatcctcttccttctctcaccctcttccctttttttcttaagttagccttttgaattcatgattctaataattaatatatattattatataatatagtatatattcataataatgattaatgatagtattaataattctgtgtgtgtgtgggcagctactcatacagaggaaaacagattgattagtggaaattacattaatttcataacttcttattaaaagagtttgtgtgtgtgttgttggttgtttgttccctttgcaactcaacatggtcttcttgaggtgtagggaaaacatatgcttaggaaacagagcc

SEQ ID NO: 115010 - DNA, 1040 bp, Homo sapiens
taatgataccagatctgttctactatgcccagccattcttatgtatctgtctctcaatgcatcatgggtcctttatggattcttttgtgatgtcctcaagcttcctgtccactccctagcaacttgcccaaactgatagaaccggcctgaatcagtcaacatctgatttcaagcattttctcttggtcagcctttggtattaggactttattctcaatctaatcaattaatattagctgagctaggttgatttcatttgaatcaacaaagaattgctaaaagctgcatttcctagaaaatgtggcaatataattggcaggtacttgagagtctttaatgttaaatggaaaaaaaataaaaaataataagagacaactttttatacggagcatgttttcggttttctttagatattttgttagagacaaaaaaggaatccagaatttattttatactacattagtacttaacagatttctacataagcaagtattatgcatttgtaatcagaaaaaaatatcaaaattagctctgtggaaaatgatcatcttgcaagcaagcatcatgtacccctacttttgatttagctcatcttcttgatgtaaatatgaagtgtctgcgcttgaaattctgtttgaagtggaaatcttcatgtttgtcttacaaataccatctcagagtacattgctcagtataaaacttgttttggggggttgggtacaaaaacctgcaaagatatagtccaggctccttttcccaaagtccttcactttcctactcttagtataaccattattttgtaaaatttaataaggcccctaataacttggggtttgggaatttgatttgaggtaacatgcctcagagtatcacctattttttattaaaccaacaaatttctatctgacaaagatgtgcatttatgtgggccttaataattcccccaaataaaactattcgtaagttctaacagttccaaatacttttggtttcagcacactaataggatttatagctgtcttagataaggagcagtatct

SEQ ID NO: 115011 - DNA, 1042 bp, Homo sapiens
aggaagatacaggccagctgagagccagcattcatattgcctgttcctttcagtattctttgtgaaaacaccaccaccaatgtgttccctggacgtcactactgcacctttaactggccttattatgctagggactgcatttgaaaagccaaactctagtatctgtctgtaattgcaagcggatatctcagcacatgcacaagcttatgtcaggaggatgtttatgaaaaactcaccaagcagaacactgctagacaggaaataaatatgtgaagcttgaagttgttaggaaacttccacatttgtccctctaagccagagataggacctgtgagaaaagaaggtctttatcattgcgcattgattcttgctgaacccctgctattctcaaaatacatttacagcaaaatgtggctactgcagatgtatttaaacatgtgcttttttaaatgacactggtttatcttccaagtttgttatctactattttactgtaaagcattaaaaagtgtttgaaaccaccagcaccatttcacagttcctgttttatttgtttaaattctctagctcatgtaatatgctgtatgatttactgttcaagtagagaagaaatacactccctcatggagatgtggggaggtaatactgtctcttggaagggctcagagatttcctgtttagattacacaggcttctttagagctgccaagagtcataacatgtacgagataatacactttggttcaggaaaaactatggataggaatgtaattaattcactgagccacaaaagatattccagcttagaaatgtcactgcactcaggcctggtggactcagtatgccaaggggtagccatgaccaaaaagaggattgctgcctgaggacccactgagtagtatccaaccacagagcaaaaggagggggcctggctgctaaggacatcacacgtctcacctgcttctttgagaattgatccctgaagggtatttctgcccaaagcctcagcaacctggcttcatcaatataactttgtgatgct

SEQ ID NO: 115012 - DNA, 1133 bp, Homo sapiens
tgtatgtatggtactacctcacagggctattctttggatttgaagtactatattagttagacatttgtcattcattcaattcattcagcaaatatttattatgctcttctctcaggccagtcaatgttctccatgctggggatagaaactgtcttccctggtgggatttaatcccaacgaggatggaaagcgacaatgctatggagaaatataggaaaggagaataggagtgttggagaggttgcagtgttgagttttcaggattggcatccctgaggcagtggcatttgaataaagaaggattggagaggataattatgtgtgtgtctcagggaagggcatttcagcaagggggcacgccagaagaaagatctcaaagtaggagcatgcttttcctcactcaatgaacagcaggccggcggtggagtgggcacagagtgagcgaggagactggtatgagaccaaatcgcacagacaagacagtcaaatctacccaaccattgccaaagactttggctttcacttggagtgaggtaggcagcctttggagggttttagatgatgagcgatgtgatctaacgtaagtgttaggataatcactgtgtcagttcgcttgaggattgcatggagaatagactggagggggacaaagaccaaaggggtacagtggggagacaaatgaagcaagaagaatgaaaaaggataatggccaggaccaggttattagtggtgcaggcggtgggacatggttggattctgttatatcttgaaagtacagctgacggaatgtggattagtgaggaaaagatgagccaaggacaagttcattgtttttatcctgagcaactagaggaattgagtcctcgttaacagagatggaaaagaggaaaggagagcaggttttggagaggaagagcaagggtttgtttggggatatattaagtttcagatattttttaaatatctcacaggagttgtcaatatagcatgtagatttatgtatagagataaaggagaggtcattattatgcctgtaatggtatctcacaggaggtcattgttatgcctgtaatggtggtaccaaatcttttccaaaaggaccttgtctcatatcctctatttttcaaatgcag

SEQ ID NO: 115013 - DNA, 1136 bp, Homo sapiens
tggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaaccactctgtatactgtgaattatcattgtaaggagagcttagcaccactggatcaaatacatcagcattgggtatggagatttttatgtgctgagatatagagagggaaacatatcccccttcccttattttttgagaagacaaaagcccaactcagaaatatcccactggcttggccctccccttaggctgtgactccccataggcaaaggttcatagagctgtgtatttgatgcatca

SEQ ID NO: 115014 - DNA, 1135 bp, Homo sapiens
gatggcagcaaggctgccatacctgatggtttttgtgatgtcctgcaaaatagtggatgatgactgggagtgcagggtctgaaaattataggattatatgccctagtggttggctgcatctgcctccaataggttgtatataaaaatcacacaaaagtgaaagtataagcatgttttaggagaagataatcaatacagatttgaataattaaatttaagatgtttgtgaatatgtctaggaagtagactcgtctggagttcagtcattgtgtttcagctttgtatatatgggatcatcctaatatgtgttttaattgtaatcaagggatagatgagattgctcaggtaaaatgtgcagagtgtgaataggcagaaagctgtatagccctgaataacacaaacacatacagaataaaccaaggaagaatgtgggaggaagaaaaatcaggaggtggaagaggaggaagtgtggaggaggagaaagaagaggaaggatatgaggaaaaccagcagggtatagtgtcatagaaattttttaaaatgagagtatttcaaaaataaggagtgatttttacttctaaatgttaaagagagattatatgagatgaagactgaaatatggcattgtatttaacagtaaagaagattgttatgtgtgatgggaagtaaataaatagatacgaaacagttatttttaaatttgggatgtgtttgtgtgtatgtacaaacctatcatatatgaggaagtcatctttgcttccatttaaaagagtccagacatctgtttggttttcttcttgttgataaacaggaatatgctctgaaaccttattcttaagatgtgtgtattttaatcgagaagagattccttgatgattaacaacaatataagaaatattagaatatccttctttcttcagttttactcgcaggtcttctaatctaaaatatttgggaagaaatacataaaatgaataatctcatttgatttgattagtggtttttctccctcttccttaattttctatgtgaaactctccttcttatttttaactaacccatactgcacctattctttatattgctgtaaaagattttaaaactttcatttttagaattacttaaaacttgtgct

SEQ ID NO: 115015 - DNA, 1054 bp, Homo sapiens
ggtgaaaaatggatattgagttcccttcatgaaaagttatataaaatatatatttagcataaacttctccagagttgtcctttattaagtttctttacagaaactttaattggtgccatgattcttgtgggggaaagaatcataagagccatcaacttttttcctttcattttagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattccccagtgtggtaaaattggggtaaaatgtggtaaaatgtgatacgcacaaaccctttgaaaatagcaaaacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaaca

SEQ ID NO: 115016 - DNA, 1016 bp, Homo sapiens
attgcagttggtgggctttctgaaattctccttgatacataccatgtaccctgctcttcctaaaaaaaaaaaaaaaaaaaaaatctattctccttgggctatgtgacatattatatataacatgtaaaagttgccagtatttacatcttggttttatgtttgtgaaattattgctgatactgttttgtttaaatattatatggtagtccataatcttcattcatatttttctctactttctcctttagggtgctggaaatgtaaacaagaatagactgttcattcctgatggcttttagtctatactaacatattgtttgtcatggcatccgagactgaaaagacccatgctttactgcagacttgtagcactgaatctcttatttccagccttggtctgggggcattttgcctcgtagctgacagacttcttcagttttccacaattcagcaaaatgactggcttcgtgctctctcagataatgcagtacattgtgtaattggcatgtggtcatgggcggtagtcactggaatcaagaagaagactgactttggagaaatcattttagctggatttttagcctctgttattgatgtagaccacttttttctagctggatccatgtctttaaaggtaaaaagcataggcttaatttttctgatctttaatttccttagcactattttgctgatctttacagcatcatttagaactagagaggatttgtcttaaaataggaaagcacattcatgtaacctttttgaccacttagtacttgcctaaagatgcacacagacatgttgctaatcaaattatttgccatcacaaactgctatggattcacatagagcaaagacccacgaactgtacctaaagagttcagtgctggcttacagaggatgcgtttagccaggtcttgaagaaagtattagcaaaccggtttaaattaacaggggtgattctcaaggctgtcctagttctttctgtatcagtgtactttcttcaggagcacact

SEQ ID NO: 115017 - DNA, 1460 bp, Homo sapiens
attctcacccaattcatctaaatttgttttctcttgtggtttttctctaatcttattcaaataagttagttctatagcgaacaggtttttcactctaaatctttttaaattaaaaatagacactacacagattccttataatcctgtcatcctactctttaattcccgtgtcatttcttcacttaaagaaatgttactgaaattttcatttcctccttaccaccaaacctccacccaaacacacacatacacactctattctctttccccctcccttatactgtaattagtttcttcatctacaaggagcagacttgataagccttgcagttccaactgtattatgaatccaagaggtcttccagctgagaaatattttaatatgaagcctatgctttctgtatataaagatatttatatagtgaaaaatgtggggaaaacctccttaactaagcaacttagtgctactagaaaatagtggtatcctaaaccagatttctaacaagaaaaatgaacaacagtcttttgatcattataaaccaggatcttcagaaaccttgctaggagaagttaatgaaaatagagtatcaatagcattgaaaaaaacctctgaaatccttcacgatattgactgtcttctatcaaactctaaaaagtgaaaaatggaattattacaacatattattaaagtttaaggatgttgtttcaagtgactggtataaaattactagtaagccaagatattgtacgtattaccccggcacaatgattgtgaaagaactgacatttaactttgaaggtatttttaacttgtacatttttaaaatatgtatttatatcttaataataaatatttcgaagttttgaacgtttcacatttaattcttatttcagattaacaagaaaaaaaatttgtaacattataaagttgttgctgtttttatcttgtggagcattcactattaatcttcaggttttttcattttgtttgtttttactgtttgagatacggtcttgctttgtcacccaggctgcaatgcagtggtgcaatcatagctcactgcagccttgaacttgtgggctcaagggatcttcccacctcagccttctgagtagctggaaccacagacatgtaccaccatgcctggctaatttttaaaaattttttttgtagagacaggaatctccctatcttgcccaggctggtcttgaactcctggcttcaagctatcctcctgcctccgtttcccaaaatgctggaattacaggtgtgagccactgcacccagcctctttttttttaatatgcagaattgtgcatttgttcacttgctatttggtccctttactccaagtatttttcagtagagctatgagacaagaactacatctcaaaaacaaaaacggagacaagcaacattgtaaactaaaaatcaggcactttggcaaagactgtatcta

SEQ ID NO: 115018 - DNA, 1083 bp, Homo sapiens
aaatataaggattttataatatttgacttctgaataagtatccaaaattgccctagagtcattaatattcatttaaatcttgttcttagataactctatttcctgctatttttatttacttggttttaggtacctgggataaacgatagcaatatactgcctttggttttgaaagagtcactcatacccagtgtgggaagatttcttgcctactctgatgacaaagtacatgctatctttttagatggcattactctaaccctaaattggaatttcagctctcctattgagaagagacaggtgggtatacttcagacttagatctattttttattggtaatctgtggaaaacagaacaaagaaaacaaagtaccacactatttcagttcattttttgaagtataaaatctgtcaagaagctttactgatctctttggatttcctagcaaaaatcagaatgatttgacaaatagtcacttttctaaagataactgattatagagaaagggattagtattttcatttgctttgataattacctatatgagtggtggttaaataacacccatatctcatgtaaacaacatttaaactgttgcatctttaatgattcctctacttatttctttaagttaatgaagttagaataggttgtttatgttctttttttcagttctaaaatgataaaacttatctttctacttcttcaggtaaatcaaggtcttaacttaggttggtgtaagttaacttttcctgatggacaagagcagttaattcagattgaacaccctgaaccatatgaaaggtactgaaaagcaattttaaaaattatttttatgttttacttttaactaacagagaataagcaataagcattatttaagtgttatatatatttttagtttttccatgtggataataatgaaggcatttcagtcgtttcagagttgatagctgtacttgtgtttagcataactaaatagatcaagtcagctttttttttttttttttttttgagacagagttttgctcctgtggcctgggccggagtacaatggcacgatctcggctcaccacaacctc

SEQ ID NO: 115019 - DNA, 1019 bp, Homo sapiens
tcattgagtggccactctgtgccagcactgttccattgaattatccataccccacaacaaaggacacccttctagtgactagaatactagtgttagccagattgagagtttcacttccatgaacaatgctagaagagcactgctaaatttttggagagcgagggggctctccttttcctatgtgaagacctattccttctaacaacatattctaacatgtatgttaataaaattaacttggcttaagtttctatttggtatatacccagtaccttgattgtacctggctgctccaggtacagccatcttttcttagggatagccccttgtgcagacggctaatcttatccataaagtattgattccgctagtttcattaatctattttcaggttctggaaatgttgtatttaacacgtatgcaatagacattgctttggtgacccttatatgccagccttgtgattagcagtggggatatcaagaagatgataagacaagatgcctgaattccagaagttcttagtttagttgttgaaataaatgcataagccaattctatttatcttttcgtgaaagagttaatttagctggttgggttcagaatatgaaattatctgcttcactggacaggcaaaaagactgtgttgttttgcttagattttgttgttactgttttttgatgactatcttcatgcatgttttaatctcaagtggaaaaaaatttttaatggttatttctatttcttagacttacccatcaaaatatgaactcaatagagatttattctggggatggatctgttttcaaatcagaaggggcttattttgggaactattttacttattattctattcaagaaggatcaggaaaggtaagccaacaatgaactcaactcaagaagagttttgctgtatagctctttctaaataattccaaatatatatgggaaatttggtcattatataacattgcttcctactccccagtctggagtattaatataatcttactgccag

SEQ ID NO: 115020 - DNA, 2115 bp, Homo sapiens
cactgtacctaaaaagattattaaagtatgctaaatgatgggacaggagtctgcacagggctctgtgggcccaggggagcacctgctgccgctcactggagcccgtgaccttgcttgctggagtgtggatctgacacagttcttttgtccatacctagcttcagaggctacccgtgtctttggttcactgactataaatacgtctgttttcaaaaggggtacacacggagtggcttctgtaaggctaagtataaaacttttaactccactaaggattgtagatttgtaacatcaactttgcataaacagtgcaaatcataatgataaaaactaacacttacaaaacacttatgtgccaggtactgttggacttcacccgtttgattctcaaagcattcccatgaagttaaaaaacgtatcatccctatatgtagaggaacttgcgacatagaaatgttaaataacttgaggaaaggtacacagctagtacttgtaaaattgagatttgatcccaggcaatctctgagtatacatttgttatttaaaacaaaaatatgggaatgactgttaggcttgtcatgattatctggttaaaatgagaaaagtattacgagtacacatcaaaagggaattatgcttcaaaagtaatgatttttcaataacttaccatgatgtttaggttgaaatccatgatccttcacatagcttaccaggtcttttgtgacctggtcccttcctatatctgtaatcctcaactctctcactactcttgcccttgctttctctattcttgctaagctggactttagcaatccctaaaatgcttgctcaagcactctgtgaccactgcacctactctttactctgcaggagtgttctctttctctctcagctggctaaattatgctcatttccaggtttcagcttaaacctaacttctttagagtggttttcctgaagaccctaaacaagttaagtcctatacaattccatagcatgcagtacttgcctcttctttacactcaatgtttattatttaatgtccctgctgagggcagagaccatgtctacatttttttggttgttatatccacagtgtgtatagcacagtgcttggcccactatagatattttagtaatttttttttttttttttgagatggattctcgctctgtcacccaggctggcgcgatctcagctcactgcaacctccgcctcccgggttcaagcgattcttctgcctcagcctcctgagtagctgggattacaggcacgtgccactacgcctaatttttgtatttttagtagagacgggttttcaccatgttggtcaggctgatctcaaactcctgacctcgtgatccgcccgccttggcctcccaaagtgctgggattacaggcatgagccaccatgcctagcgaatccaggctaaattttaaatgttattaaaactgttaatttatgtaattgtgctgagattcaataatgagattattgaaaatagtgaaaaaaacatggaaaaagacttgctttttacatttcattaatataccttcatattaatttttattctttgatctagtgagttaaacaagaaattaatcctgttacagtagcaacattttgttgacttctaaagacaattatattgagcaaccagaagtaatagcttgtattttatccttcacaggtggaatttttgtgattcacttttacagagacaatctgatgaatattcctatcctgaactagtgaaaatggtttggtacaaaggtgttacatataggtaaggcacctatgttggcttctatgttggagttagagctgtttattgatgtcacagagaagatgggacgagccttatagacagactctcagaagaggacacagttctgttgggccaactgtgctcctgtgtttgatcctgagttttacaggtctcaaaactaatgttattagtgcacacaagggtcctgtgactcactcacattaaccatttttataagacttatgtggtacctccaaagccaatgagggattggtttgctagtgaatgtaacattcatatcagttatttaggatactccttccaagcattggaggatcaagttgt

SEQ ID NO: 115021 - DNA, 3391 bp, Homo sapiens
cttttacaagggagttactctaggactacaggtgtgcactaccacatctggctaatttttaaattttttgtagagcattgtctagctatgttgcacaaactggttctcacactcctggcctcaagtaatcctcccatcttggcctcccattatgccaggattacaggagtgaaccaccgtgcctggccaaaactactctttgaataccaaaatactgttgacgtggctagaatatgaaaagtaattagtattatggattatactgtactgtcatttttaattgattttcaaatcattttacattaaggttacattttatatttcttttcataggagcaactacagcgagccctagattttcgaaactcttcagctacttgcccttttttatctgaaaccatcataccttctgaaagaaaaaaggtgatttttttaacttcatttttgttagtattatttgaggacaagtaactagaaacaggtaatttaatatttagcctttttttccttttcaggacacctggggatacattgctataaaacatcaaagttacatagtgtatcccccttgccattttctttgtatccaagcattataatcagaatttttagattggtgactttttcattctcagaggtctcaaaattaagtaattatgtgaccattttcagtaacagcgtatttgttaatgtatagtagaaatatgtaactatgggtatgacctttattattttgcttatatagtattgtgtttggacttttaggaataataactgtcatttactgagggtttactatgtccaacaactatgaacaatattagaaatatttaataacaccatactgatcaaaatggatgtccatccaatcaaaacaggtatattggctagatggcagcctcttttttttttttttttttctgagacggagtctcacactgtcgccagggctggagtgcagtggcacgatctcggctcactgcaacctccacctcccaggttgacgccattctcctgcctcagcctcccgagtagctggggctacaggcacccgccaccacacccggctaatttcttgcatttttagtagagacggggtttcatcatgttagccagcatggtctcgatctcctgacctcgtgatccgcccgcctcagcctcccaaagtgctgggattacaggcgtgagccaccgcgcccggccggcagcctctttttataggcaaggaaattatgtcttagagagtttacctaatttgtctatggcagttttctcagtggcaaagtcaggatttgaacctagtctatctgactctgtaaactctgtttctcaactactttctgctacctttctatgctgtcaagatgcttgcctgccggctgagtaattttatattgtctcgtggcaaaggagccataaaaaattataagttgtaacttagcctagaatggtaattttccattgtgtcttttgagtcactttattcactgaaactgcctagcttgttgctgatgctgcagcaggattattagatagtctaattctaaaagaggagtttgatgaccatccttacaaaccagctttgctgtcagtaaatacagccctcaattttagtgtcctaacatcgtacatatagatagcatggtaaatttaggaagctttcttgacaatagtttgtgtaaacgtaagattttacataaatggaattgaaatgctaaatgcttggcaaaattaattcagtaaaaacctctcacgcaatatctactgtttatatcttatatgaaaagtcacaatcaacactgttacttgttatgagtcttttattagtcagaatcaatttttctttgagtaattaaacttttttaaagtttcctctaagcctcctgaaatttattttagtgtatggtgtgccaggtactacctaggatgggtactttttacatgttaccttatttggttcatgtgataaccctgcaagacagaatttcccaaatgctgttcagtaattctagtactagtttaaataattttctcttttccctcttgctctgaaaaacttatgttatctcatgtaaattttaagatatgattgagtttgtttttgaattttctgagttgttctgtcaataatttttatggtagtcctgtaccatttaagctatggttgcttttttttttatttaaaacttaaagaaaaatttttagctatgattgcttttaatataatgtatcatagtgttggtcttcccttatttctagttttttttcagagtaaacttttgcagggtgaggggagggatacaaatctgtttaattcattgtacatttaaaaccaaaatacatttaacactaaatatgaccatttctctcattttgtgtctgttttacatctcttttttttaagggtgataatcttaacaatatcaaacattctctggaaaatcatatataggctgagatctggccctccattttttcattctctgtagatagtaaaacacaaatatttaagagctttcttacacaatacttaaatatcaaatatatggaaaaattggactgttaacagaaaatactcaccgtctcttttcccctctccttgcagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtctttagcacttcattttcataataaaatcagcaatatgtctaaaattgatgcacatataactcagagtagatttttaacttctgatatttcagaggaaagaggaaaagtggtttctgttcttcccagggccctgtcactcagctgtccagtcccacacctacacaggtaatgcagtaatggctattggtcatgaagctttttatcagaaccagtcttaacctggataattttctttttatctgataccattcacaaggaaagtttatctcatccaaaattttgcttttaactgatagtaaataat

SEQ ID NO: 115022 - DNA, 1157 bp, Homo sapiens
aggcggctgggaggtggaggttgtagctagccgagatcacgccactgcactccagcctgggcaccattgagcactgagtgaatgagactctgtctgcaatcccggcacctcgggaggccgaggctggcagatcactcgcggttaggagctggagaccagcccggccaacacagcgaaaccccgtctccaccaaaaaaatatgaaaaccagtcaggcgtggcagcgcgcgcctgcaatcacaggcactgggcaggctgaggcaggagaatcagacagggaggttgcagtgagccgagatggcagcagtacagtccagcttccgctaggcatcagagggagaccgtagaaagagagggagagggagaccgtggggagagggagagggaggaaacccaactctttaattccccttctgtcactgctgtatggagagcataggtgaagacatagtactttagaggtagagaagaagaaactgaatgcagagaaataaggacaaatccaagataataggagattaagttgctcagtagtaataaagagctgtttctttaatgctagggtagagacaggattccaggtatttggatttcttcttcagggtccttttcccataggcctaatagttactttctgcctgtctttggaatttatattacaaacaatttgctgcattcttaccataaaggtggaatttgcttattatttgaaatttaaaatgagataatgagcatataatttatagaaattaaatttctttaggccgggcgcagtggctcatgtctgtaatgccagcactttgggaggctgaggcaggcagatctcaaggtcaggagttccagaccagcctgaccaatatggtaaaaccccgtctctactaaattacaaaaattagccaggcatggtggcacacacctgtaatcccagctactcaggaggctaaggcagaagaatcacttgaacctgagaggcagaggttacagtgagccgagatcacaccactgcactctagcctggatgacagagcgagactccatctcaaaaaaaaacaaaaaaaacaaaaagaaattagatttcttcttggttatgttcctgcattggagtaaacttctagaagttataagcttctaaataataagcatataatttacaaaaat

SEQ ID NO: 115023 - DNA, 2369 bp, Homo sapiens
cttagtcattacactgtttgttgtgtatgcttgattatttaaaattagaaaaccgcctcagtaaagctattaaaaaaaagacctgaccaaagatagactatttttcccaaattggaatcagaaaatgtcttccatctatgtatcagcacccgttttttcccctaaaataccaagtagacatacccgatatatacgtgtgtgtttatatatatatctgtaatctatattgccatttgataagtacgtaaacaggtgatgtaaagcacttggtatggtgtgacttgtggaaagttacctatgtcatcaatactagagatggattggagagagaagaaattccagacagttgcaggagttggagagtctatggcctgaaaaagagaaagaggtagagagagtcaggttccaaagacagaaaatcaacaggacttgttacaggggcatggagtggaaagtcaagttttagaatattggctgctaacaatgagacaccattaattcaaattgcaaattcaagaggagcagtttacttatttttcatcattcaaatatttattgtgccatttactatttgcctaatactgttttagatgccagagatactgttacatataagacagataaggcccctgcttcggttgactttatatcctagtgggagaaaataaaaagcaagtaaataatcaattttgatgatagattctatgaagaaaaaacttgaagagggatgacaaatgattgggagatgtttgggagtaactttaacttagttggtcgttgggcccttgtaggagttacatttgtgctgaaaccttgatgatgataaagaaccagccttgtgattagccaaggaaaagacaaggcaggcagaaagaactgcaaagatgggaaagagcttgtttaaagaacatttaaaatgccaatgtatctaaagtgccctgtagaagtaggagagagttgagaaatgacattgggagaggtagataggaccagactgtgtggcctttgtaggccatagtttaggagtttggattttaagtagaaatggaaggtactggtgggttttaagccacgaagtgatagatgtgattttcattttaaaagatccctctgggcactactgtatgcagactggatttgagggaagagatgagagtgaaagtgcaattagggggtattacagaagcctgcttttggtaggagtgattaagttccattttagttatgttgagtttgatttatctatgggacagggacatagagagcggtctagcaggcagccacctgaaagctctgtgagaggtcaggtacatttagttctctagagaaagaaaataattaaaagtgtgtgaatctcctcaggagagaccatgtggttaaatatttacttatatcctgacatatcctcagaagattacagatgatatcacctacagctgattacatacattaaagggggtaaggttaaaaaaagacaaggtgggccaggtgcggtggctcacgcctgtaatcccagcactttgggaggccaaaacgggtggatcacgaggtgtggagttccagaccattctggccaacatggtgaaaacctgtctctactaaaaatacaaaaaatgagccaggcgtggtggcacgcacctgtagtcccagctactcaggaggctgaggcaggagaatcacttgaacccgggaggcagaggttgcagtgagcccagattgcgccactctactccagcctggcaacagagcaagactctgtctcaaaaaaaaaaaaaaaaaaaaaaaaaaaaaaaaaaaaaaaaagacaaggtggggcataaaagtgacatcagtgttatgttaagaagggatgaaatgtggactaaggtcaggtcttgaagaatccttgatttaagggaatggtgaagaagaatgattaaactaaaaacaggtagaagtgaagaagaaaactgtggcagcccaatgttaggggagaaaagtaggggaaaagagagtttggtgcaagggaatgtagacaatgctgttacacgttgatgaggtttagtaggatgaagactaaagtcattgggtataagaagacattggcgaccattgcgaaacaatgtcagtaaagagatagaggtgaaagctggattgcagtgaattgaagactgataggagagaaggttggtagtgagtgaatactacacttgagctgtttataggtaggaaatagggataaagtgaaagtgttttctatagaacgttatttttttctggcaggtaaaacttgatcatcttggtagtagaaggggataatgtggaaggggatggggttagtgttggaaaggaataaaaacatttcataagattgcttgagtgcctgcaag

SEQ ID NO: 115024 - DNA, 1004 bp, Homo sapiens
ggatggctttattctatgatgtctgaggcctaggcaaggaaaactaagggctgagggtaatttgaatatctgagagctataatcatctgaattcatggtactgagatgacttttaaagccaagactagattggaatcgttcaccagaaccatctacacttgtccatgtagcttgaacttctcacagcatgttgcctggattctgaagggccatttcaaaagacccagaaagcagctgcatttggaagttacacagcattagttccattatattctcttggtcctaagggagttactaaagccatatcacataggccatcaaggagcatgtggccatattttaaaactgatggcttgagcctggtggtctttggttgaccagactttgcataattgactacaccagtacataatgaaaggaagagttgcccccgtccacaattgttggcctttaggattgtcatgccttaaacagaaacgtgtcagcaagtcttgaggaaagatcattttccaatgagcaaggacacagagctgctagtaaatatagtcttgcgttctggcaaaaaaaaaaaaaaaaccacaaatattggtcttaacctagaagttgtcatcaactctgaccctctgtctttatgttgttaatgctctccagccatagactaccaggaacacactgtacctgaacatgttgagcttactgggttttgtttttttttttgtttgtttgtttgttttttgaggcagagtattgttcttgttgcccaggctggagtgcagtggcgtgatctcagctcacctcaacctctgcctcccgggttcaagcaattctgcctcagcctcccaagtagctgggattacaggcacgcaccaccatgcccggctaattttgtatttttagtagagacggggtttcgccatgttggccaggttggcctcaagctcccaatctcagatgatctgcccacctcggcctcccaaagtgctgggattacaggcgtgagccac

SEQ ID NO: 115025 - DNA, 1025 bp, Homo sapiens
tcttgagccccaagtttatatgtcaagcctttgattaactttcaggttatagaatttaacttatgtctaaaagtatatatattctttactataatttcacacacaagggactcagaatctgtaaaattttacttaccaaattaagcatttggttgtccgaagactgccattaatgtaattctaaagttaggcttgtgttctattataagtcagtctaggaaagttgtattacattatttttttcatgatttagcatcttactttctgagttgaaaaaccttacacttatgaatcatctttgcttttacagatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttat

SEQ ID NO: 115026 - DNA, 1151 bp, Homo sapiens
ccctcctcccagttgtttggtaaagtagtaaatttacagaaaaccacatcctcaccagcacaagattgtaactttttgatgtcttcacatcattctaaaataccagtgtaatggtttgtctaatatagaatgctcttcatagtgaccacttgaaacatttcaaatgaaagtatgattccacatataatgtcttgtcacttaacaacagaggatgggaagaattctcaattaaatgcaactattttaattttatatttcctctaacttttttataatcttaaattttcaggtgattagaatggaggggaaagacgattctagttcactgcatagtcagcaacatatattaatatgggttaatactttacacgaagaattacacatttcattcatacttggtgtgtgacagttaattaaaatccaaatctctgcacatttcctcttccagaagaggaccatttatagaaagattgccttaattgtattagatggaactgtagagtgaggaagagaaatttttccctttggtacaaactgcaaccagcttatggttggaatttttccatttgtttcctctggattccaagcattgactgtcctgtgtctctagcacagagaagtttttttagggcaaggaagtagaattaagttacacgctatgggcatcttaaacttcactaaatgttactaaattgttttctagcatgattatgccacttaatcttcccatcagcagcacatgagggttcctgctcctcatctttggcaatactttttattaaacttaatttttgtccatcagattgtatgaaattctatcttgctgatattttatttccctgacaagtgatattgaagttttcttgttcttgttgacctttttgatttctttctttgagaattgcctgctaatactctttgttcatatttctgttggatcatttgtctgtcttactgatctgtaattccttttgtagtctagaacaaagtgattcttagctgagggttttggttaccttctttctctcagtatttgcctgtctttgcattttgtttataatgtcatgtagaacctttgagttttaatgtgaacaaaatttatcagtcttgtttgtaatttctgtggtttaagaaagtttccttaccatttc

SEQ ID NO: 115027 - DNA, 1040 bp, Homo sapiens
ccagagtatagccccatcagcagaatgagtacatctcttcctacatccttatagtgatggatataatcaatcttggtttttgttttgtcagatgattttaagcatttcttcatgtttattagccatttgtttattatttcctataaattacctgtttaaatccttaactgatttatttcctgatgaaatgcatgtttgtgttttttttttttattcaaagcttctatacttgttgcttgctgtatatttcaaaaaaagtgacatgttcattaaaatctaatagcctatcttagtcatacagggaatataacagtcgttgacataaaacccatgattaaagttctgctattgttttttttgttttagtttctctcagtcaagagaaatatagagggcgtagagatcactgaatattagatggtagacagaataattaggaatattaaacttgctaaattcatcttgtttagagaatgcttgaactgttactggtatctttttagaatttctataatacactattgaatttcttattttactgacacctgcttttttagttgacaggatcagttttggaagatgcttggaaggaaaaaggaaagatggatatggaagaaattattcagagaattgaaaacgttgtcctagatgcaaactgcagtaggtaggaaaagaagtaatgtaaatagccagtgcatctcaatttcttgctttttctttggagattgttttttaatttgctatacttcagcagggtaagttgatggctaacggatatacaaaaatgcttttctttaaaggaataatattttacctatagtttctgctcactagacatttttgtgatagacgtgtcagatatttttgctcaattacatttagaaattgaaaaagctaattttcttaagatatgaattaaatgaaaaacaaaatccaaatattaactgtccaacaaataaaagtactactgtaagtatagtaggacacataaaaatgtttgaaggatagccactgcctttaaggtccatatagtcatagtt

SEQ ID NO: 115028 - DNA, 1904 bp, Homo sapiens
catcaactcttaccgacaaagttgtaacagaaaagcagccaacaggtgtttttaaataactgatttggcattaattaactgatctcttccattattaaccagaatgtactatctataaatatcccaacttttttctgatgaggaatttaatatgtacaagatgataacaaatatcttaccacatttgacttaaacagaagatgttgctcagttaatatacctcgtaaacattggaattggccacgtaagcacagtaagctgtgctggggtttcgtggttggcaaactgacccagagtcaattactgaacaagaggtaatttattttttctttgttaaaaattgtttacaaagtcaacctaaactggctgcgtggaaaccattcagtacccatagcttttccctttgtcttgaaaaggaaaactgtcaaaaccagttttgtgaagcaagttactttcccagagttttctcaccttatcaataaagattacaaatacttaataacaaaatgataaacttttacagtccatttaaaaaatctatgttagtaacaatatctgacactgtagttcacttatgaaggcagtgacaggattattgtgcctagtttagttaccttgtaggaactatgactgacaataagctccaagaagaggatttcttctttttctcctctgtgtgaagcaaatgggtcaagtcaggggcaaagagagcaaggaaaaatcagttatttgaagctgtcagtctcattggaaatagaaaacaagtccggtgctttctatattgtggttttaatgggggaattttttcctcacattagtacttctctgatacgtataatggaaattacaagaataatggacttaaaaacaattcattttattttcagttggaggttgtgtgtgtgtgtgtgtgtgtgtgtgtgtgtgtgtatttaaagatccttttcaaagttgtagtattaaaaaaaaaattacagagacaatttgggtaaaatcagtgctttcttagtaaaaaacctataagacaaggtgaggctctctctcccctctttgggctgccagtatgctgtgaatcagattacacctatgttgcttaaacatattaaatttgataaaaatcgttgaaaataaaactatcagttttttcaaactgggagacttagtatgaaaagatggtgtatattctagcctcttcaatagtcaggaacagtttctttattgtagaaagagcattgggacattgtccttgcctcttgctgtggacaaccaaactgacaaatggttattttgtttgactatttaaaaagcaaagcaatgtgagattataaaagatatgtctttaattagatgtcggactgaatatgaagttaaagatcaagctgcaaaaggggatgaagttactcgaaaacgatttcatgcatttgtactctttctgggagaactttatcttaacctggaggtgagaagtttttcttttgttaagtactaacaaggcctgagaacataagttgatctcaatgaggaatttgtgttcacattgtacttttacaacattaagagtgaaatgaaagagagaggaaagaaaacatgtttcggcacctgctagtgtctgtggtttactggaccgtctgtccataacatttactcatggacagaatgttaggaaataattactgaggtaaaaatctgcgtacttttaggaagctgtggtttacatgcaaatttaagttcttgagatatcaacagtgatacctttttgagttcttacatcttatatattaatacatttagtatgttgactttcagatggtggctcaaagcagtttactctgcagaactctgagtgaaaagagagactagagtctctctaggcttttcactctaattcacccaaatagtttttt

SEQ ID NO: 115029 - DNA, 1087 bp, Homo sapiens
gccccatgtgagcaaggaaataattagaaataaaagttagtaagtagacccaacatatagagtcagaggggtagcaggacatttgttagatctagattctatgttcaattacatttgtggccaagtcccttagctttttttttttttttttttttttttttaaaaagatgggggctttgttttgtcacccagactagagtgcagtggcgtgaccacagctcactgcagccttgaactcctacactcaagtgatccttccacctcagcctccagagtagctgggactacggtgcatgctaccgtgcccagctaattttaaaatttttttatagagatggtggtcacactgtgttgactaggctggtcttgaactcatggcctcaagcgatcctctggccttggccttccagagtactaggaatacaggcatgagccactgtgcccgacttcttaaccttttaatgtgtgttttcttacctaatattagatggtaaactatgttctctactattctttagaaattgcaattaaagttaaacttgctgaacactgcttcagttatatcaacaatctttgatgtgtagtgttttcttacttttttttttttctgtttttaagtagcttagctgttttcatttcccctttacccaatcattcttggagtgtttaagtgttagttgcttgtgccagttaccattaatcacctctttaaagtctaactgaagctcagggaggtttactgatgtccaaagtcatgaagcaaaatgccagggaatcttgtcctggactgccaaacactaaaaagtctgtgctttcctgccccaagaagccccactggtcaacagtttggcagtattctcattcataattgtcactgtgcagttgaggacatgtacaggttttctgcaaaaaatgggttagcatcaggagacattatctcttcgctttctggtagcctcaggtaactgatgggttttttctttttttttttttttttgtacttattgtggttcttgctgtaaggttgggagggaaagtgaatttaatttccttaagcctaacaatgacaaaagacttgtatatatgg

SEQ ID NO: 115030 - DNA, 1055 bp, Homo sapiens
gaacagtttgcagagaccctgaatggttgtgttacaacagatgatgctttgcaagaacttgtggaactcatctatcaacaggtatgttggcttatagcatgcagtgaccttcagatagcttccttgaagcccaaggatagtggctactccttgagggagaccagattcatgatcacctgcctccacacttactctttatagtttccgggagttctaagtctgtcttgtataaaactcctatagttagggatccaagggtagagccagacaggattgcaagttcacatgtgtagtcaagattcaatataggtaatattcacctgtttagccaaagctctatacaagcagtatagtatagaaggtgatatgggcactgaaaacgaaggctacataagtgtcacccccaccaaaaccctgccccttgttttgcaggctctgaaattagcagtaccagaaaagactgcaattcttttcccctatgtgttgaattgaatagtagtattagagtaggggaggaaaaaaattgagagaatttgcttgcctcataagtaggtctttaaaaaaaagaaagccaaaccataaaatgtcttgtcttagcatttctacttgcctttgctttcttttaaaatttaaggatttcatcttaattccttgaaagtctaatttagtcagttgaaattgtttcattatacaacatttagtttttatcccagcatattggtcattaacatattaacgctttttttttttttttttttttttttttgatatggagtcttgccctgtctcccaggctggagtgcagtggcgcagtctcagctccctgcgacctccgtctcccgggttcaagcgattctcctgcgtcagtctcccaggtagctgagattacaggtgtgcaccaccatgcccagctaatttttgtatttttgatagagacagggttccaccgtgttgaccgggctggtctcgaactcctgaccgcaagtgatctgcttgccttggtctcccaaaatgctgggattttacagacatgagccgctgcacctggcctcatt

SEQ ID NO: 115031 - DNA, 1040 bp, Homo sapiens
gcttatttcattcatttgtaatctacctgaattctacaggcattcaggcttactacccctgttctggtatattctctagccttactggtttaccctaatctttacccatagttaaggctaagagagtttttctcaatccaattagtcatagaacagcaggatccttttttcccccgactcttaggataagctcttgttgcaaaggaaacatttccttttagtagccataatccaaagttagctacattcactcattcaacaaatagtcaagtacttatcatgagtcaagcaccggtgatacagcaacaaacaaaatggacagaaattcctgtcttcatggagtctctattctagtagtctcctggctcagtttgcagacatttattgaatctgcttttgttctacacatgaaaatctatttcctggtatcctttttctaacagcctttatggtagtcttctgctgtgctttcttaactctttcaaggcaccaagcccttttatcttcagttcttcctctaatcctgctgctagaatttcctactttccatgtcttcttaccagtgagttgctatatccatttatccctggccattatttcttctcagacaaaccattatgccttgaatatttgtcacagttcacttaccagagccaaaaatttaacataggaattcataaagcattgatgaagagacagaagtccccttcctcccctgcaaaaaaacgagctttttttctaagagaatccctcttcaagttacttcccagtttttgttctgccttgcagtagtatcattctccaataggtaaaattattcactgtctctcactgttcagacctctgcagtctgatctccctaattgtattgatactatttttgtgactgatgttcttccgatttttaaatttatcttcctaaatctcattttaaaactttgagcactgtaggatctattcagtttataaatccccatgtgccaggtcctgtgctaggtgcaaaggtacctttttagtctatcagaagctccctcccattg

SEQ ID NO: 115032 - DNA, 2224 bp, Homo sapiens
tttgtaggctgtctgtacacattccggcgataaccataaatttcatgatggttcctgtttaactcttaaaaacagacgcttttcagatggtttttcagtatatagcaagttgctgtacaaaggaaagaatgcatctgacgccccgtttttttttcttttgcagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagtaagtacaccctttttcctacaactctgggttaatttactggaataatgtggttgttactttgttaatcagagtatgtttgtgctttctgtactacacgtaaaaaaatttttttattgtgaatgttttgaattattgaactcagaaggaaacaaagctgattcagaaatacattttgtagttatattcaaggtattagaatgtaagcttgagatacacatctgtgttcttgtttctagtgattattccattatgttaaaatagacatagttttgatcctaattattgtatgcagaaatgtcctacggggttgtgataaagtatttacataggtataaagaatgtttaaactttcagtttttctttgtcacttatataacaactttaaaaaatagtcacttttcttaaatagccgtacaaagcacagttggaatatgtagaaaggaatttgttgtactggataaacccagatgagtaaatgcatagggattaattatagagaagtgggagggaatcattggagaaatgattgatgatactttagcttaaatcctgtctttcctatcttcttagttttattgaagtatagcagagaatagtgtacttaagtgttagctcagtctcataaagtgaacactcaactaaccagcatcccagtcaggaaatagaacattatcaacatcccgaaaacccactctgtctccttccagttgttcttgatgtccaagtatagcactgttttgacttcataggatagttttgcctgtgttcaaagtttatataaataaagtcatatagaatatattctttctcactttcaatatcaagattactccatattgtagcatataattggaggtgacttatttttataacattccattgcatgaatatatcccatttgtctgttgatgaacgttggtagctttcactcttgggttattatgaatagggcacattttgtgtcttgctggctgtatgcctttatttctttttggtatattaccaaggtatggagttgctgggacttagggtagccagctttagcagagactgccaagtagttttccagagattgttccactgtacattctgagtagtgtatgatttccagttactctgcttcctggtcggcacttggtattttctgtttaaccattctggtgggcatatagtatctagttgtggttttaatttatatttcccttataactgataatgacacaccttttttattacctctttttggctctccttccatatttgacagtaaaagtatggaaaaagctgtgttccatgttttagatactccatgattcttatgctgtataggaaaaagctttgggattggaaagaaaaagatacaggcatagcaggaaaagcaattgatatggggtgaaaaaggccatctatcgtgtaaggtagaaatgagagcatcttgagttcttgccagaaaattgtatttagctcacagaggaaaagaaccattagagccactgtaagaggttgaataaactcttaaggatgcttgttctagcagctacaagcaggttcccatttattttcttccctattgacttgggctgttttatgatggagggatacaggggtgtgtttgtgtatgtaataatcgtgtatcaactatttttacgtggttcaagtgactttggggctgtcgagcagtatataaagtcatgttagtccacctactttgagccactgcatcttttaggcattccttgccatcctctaatagatcagcacctcctgtgctcaatttaccaaaacagattgcagcctggcacctggaaacctgtgtggcctgcaggtgtcttctctagccctgaatgggtttgttttttctttaagttgttttatttaattaaccaat

SEQ ID NO: 115033 - DNA, 1599 bp, Homo sapiens
agccgggaaaattttacttttttttttttttttttagacagagtctcgctctgtcaccagactggagtgcagtggcttgatctcggctcactgcaacctccgcctcccaggttcaagcgattctcctggctcagtctcccaagtagctggaattacaggcacccactaccatgcccagctaatttttgtatttttagtagagacggggtttcaccatgttggtcaggatggtctcgatctcctgacctcgtgattcgcccgcctcggcctcccaaagtgatgggattacaggcgtgagccaccgcgtccggtcattttattagtctttaaaaaaaaaaaggaacctgaacttttctaacacagctggaacaattcacagcagccgcggcagccgcagcagcagaagaaaaggtttaatttagttgattttctgtggttgttgattgttcgccagtctcatggtgatggaagctgtacatttttccgaagggaccgagaagcggctggaggtttggttctcctggcagcagcccaatgcaaaccaaggatctggggatcttcgcactatcccaagatctgagtgggactttttttttttttttttttttgagacggagtctcgctgtgtcgcccaggctggagtgcagtggcacgatctcggctcactgcaacctcggtctcccaagctcacgccattctcctgcctcagcctcatgagtagctgggactacaggcgcccgccaccacgcccggctcatttttcgtatttttagtagagacggggtttcaccgtgttagccaggatggtctcgatctcctgacctcgtgatctgcctgcctcagcctcccaaagtgctgggattacaggcgtgagccaccgcgcccggccaagtgggacatacttttgaaggatgtgcaacgttcaatgataagtgtgacaaaaactgacaaccaggaagcttgtgtactcagtgagagtagcatgtttgtctccaagaaacgtttcattttgaagacacgtggtaccactctcttactgaaagcgctggttcccctgttgaagcttgctaggcattacagtgggtttgactcaattcaaagcttcttttattcttgtgagaatttcatgaagccttccccctaagggtacctacactagaatttccaggaagaaatagagtttcttaatgcaattttcccaaatggagcagcatattgtatgggaagtatgaattctgactgttggtacttacgtactctggatttcccagaaaggtaatcagtcagccagatcaaaccctggaaaatttgatgagtgggcttgacccagcagttatggaccagttctacatgaaagatggcgttactgcaaaggatgtcatttgtgagagtggaattcacaacctgataccaggttctgtcattaatgccacaatgttcaatccttatgggtattcgatgaatggaatgaaatcagatggaacttattggactattcacatcactccagaaccagaatctttttatgttagctttgaaacaaacttaagccacctcctatgatgacctgatcaggaaagctatggaaggcttcaagcc

SEQ ID NO: 115034 - DNA, 1052 bp, Homo sapiens
ggtgttcatgaagctgaccttttaaagacatcaggaacgctgattagttttatttacccagcccaaaatccagagttgctaaataaactttcccaaagaaaaactacagttctggcaatggaccaggttccaagagtcacaattgctcagggatatgatgcgctaagctccatggccaacattgcggggtaggttcttttccatttcaattgaacaaaagcgcaatagtgctacagaaaccttcacactgtagctcttctgtcttacagtgattttatttgtaattattgttggagattacagccttttgagagtgcatttaaattatttttgactcattttattgttttacagtaattagataggaaatgaactctatttatattcctttttaatcttaatgagtagaagagtagtaatgtttccattcaccaaagcaaatagctgtcagattatttgtatgaggaacacactgtatttcataaatgtgtgtgtacatgtatatgtaaggttgaagttactgtttttataggtcaaaaatggtagaatagtgacaatttcatgtggttaaattaatatgcatatattagtggatttgctgtcttaattaggttttgcttaggtaaatttataaaatatttaaagaataggaaaaaggtctggactagaggaagtttcatctgatgtcaaaacccatattgataactgagggctatgtcttcgacctttaaggtcaagatggtaataagcttcatttgcccaatagcactaatacattctatgttgattgcctggagtactatgttgagaaggattctaaggcccattctgcttggaggaatgtggctatgattgagtaatcatgcctgccatgggtgagggacaggaatagctacatgaaagcagtgtactgctgactttgccttaaagggtgggaacaatctggaaatgggataaggcttatgaatcaacttctctaagaaactaattaaattagattttaatcatgaaaactattagtagttgagaatttgctaatattaatgaggcac

SEQ ID NO: 115035 - DNA, 1096 bp, Homo sapiens
caatatttggactatatagtaaagtaagtgtgaaggatgtatagtcctagtacccaaagaaaaccattgttagtattttcctatctttctttcattacattttctattatgttctacagtacttgttatgaagagggtgggtgcataatggataagagagtgcctctgtaggcagactgcctgtgttagacttctggctctaccatttactagctgagtgaccttaggcaagtctctcagtctgtatctcagttttctcacctatgggatgaagacagtaattgtacctttccataggcttgttgtgcaaattaaaggagcaagtgtatatacaacacttagaactgtttttgacacatagtacatactacataaatattagctattattctttgacaaaacttcattgatgacttatgatgatatgtgagtctgagatctctccttttatggaattatttatttatttatttatttatttttaaagttataaggctgttgtcctagcagcaaatcattttggacgtttttttactggtcagatcacagctgctggaaaagttcctccagctaaggtaggtacaacttttaatgtttctttataatatgcattgattaaaggaaagggtatgtatagtcttaaaatacagttatttaaaaatttttatatgttaacctcactgatgactttttggtgtgtataaatatttcacgaaacctcaaagcttaacgtttaagattgctagaaaaaaatgaactttgactttctgaaagttctagtcttttctgttttttgactttactaatttgaatttttaaaagaattttggataacttgttctctgtagcctatatattattaatttttaaaaaaaactttcaagataccattcagcagattctgggtttctcaatttttgcaacattttggcacatatacaaggtatttttggtttcttcacttcttgtcaatttttggatcaagaagacaggaaatgggaggtggtgtaatcagagtatttggcagagagaaatggtgccagtttctttaatccacactgaaagcagagaggagcagttaacgatgagaggtgac

SEQ ID NO: 115036 - DNA, 1062 bp, Homo sapiens
aggatctgtaaaatacacccctcaaaggatgtggacttctgtggtaattttccatgtctctggagaattgggtgggaggtgttttcctccaatatgcaagttccttacatatatgaacctgagatgttgctttgttctccatctgtcttgttaaatttatctttcatatggagtggaaatatagcgcaaaagaatgactttccatagtaattgttgaaacctgtgctttcgggcaagagagtgattgatacaagaataactatactctctagttgtgtaattccacaaagaaatattgtttttgatgactaaagtttttcccaaaagtaaggatttattattcattttcttattctgtatgcattatgatcataaaggacaaaactatatgctatagatcagttattcccaattcttttatattactttttttgttatctgattcatgttcggtaattccttcccttcaatgtattttatgattatatagacttttgtaatattgttatataaagtttcatttgttttgaggatattgaagacattttgaagaacagagagaaacttaagtgttgcaacatcaagggttggtaaccacaggctgtctacacacctcttcgtagctttcaatgcagatagagcaacttgtcctcaagtggaagatgccaaaactgtgaagttttccattgctatttatcagtcttgttcttagggtgtatttgagcacactttgtgagtgactgggccagatttaacaaatgttctgttaggaaaatttatggcatcgttatactttggtttggtttgttatttctccaaaagcatgttgcaatattggtatgcattatgcttccttcctggctttccctgggttgtaaaggattgggagactgaggctgtctttggcaaagcagcacaaatagcgttactgctaatgtactagtacttccctaccatatgcattgctgtatctccttccttccattttccttatagtttcttgtgcttcagtattagttagggtggtctagccctaaatctatgagttttgctataacagat

SEQ ID NO: 115037 - DNA, 1179 bp, Homo sapiens
ttcagattaagattttaactctatcatgttatcaaatgagttttctgtaaataaaatctactgatttgacatgtgagtagtttactagttagttatgtactgaagtaaaaataggagacattagctgaattgagtgttaaagtgtaagccttctcaacttgggacaatatcactttttaggggcatttgaaataggtggatttgggtttttggttgtccaaagatgggaatgctactgtcaattagtggatggaagcagataaatgaaatgtactgtaacgtgtgggacactgctgcataatgaatcatcacacccaaagtagcattggtcttacctattgagcaatgctgttctggagtgtaaaggtgtaaagatgtagaggacacaatctatttcctctaggcactttccatctagtgattaagtcagataggtagatcagtaatgcaaggtgggttatgataagggctaaactgaactatgtagacagtttttcaatcacaagaaacctatgaaggtttgtagggaggcgacgatttgtttttaggacttagagaatagatggtgttgggatgggagaagccaacgggaatagcttgagcagagacttggcatttgaaaaaatggggatagaaaagtggggacagatgtgagattcattgtgcaggtagaatggacagaaaggagggtgaagatgactgaagttcttggttatacctgtaataacatcagaaatatggaaacagtttttagagtgtggggtggggggaaattttgagttctttttttgagacattaaatttgaggtgaagatgggacaagagccatgttatactggcgctcaaatgacaggtcaagcctgcagacagattgggaatcatcagatggttgttgaagccatgagaggagctgagattttcaaggagaatgtgaggggcaaagttaaagccctttggaaacttatataagcggagaaaagaaggagaaaaactattcaaggaactagagaaagaataataacaaagttaggctgggacaggggaccgcagtgtcgtcaaagccaagtatgaagagagtttaaaaacatgagagagagagagagagagagagagagacagagacagagaaagagacaagagagggaacacccaagggtgtgtgcagtgtcgggggtgggg

SEQ ID NO: 115038 - DNA, 1040 bp, Homo sapiens
cctccgcctcctaggtttaagcgattctcccacctcagcctcccaagtagctgggattacaggcatgcgccaccacgcctgactaatttttgtatttttagtggaaatgggatttcatcatgttggccaggctggtctcaaactcctgacctcaggtgatctgcccaccttggcttcccagagtgctgggattacaggcgtgagccaccacactcaggcaggattttcctgtttttcatggataagtatgattcagataaacaaagtccagccttcttggatttgttatgtttttgggtggaggaagagtcaaggcttgcaaattggtaaagcaataaagtcatgtatttctgacgagaatagaaactaggccagttaaaattatcttgtatagtatttgagtaacgaaatagacattatttagcagtttcatgtcagctttgtaatacttttataaaataaagataccactattcatatccataaccattcattgaacaaataattataatatatactactctttcctaagctactgttgtaggtccaggggatacctcagtgaagacaacagctgaaaattcctggtcttatggaatttacattagttaattaattgattaattaataggcttcaagataatctgacttggagattataagcccatttgtctcccaatttcaatgctacttgaaacaccagagaacagctgtaacataggttattgtatcagagtttcaaagttatagctgccactatttggccttgaattagccagcgcttttggttttctcaaagaatgtggtgtgtttctttgcactttgcattggggctgccttctcgaaaaacatggtggcaggatagtgggtatgggttattcgtgtaactggtcaaatgagtgaaactttgatggaagagaggaaaaccaaagaaagtatgtgcattcactcacatctatgttcaacctattgtgtggagttgctagtaatctcccagatcaaaggtgtctgttatgctcctagaaagtggccaccttcat

SEQ ID NO: 115039 - DNA, 1064 bp, Homo sapiens
gaaacttctgttgttgtgtcccctttaaaacatgtggtatctgaaatctaatgtgaagttgtgaaaaactctaaagaatgaggttcatgtcaccatatattataaaagaggcttttaaaaaatagtactttttgaattgcttcttcttcatattttaccaagtatactcagtattcgtgaatagttcttgtatacacttatattagtttttattcttccttggttaatttaaaaggttctgaagatcaggttgtttcatttgagtagattattctactttttttgaactgtgcctgggtctattcttaattgatgactgaagcctgagcttttttattatctaatgttccatgaaaggctctattgttttcatatttgagagaggaaaataacaaatactgttgaattttttttttttttgcttcaagatattgaagagattatcctaatttgatgacatttgttgtatctgtcaaccaaggaaacaacatttttgcctaatcatatctgttaaatggttaaaaatggccttttgaaatttgactgtatcaaaataaatgtgtatttgaatgttagttttgttcaagtttccagggagcccaacgtttataattattggcctcaatctagattgactatacagttttttagtatttttgatgtagctgcaaatacaaataatttctggcttttattggactttattgatttttactggcattacaagataaaaattagaaaagcaacccagtaagtgttgacattaaatcaacatttgttttaatgtgaaaatgtatgcttctttgtattaagtgattattaaaaatatgcatttatttgaaaaacagatgaacatttatattattatacaaaaatgtatttgaacaggataattgctgtgtacatttattgaacaattgtgtctgccaggtgttggcctaaagcactttgtatgaaaagctttttatacaaactacatcacttaaatccctcagtagtcctctgaggagattttattatcaatcccatggtacacatgaaagaatggaggtacacagaagtaa

SEQ ID NO: 115040 - DNA, 1337 bp, Homo sapiens
gaaaacatgtgacgcgctccaggcgaaagttagagaatcctatcagaagtaaatattaaggatcaagctgttagctaataatgccacctctgcagttttgggaacaggcaaataaagtatcagtatacatggtgatgtacatctgtagcaaagctcttggagaaaatgaagactgaagaaagcaaagcaaaaactgtatagagagatttttcaaaagcagtaatccctcaattttaaaaaaggattgaaaattctaaatgtctttctgtgcatattttttgtgttaggaatcaaaagtattttataaaaggagaaagaacagcctcattttagatgtagtcctgttggattttttatgcctcctcagtaaccagaaatgttttaaaaaactaagtgtttaggatttcaagacaacattatacatggctctgaaatatctgacacaatgtaaacattgcaggcacctgcattttatgttttttttttcaacaaatgtgactaatttgaaacttttatgaacttctgagctgtccccttgcaattcaaccgcagtttgaattaatcatatcaaatcagttttaattttttaaattgtacttcagagtctatatttcaagggcacattttctcactactattttaatacattaaaggactaaataatctttcagagatgctggaaacaaatcatttgctttatatgtttcattagaataccaatgaaacatacaacttgaaaattagtaatagtatttttgaagatcccatttctaattggagatctctttaatttcgatcaacttataatgtgtagtactatattaagtgcacttgagtggaattcaacatttgactaataaaatgagttcatcatgttggcaagtgatgtggcaattatctctggtgacaaaagagtaaaatcaaatatttctgcctgttacaaatatcaaggaagacctgctactatgaaatagatgacattaatctgtcttcactgtttataatacggatggattttttttcaaatcagtgtgtgttttgaggtcttatgtaattgatgacatttgagagaaatggtggctttttttagctacctctttgttcatttaagcaccagtaaagatcatgtctttttatagaagtgtagattttctttgtgactttgctatcgtgcctaaagctctaaatataggtgaatgtgtgatgaatactcagattatttgtctctctatataattagtttggtactaagtttctcaaaaaattattaacacatgaaagacaatctctaaaccagaaaaagaagtagtacaaattttgttactgtaatgctcgcg

SEQ ID NO: 115041 - DNA, 1028 bp, Homo sapiens
tacctaacatatatgtttagtcatctgttttccattgaggaagttaccttcactgccaagttgactgaaacttagatattttttatttcttagaagatatattggatgaaagttcaaaagtttatgtaaatagaacccattagcaggaagagtgaggcttctgatggtttttttttttttttttaaagatacagggtgtcattctcacctaggggatggagtgcagcagcacaatcatacctcactgcagccttgaactcctgggcttaagcaatcttcctgccacagcctctcaagtagccaggactacaggcatgcatcaccacgcctggctaattgtttacttttttgtagatacgggttctcgctatgttgcccatcatggttctgactcattttattcttactcttcttttttcttccttttctttttccagtagatgcccagaatgtaagggattttggttgtgattcattatctctcaggtgctatgtctaagataaaaggtcagtttttgtttctattctacacagattcctcccaataacattagctgagcaaggcaagagcaactagtctttaaacattgatgtcatgggacagtgaatgtttaaaccaagcaaaacttctctccctcacatctgtgttcctccttgttattctcttcttccttaataactcttgcaaaagccagattgtgtatcttctcacacttgactctgaaaagatatctacactcttgttttgttgacatctaatggagaattccattatataagaaagaaccatctggatcatgagaacatggcctataccacactcactctatcagtttatcatagttagcatgatagataccaaaggaggttatagcagctccttccttagagatatttaactttgttatcattaggaaccatctgacttgggttcagaagatggaactatatgacatctggaggctttttcaatgctgttaactctatttcccagatgttggtgttgtggtttgcagatactgcaatca

SEQ ID NO: 115042 - DNA, 1035 bp, Homo sapiens
accactcctatttaacatcatactggggatcctaaccaatgcaataaggcaagtaaattaatagttatataaataaatgctataaatattggagagaaaggaataaaactctgttcaatgatgacatttctcattgtctctgaggtatctacaaaaaagataagaattaaaaagtgagtttagcaagatcacagaatacaaggtcaaaatataaaaattaatcatattggtatatactacttaagaataatttaaaattgaactgaaaacctgaaaaggagtataactcatggctagctactcattaattcaattaacaagtttttcctgtgcagtttgtgattaaaacacttagtcaggacttgacttggattttcagatcacttcaaataaaataatttgtttattgggttagacttctcatgggtcaacgttctcctagtctcattctaagtatttgatgatgcaatcacaactcagcagttgttatatttaatacagattgacaagagcctttatttccaaaaattggtctgaaataactgtgatcaagttaaaataatctgataaataaaacagaaaatgcatctgatctgcatcatggcatctcatcactcaagagcatatgcttaataagttacaaaaagaagagagaaaaagaaagatgtcctgaatagggtggtcaaagatgacagttaaaaagacctccagatctctttggaatccaacatatcactatagatttcataaaacaataattgtctttctgaattgcttacacggtaaacgaattattaaataataacttgaaagtgaagcacagatgtgatctggctgtggttcacctattgtttacttttaatggaaatgttttttcttcaaatcactgacttgaaacatggtggatttctatctgtaatatagacttctttcagtctatgttttacaagttacattatacactatgccatttccacattcatagactaccaaagtgcttcttccaagttgccttgatgatagatgtaccttata

SEQ ID NO: 115043 - DNA, 3240 bp, Homo sapiens
ggctttcaaaaagtggctatgatgatcaattaaaatgtatcatgtgctttcaaacagaatgtgttttgtggttctgagatttacttttctattgttgacattatgtattaagtgcacaacttaggtacaaatggcaactacaaacagaatccttggactggagttctctggatggcttgtatcaaatgaaatcaagtacaatcaccataggaataaaagattctgtttttcctttgcagaaagaatttaacaatgactgtaagctgaaggagaggatagaggaaaatggatacaatacctatgcatcatttaactggcagcataatgggaggcaaatgtatgtggcattgaatggaaaaggagctccaaggagaggacagaaaacacgaaggaaaaacacctctgctcactttcttccaatggtggtacactcatagaggaaggcaacgtttgtggatgcagtagaaccaatggctcttttgccaagaatagtggatattcttcatgaagacagtagattgaaaggcaaagacacgttgcagatgtctgcttgcttaaaagaaagccagcctttgaaggtttttgtattcactgctgacatatgatgttcttttaattagttctgtgtcatgtcttataatcaagatataggcagatcgaatgggatagaagttattcccaagtgaaaaacattgtggctgggttttttgttgttgttgtcaagtttttgtttttaaacctctgagatagaacttaaaggacatagaacaatctgttgaaagaacgatcttcgggaaagttatttatggaatacgaactcatatcaaagacttcattgctcattcaagcctaatgaatcaatgaacagtaatacatgcaagcatttactggaaagcacttgggtcatatcatatgcacaaccaaaggagttctggatgtggtctcatggaataattgaatagaatttaaaaatataaacatgttagtgtgaaactgttctaacaatacaaatagtatggtatgcttgtgcattctgccttcatccctttctatttctttctaagttatttatttaataggatgttaaatatcttttggggttttaaagagtatctcagcagctgtcttctgatttatcttttctttttattcagcacaccacatgcatgttcacgacaaagtgtttttaaaacttggcgaacacttcaaaaataggagttgggattagggaagcagtatgagtgcccgtgtgctatcagttgacttaatttgcacttctgcagtaataaccatcaacaataaatatggcaatgctgtgccatggcttgagtgagagatgtctgctatcatttgaaaacatatattactctcgaggcttcctgtctcaagaaatagaccagaaggccaaattcttctctttcaatacatcagtttgcctccaagaatatactaaaaaaaggaaaattaattgctaaatacatttaaatagcctagcctcattatttactcatgatttcttgccaaatgtcatggcggtaaagaggctgtccacatctctaaaaaccctctgtaaattccacataatgcatctttcccaaaggaactatcaaagaatttggtatgaagcgcaactctcccaggggcttaaactgagcaaatcaaatatatactggtatatgtgtaaccatatacaaaaacctgttctagctgtatgatctagtctttacaaaaccaaataaaacttgttttctgtaaatttaaagagctttacaaagttccataatgtaaccatatcaaaattcattttgttagagcaggtatagaaaagagtacataagagtttaccaatcatcatcacattgtattccactaaataaatacataagccttatttgcagtgtctgtagtgattttaaaaatgtagaaaaatactatttgttctaaatacttttaagcaataactataatagtatattgatgctgcagttttatcttcatatttcttgttttgaaaaagcattttattgtttggacacagtattttggtacaaaaaaaaagactcactaaatgtgtcttactaaagtttaacctttggaaatgctggcgttctgtgattctccaacaaacttatttgtgtcaatacttaaccagcacttccagttaatctgttatttttaaaaattgctttattaagaaattttttgtataatcccataaaaggtcatatttttcccattcttcaaaaaaactgtatttcagaagaaacacatttgaggcactgtcttttggcttatagtttaaattgcatttcatcatactttgcttccaacttgctttttggcaaatgagattataaaaatgtttaatttttgtggttggaatctggatgttaaaatttaattggtaactcagtctgtgagctataatgtaatgcattcctatcaaaactaggtatctttttttcctttattttaaaataataattgcacctgacacataaacatagaccacccacaaccaaaattaaatgtttggtaagacaaatacacattggatgaccacagtaacagcaaacagggcacaaactggattcttatttcacatagacatttagattactaaagagactatgtgtaaacagtcatcattatagtactcaagacactaaaacagcttctagcaaaatatattaaagcttgcagaggccaaaaatagaaaacatctccctgtctctcccacatttccctcacagaaagacaaaaaacctgcctggtgcagtagctcacacctgtaatcccagcagtttgggagactgtgggaagatggcttgagtccaggagttctagacaggcctgagaaacctagtgagacatccttctcttaaacaaaacaaaacaaaacaaatgtagccatgcgtggtggcatatacctgtggtcccaactactcaggaggctgaaacggaaggatctcttgggcccaggagtttgaggctgcagtgagctataatcttgccattgcactccagcctgggtgaaaaagagccagaaagaaaggaaagagagaaaagagaaaagaaagagagaaaagacagaaagacaggaaggaaggaaggaaggaaggaaggaaggaaggaaggaaggaaggaagcaaggaaagaaggaaggaaggaaagaagggagggaaggaaggagagagaaagaaagattgtttggtaaggagtaatgacattctcttgcat

SEQ ID NO: 115044 - DNA, 1038 bp, Homo sapiens
tgcttgtttgtttaccaatgttttgtgccttttgtttttagaaccacacaaaaaacaactcaatagtttcttttgattttacttttcttccaaatatatttaggattctttatttagccttttaaaattgtatgttttaggcatcctggagataacatcagtagaaatcggagttgttgccgtcaaagccattaacagcaactattacttagccatgaacaagaaggggaaactctatggctcagtaagtattctgcttttgttttcaaatccactccagtaaaccattaccatagttttggaaagtttcctccagacaccgaatagctttgttatccttctattgctagtaaatagagccacagtgggttagtcaccactgtttcaagggctggcaaagcagctcttccaattctgtaatctcctctgttgttcacccattagtctaccacacaggctgctgctggcatttgtctgtgaatgttctaaactgctaaccaagtcaggctctcacggaagcatccggtcagattggcatggaaaatgaagacaacttggagaaaaaacactaaaaacaaagatcttgaattgagtagaaacccatgtattatatatgcgttacggctgaagatgaaacaagggctcagatgttttgcattttgttaaaatctgaaatggggaaatgtgtcaagaaacaccattttgcttgttgttcaatcaactctagaattttatttacctagacaataacctttaattcaaattatgcctcaaaatcatatatatatatgtgggaaatattctttgcaatagggtccttgtggagcaggtatccctgcagtgctttgggcacatccatgcctatattccataccaggtgttaagtatttggaataccacttctgcaatcttggatcaaactcttttaaaccaatttcttagaaatttaagatctcacttaaaatgccaaatagttgttttataattgcaattgtaataataattaaattacaagcagtgagacaatttatcctgctc

SEQ ID NO: 115045 - DNA, 1049 bp, Homo sapiens
actcaacatctatgccaggatttttggaggggttacataaaggtgaaaggaaaaaaacaaaacaaaacatgaaaacaattttcaagtgcagccatttaagagtatagtatgaatgtcccttgaactttgtgagtgggaagacatctaaggaaatgtctctgtagctctccttttgaaaatcaatcttaactggacaagacccctggccacaagcctatgcaattagactgcatatcctagtaccacaaatgcaattgttagcagctgtctttgtcaacaggcaagttggagaaacaataaaaagaggagctggtgatgatgaaagaggaagggtgtgaaatggttgtgtgcttcctagtagtctttaagtctccacatacagaaaagaatttgtgctcctccctttagctaaagtgttgaatgactgagaaggcaaagagggatgagaaagctgtttgttgtctagaggaagaaagataggatatcctaccatgtcagaaagctgttaaacactcaagatgaaaacactcatcaggattttagaatcaacaagcagttgtttatatttggatgtttgcagtggaccttattaccttaacatccttgaccaagtttgtgagacaaagaatatccagggtgtggactgagatattggactttgtggttaagggactctttttaaaaaccttttttaaaaggttattatgactgcaaacttgggtaagaaaagggagccaaagtggtccttggcttttgttgtggttgaagcaagtgaatttagaagaaaaagactgagcagaataattctggtttaggcttgggactcttttattagttctcttcctatagcatacaagtcacaagaaatccttcttatgtttcgtagatggcttttatacccagtaaacatcaaatattgtcagtgtgatttttcacagggatacatttagcagtcagtccctcatggtacacgtttattattttgagttgaatatgcatatgttaaataatgggaggattcagcctcaggctggaaaccacgctgaaga

SEQ ID NO: 115046 - DNA, 1103 bp, Homo sapiens
gtactgagacctgaatgacaaagtgtagagtaagctatacaaaaatcaaggaaataaagctcaggcagagtgcatgagttctgaagaatgaaatcaatgtgtgaaaaagaaagaaggccaagtgggctggagaatgttgtgtgaagtagagagtagtgggagaagtttggaaagtagatcctggtcatgtaggccatgctagaaaatctgacatttattctaactaagtagtgatgttatctccaaaattaattgacatgttaatttgggaagctagtgaatggattgatgtaagtgaaaaacatgatataattttatatttgttttttttaattcactttattttggggactgggaaaaatgaaggaaatatacaaatgagaaaaaaatgatggttttggatagcactgacagtggagctgtagagaagtgaaagagtcaagacattttggaggcagaacaagtaagtgttcatgtttgactgtaaatgggggtgggaggtacatagataagaggaaaagagtaagtggtgttgttttgtgctgagattaaggctgtgggacaaggaacagcttcaggaggacaaatcagttaattttggagataagatcactattagaatttcaagggcagccgttaagtgattagaggtttatgaggttagagaataggtcaaggctggagatgtatgtttgggcatcatcaacatatgtattgaatttaaagtcatgaaacagaagtgcctgtggaggcagcatagaacacttaggcctgagtccaacgtcaacccaatattttcatactgagtagagcaagagaagaaaacagaaaaatgacttagaagtactaaagggatgggagaaaaatcaagagagtgatatctcagaagatggatgagaaaactttccaagtatagaaggtcagctatgttgaatgccatgcaaggaggggtaagatgagaaaagacagttgaaattgagcagcattgttggtgcctgatgaaaggcaagtagaagttcgattttttttttttttttttgagctgagaaagggaatgaacagtgaaacaatggggaaaaactttctatttctgagaagggaag

SEQ ID NO: 115047 - DNA, 1017 bp, Homo sapiens
ccaatataactttttcttccaaaatcttttatgcaaaaatatgcaagttaatagcattacctagtagcaatcctcaaaactttactggcacataaattaaatataagcactctccaaaggtgcttagatggtgcaaaagaagtacaagatgataatttgactttgctgacttcagatcttgttaggaggctctcattggggtataacactgcacataatcaactgctaaaaggcttgagccattgtgtatgccaaggataagcgtatatgtattgcatcacatagagaacaaatgtaccacaaaagcagagggtctttattggagaatgttattctgagatttttattttaggagggtaatcctattaattatctaatttccatttttctcttggcttctaaagtagatgtatcaattttagatacaatgtactgactttttatgttgtcatgagtagagcatgtaccattaaaactgatgtgcggaggtaatatgcaccacatggtttcttactgtctacatgtctggctttaatcacagattcttcatgaaatgttgcaagcctggggtgagctagctgttagattcttctggggtacagcctgggctgtggattattggtgaaactgcattacgaggctactggggttaattatgtctgaaagttttcagtacaatccacatcagttgacactctgtgcatactacataaacagtctggagggagacctttattagcagagcaagaaagcagctagctgtctgtgttctataatgtcctttgttttttagagcttctgactcatgtagcccttctgttttatttaatgtattcttaatcaaatatgtgcttattaagccaaataatgaagagtcaagaggttcaaatcttgaacataaattccctatgtctaagaacaattcttaatttaagattatgtgccccaggacagcagcccactgaatctgggggaaagcatgccaatgtttacccagaatttcaacatacattgtgg

SEQ ID NO: 115048 - DNA, 1054 bp, Homo sapiens
cattacatttaaaaaacagatagacttaaaaaaaaaaaaaacagcatacaaaattttcttaggcagcattgaatgattaatgcaaactgggtgaatggtcttaactactgatatctagctcctggttttagatattgtttcagttctgtttttagaataggagaaaataataataactaatgatattgaatgcttaggcctatgtactttatatgtacactcacttaatgctcaaaacaatcctagagtgtggatactaggttatcctattgtactgatgggaaaatttgaagctactgagaagccgagtaacttcactgagtagttaataattgatgagactaggatttgaacccaggtagtatggcttcagttcctgtgcacttaatcactaagctattgtgccctttgataagatgcaactagtctaatttgaaatccttcaattagacagaggcaaattagtcactatgctacatcagcaaattaaactttatagctagaggaaacttccatagagtattctgtgctttcttgacaaagtttgcctacataaagaacaaaaaaagatctcttcttgccatctacaaatgtttacctgcagttaaaaaagtctggctcctgaccacttttattttgaaactcctgatggctaaaaaagaaacagatgaaaaaaatggatttttttcagtagttacttttcaaaggatgataaatggaaacatttaaaaaatacttttatagtgtgaattcattttctatcagttctttcagtttgaaatttcttttgttatttgtttaatatcaaagatttttaaccttctcacatatgaggaacactatttattttattttcttgcagtttgagaaatatttgtcttgatgccaaactgcctgaagacatactcttttacaaagaaagcaaaattttaagagaagttaacttagggttgctgacatttattttcttctttatttaatcttcccatagttcccaagttcagaacttgaaatattatctttattaaagaaagtattcatattaaactcccac

SEQ ID NO: 115049 - DNA, 1013 bp, Homo sapiens
gagaacctgaaaaataagttagtagggctatcattatttaagagactgttaagtacttaaattcattaaaatttctgaattaaaaaaatgtgtaatcatgaagtgaatcatttttcatgtttctctacttttcctaaggttactactgataacattcagtggggattaaaaattactttatcccctttaaaattcctgctgactatgagacagttatttctagtttcagagttgtgtttatggattcttggataatttggtggttattaaaaaatgagcaattcttagtaattattttagagaggaagaataaagtgctgtaaagagtgggagtaaagggagtggtcttgtctgtgtcaaaacatttactgtggatcttaagcaggtcatttactttatcttggcctcagagacttaatctataatatgagtgtattgaactacattattattaaaatattttagtttagtatatttatttcacagactaaggaccagattcctggagtgtacctatattaggaaataaagctatattatgctgaataatgagcacccaaagacatcaggttctaatcctggaacctgtgaatgttactgtatttgtaaagtttttgcaaatgtgatcaagttaaggatcttgaaatgaggagattattgtcattgtccaggtaggcccttaatgccatcacaagtgcccttataagagagacacaaggagattagacatacgtagaagcacagaaggcagaaggcattttgaaaatggaaacagaaagatttaaagatacaatgttgttgtctttgaagatggacaaaggagtcatgagccaaggagactggaagaggaaaggaacagattgtctccctagaacctacagaggagtttggccctgctgacaccttgctctaggcccagaaaaattgatattggatttctagtccccagaacattgagagaatagatttatattagtctaagacaccaactttgtggtaatttgttgcagaag

SEQ ID NO: 115050 - DNA, 1025 bp, Homo sapiens
ttgaaaactgaaggtaacttgaggagagaacaaggtgcttaaaataaagaatagaagatgaatattttcaaggacacaagctgtaaaaggttaaaagaaagaaaaaaagaatagcgaaataggtaaccgtggagatttgatgactatagaataaaaggcaacaaagaaaagtaattcttaatttttaaatatttcagaataagtcttatatttcaacttacagtttcgagacagcattatcacagatacttagttcttattaaacttggtagttgttttttgtttctcatcctattactgtgacctttttggctcatacccttaaagcatttgtagtctagaagtagaaagaggagatcatcacagggagttggaagagcatataaggcagtttctactcaatgccaagaagcagggcagaatttaagtaaacagcagtctctaactgagggagagatgcatgacatcaggaggtcacactgaggataagggactccagctagacagagataaaacaagagaaggaagaatattctaaacgaaggcacataagtgtgtgggtgcagagtcaaacatgaagttttcaggaaatcacagggaggaaacaaagtttgcatgcaggtgggcatcttctgacagacaaagcaaagtacagtagaaggtggtatcatgtgagagggaagtctgtaaatgtatccttacatttgcggatctaaactttctggcaaaatattacattgacatgatttttatttaaacttgccctttacttttttttttcatttttactttttgaagtaaaaaaagaaagaaagtggaagaatatttcaaaagagtattatctatattataattgacaatctaaatatagtaagtagcaagaaattgtagcttaatcaaaagaaaaaagaactaattttatactagggacatggaaaagaagagttcttctgctcttcactaaaatgacattattcttcatatttctgatttgccaaatgatcattattttacaatttaaaata

SEQ ID NO: 115051 - DNA, 1029 bp, Homo sapiens
aagctgacatagctttttagattatatctcattcttctttttcttttctgtgcagcctttcttttacagcacagttgaatccctaaatacccgactactttgcattgttaggtcacctcttaggttagcccgagaaagcctgagaaaagttccacaggaaagatgcactatttaacggaattcaatctctcccaatagatttgaatcactaacataaatgtatgaatgtagattatatctctgtaatgaggcctgaatcattctcagttacttcaaaggactgaaattctaccttccttttttagctgcaataatcaggtcttaatgggttcctttattaattgtttctttgctaggattgaaaaggacagtacaagcttcagattagagtggtacctactaattctcaaaggctgtttttctcttttatccaacttctggaaggcatactttatttctatgcccttaaacatatctgctactatcaggctagctctgtattgagagaaatagatgcagccttttgttacgtgtgatgtcttgagaaatgattgaggctttttaaaacaagaccatggcagcagccattgaagaatcctaaaacctggctcttgaacctcagagaagcaatcagtgtatgtactagcagatccttcagtagctattgtgtttgagcagtttacattttacatatgtattgcctggattctttatgttgctcagcactacctatggttcagttacaagatgtgtgccctattatgtatgatgttattggcagcgtcagtaagctgcttcaagtaatgctaagtaaggtcaaaagtcagccacgctgttcaaaaatttagacatatgcaggcctcattttttcaccctgtggtgcagaccttatgagtatgtgtcacagcccatttttcccttttggacacagaacatgccagttttaagtcatcattaggacttgtgcacttcccaggctgcagctagaaatgatgctaataatcactcacatttgggtgaatgaaggag

SEQ ID NO: 115052 - DNA, 2052 bp, Homo sapiens
tcagctggtgtcaaccctcgtgggcctcctcagcccacacaacccggccctggccgctgccgccctcggtgagccttggattccgccccagggcggaagggagagatggggattgtactgggttactctgccgcagatttacccctcgtcatttctttctctctgcttcgttcatgttttcctagtcctttcgttcctatctggggtggcctggttttgtaacagtcactgcgttaggaatctagagactaggtgtgtgtggctgcgctaacacctaccagctcttcaactctgaaagcctgagctctccaggattccagtcctggattctactttgtgagtgttcagccaaatggaagagcagtggtgatgaagagaaacgccacttaagagagtggggcgggccaggtttcctgttggctgttccaccacaaagctgtgtgaccatgtgtcacatggctgagtagtaacttctttttaccttaattttaaatttagtatgtcttttctttttctttagtaacttttttgcttaatttttcgcgttttacggtagtagttctttgttgtagaattgtgaagattaaatgaagtattaactaagatacctaacgtttactcagtatttatgtgctaggccctggttctaaattttatatgtgccaacttattaatgctcacaataaccgttcacgataggtagcaatgttttggtaaatgaaaaaaagacaaaaacgtaacaaactgaggcatagaaacgttaaatgtgtctgcctgacaccctatagctaagagattagggggtcaaacttcaaactcccattccaagttcctagtaaaaaatcagcagcttccgtgtaactgttcagggcggacatgaaaagtaattaacgtataaataattttaaaaattattgtttttgacgcattcattattttatatcttctaccaagtgtatgtcttaatatttattgaagtaatgttaggactgtagatgtgtgctcaacctagccttgttgtgtgcatgttttttcccttccccagttgagaaagaagtggtcttgaggaaagcgtcatggacttagactactcctgatggatggcctagaaaacctgtttaactttgtcaagacccaggttcttctcctataaaatagagataatgaaaagtatacatacctttgggagttattgtgaaaattgaattggatgttcataaaatagccctatttttatttatggtgaatgatattcttgttaatcttattttcttttattactcctaatgaggaatctctttggttactgttcattgtaatgatggcacaagtagacaataaatgtttgaatgttatatttaagtcataatagttaaattaccacataacccagactcttacctcaatcattcctaagttatcatttgctaagttagtactctttagtgttctaatagtaaccaaatttatttagatgatcagatgaaaaaaattttgaatatctttttgatagattatagatgcccagttcatttttactgggtgcgtggtgaagaaattattcctcgtggtcatcgaagaggtcgaattgatgacttgcgataccagatagatgataaaccaaacaaccagattcgaatatccaagcaactcgcagaggtaaggatttattgcgattatgtatctattgatatctcgtgtaggatttgtcataggcaggttgagtaatagtcttagtagaataaaatgtttcaggtggatctcttgcctttcaagtttcctttttgaagacatcacctctcaaaaatctttttagctttttaaatctgctttggtatactccataaaggtcagataaccattttaacaataacgggttaaagtgtcattttgcctgaccatacagatctatatgtttctcttaatataaaaattctgaaatagtttacgattgtaatttgtgattgtaatttactagactagtcataaatcaaggaagtttaacagttatcaactgggccattttacatatttgcagttcttttggagaaa

SEQ ID NO: 115053 - DNA, 2041 bp, Homo sapiens
tttaaatactatacatttgaaatctgacactgaggtagttgtttttgtcttttactttgaccatcttctgtgtgaatgtacttttgcacacattccaaagactgtagccaactaagtcaaccctttctagataatagctttctgcaggtagaaaaggtaatgattttgtggattaaatatttatattacatcaatggctatcctatataatttctttaaaggttatatccaggatttggattaggggattgttcattcattcagtaaacagtaactgcttttttatatgctatactctgttcaagatgcagtgttgagtgaaacagatcctgctttcttagagcttatattatagtgggggtgtggggtggtaaaagataataagcatgtaatgtttataactagtggtaatactatggggaaaatactttagcctaaagagtagaatgatttataggggggcaggtataaatgaggtatggagaagaatctatttttaaaaagtcattcaggagaggtccctaaaaatgacttactctaagacctgaatggcgaggagctgcctatgcacaaatctgggtaaagacacttccaggcaaaaggatcagcaagtaaaagtccctgaggtgggaacaggcctgaaatatttaggaacaacatgaagggtaatgaagagtgggacaaggagaatgatgtagaaggagacagtggaagccagaggctatatcttccaggactattagagctcattgtggggcatttggattttattctaaaacctgaagtaatgtaatatgaagtagattaacactatgtgaatatccaagaggaattttactacatatttgattactaggctcatctttttttaacatatatatgtattttaaccttatactcaaaattgacttagatttatataatagaattgaatagaggaagtgggagtaggagtagatggaattagacaaagtaagaagtaactttcttgaagatggtagaatggcactgtttacttttgaaagataaagtacttctttttacaataaaataaattacatatgtcaacagtattactcatttgctatctccattaaagatgacataaaatacgtgtggagaaataaagttactacttggccttggtaattgggtaatgacatagtaccagatgtagaaagcatctgtgtagataaagcttgctgctcttagatgaagtaaataagactgatgttgttgaaaaagattaatcatgagattgaggatactagaagggaggaaaatattatttgtgcagaaataaaatatagggttagaatagagatgataaggaaactttgaggtcttcagggattttgttacataaagtatctaagttgtaggaggtatttgataccctctaatgtctaatgtgattgttttgtttgggtaagatatattctatgtgtaaatttcagcataactttcttctacaggattctggagtgaagcagatgttactcgaccttttgtctcccaggctgtgatcacagatggaaaatacttttcctttttctgctaccagctaaatactttggcactgactacacaagctgatcaaaataaccctcgtaaaaatatatgttggggtacacaaagtaagcctctttatgaaacaattgaggataatgatgtgaaaggttttaatgatgatgttctacttcagatagttcactttctactgaatagaccaaaagaagaaaaatcacagctgttggaaaactgaaaaagcatatttgattgagaactgtgggaatatttaaattttactgaaggaacaataatgatgagatttgtaactgtcaactattaaatacattgatttttgagacaaatatttcttatgtcaacctgttattagatctcttactctgctcaaattcatcactgaaagatttaattttagttaccttttgttgatttaaaaataattgcatttgtatattgctaactgataagacaaattgagttattgagctattaaatgcacattttaatataa

SEQ ID NO: 115054 - DNA, 1600 bp, Homo sapiens
tggccattagcccctaaatggcaaaatccactggacagttttctgtattgtactcagtaaggtctgacatattttgcatgtttgaccgctccttcatttttaaaatagtttttttattgccttcagtgaaacatgctcttggttttcctcctatctcatttgctgttctgtcatatttctgtttgctgttcttcctctcacttttcttcaaatattggtgtacttttttttcttttctagactccatttttgtttaaccacactctccctagatgattttatcaaattccatggatttaaatatatttgtaagcacattcaaaattagtttgatttcaaccttgtgttttgtatctgaatgataagcatcagcattataactaaacagactgtgtggttaagattatggacagtttttccctctagttatctaattttcataattacccccagaacgtgagaacattatttttatgatcagaaagtattttaagaaactagttgagtggactctaatatggaaccatcaacatgtatcaaattccacttaattataagcaaattcattatgaaattatatttaaaaaggcatttcatgattacatttgttatttaagaaaatgttatttaaagaaatttacataagtttcattatacatgtattttagcttactcattctggaaatggaaaacttagatactaggcaagaaggctttagattttttttatgagatattttaatagaccagtacttaggtcttaatatttgtgtttttcaaaaatttatgttaaaatcctaacccccatgactatagtattaggagatagggccttttggaaggtgactggagaggggcagcaccttcaggaatagaattagtgcccttataaaatagacccaagggaactttttcatcccttacaccctgtgagaacatgatgagaaggcaccatgtatgagccagagaatagatcctcaccacacactgaatctgctggtgccttgatcttggactttctagcctccagaactgtgagaaacaaatttctgctgtttataagctgtccagttaatggaattttgttattgtagcccaaatatactaagacaacaaccaatatagttaaaattactatgcatgttctactttatattaagttctagtgtacgttgtataatgcttacatcaaataaaaggtaaggttaatttacataaaacatgtttaggtaggataattgtaaaaattatttattagagaaattggtaaaattgtggctttgcatagaggcaggagaaagaaaagagcaaggcactagtgagaaaaattgctatggagaatattgagaatagatacaaggagacctacaggtttacaacattaatattggccaatacttgattggacagtttaaatttttcaacctgaaaggcctttgtgccccaaagtttggtaaggagattttgtaaaaacaaacaacaatagcaataaaaaatcagggaagattaagagatttcataaggagcaagaatttataggtaatacttaaaaggtataggtatgattactattttggtgaataataggcacatggtagac

SEQ ID NO: 115055 - DNA, 1085 bp, Homo sapiens
ggacatgtgtacctgaacaatatttcagcctctctcttcagccagaatttgctcctgagaggcaaattcatatctccagacatctctacctgaacatcccaaatatgctcataatcaacatgccccaaactgcattcatcagctttttgtccttttcaatattcccaaaccaagggttggcactactacttgcatagtctttcaatctagacacctgggagtcattttttactttcattcttcccttcccatactcagtcagtcaccaagtcttgcagattcccaaagatgtttccaactccccattcatttcttcccttatcaatatttaacttatttcagatccccatcatggctcccctggacaattccaagggtcttctaaggttccttactcacagtctcattaccctctagtcagccttcacaatgcaatcagaaagatccttgtggcatacaaaccttttccccctgaatgaaatccatgcttctaaccaagccatgcaagacttcttgttttctttctagcctaaagtcttgtcattctttacctcctatgatttagcaatcgtgatggagttgactttcactaaatgcaccaaattagcttttagcttctttccttttatgtttgtttgtttgtttacctgcatagaaaattggttcaagcatagcttcagttttccttgatctgtgatcaaggctcttccacataaattgagactctcctcctgtttatcccatcatatactcactgtattgtacttctttgttcctaggttccctgagagtatgcattgtgtttgttctttgttcaattggtagcacatttataaaatgcttgttacatagtagtgctcaataaatatctgactaatgaattaatatatcccctcaattagaactccagacacaattaaaatatactttaccatgcaataattcaaactttcgagttacaaatatattgaatctcctactggcttcactcataatcaataagaataattttaaaatgtaattttgtctgatttaaatatattcatcttctgggggaaaatgcagtttggaattgtagcagatta

SEQ ID NO: 115056 - DNA, 1072 bp, Homo sapiens
ataagctccctctaattctaaatttacaaaaatgtttatgaataatttagtgtatgataaatatatgccttccattttacttctaaagcatatgagaaacataccaaaaatgataaagattatatattcttgtagttattttaatatagctgagttatgtaatacatatggaattacttagcacaatgcctggcacattaagaactagttgtttgaagagtttggattttactaaatcctagagtatgatttcttatgtgtgtgctcacaattcaattttgtttatagtgaggaaattagaattttcaaagttgaggttatctctagttttaaaaagctgtcatgattatttattccacccttacttccccaccatcagacacacacacacattgatatagagtcattttcattgctataggattaagactaacacatagtcaggagaaatacaaattgacaattagatctccagtgttgattcacttgacacgagccctgaatcaataatgccccagtactgtcttttacacgcatctactgctttatactacactggccctttcgcttatgctaatgcctaacatcatggcacagactgtgccaggtactgctctaagtattttagaaatattggatcatttcatcctctaagcaaaccctagtgaggtaggaattaacattattccagttttacaggtttggagatattcttggggaagatctgtggctttcccaaggtcaaatagcatctcagggtgcagctgcatcacctacactcttaaccagtatcctctcatctcccaccacatttcaaggagcttcacagtccaaggtctgacaatttctactttatttcactatccacgaaaaaaagtggcagttattttttaaccaccggagcatgaatcatcacaaatctcacctacctccatttctttttaaattgctaagtgcttggccttgaaaacactcacagtgataatactacaaatgaaatgcagcccttctttaaaaatactgtgaactagaataggcaagaagacattttggatgtttcatgccaaacaac

SEQ ID NO: 115057 - DNA, 1054 bp, Homo sapiens
actctctatcagctcacctatacaatcaattattaagtcctgattattttacttcctaaatataatatggaatttgttctttcaaaatgttttctcatgattagacttgagtcattaatgtttagaaagaatactacagaccatcttgctctagctcataacttcattgccttccttacattgggtgaattacacgtgttctctaactgctctttgtttatgttagccttatgtttttcaaatccgttattctcactgctctagcaaatatcttgctatgctacttctctgtttaaagcctctcaaatgacttcccattgtttacagaaatcaatctagctccttaaaatatcatacaaagcattctaaacctctttgttcccacaatcactataggcttctagttcaggtataagctatttccattttgtaatgcctctgtgcttctgcttatcacatcctcttagcaggaggaatacctccgtgtccctttctttagtattcatccccacccctcaccacaacacacacccgtatcttccaggattccttccctgacttcattttgtaagcttgtttagtagattttcagtgcaacaatggcttcctgcacttatgtcactattagtattattgattgcttataacatggcaagaaatctactaagtgcattagctactttatctttttcatcattcctaaactattatatctgaatttcccatctgtgttctgcctcttctagtataatgagctcctgagaaaatgcatcagagcttacgctttgttatttcaccagagagaacagtttctgacagatagtaagtctacaatatactttgtagcaaatgaatgagtagactctggaacaggttgggttggggagggaaaagctatagtctcattggaatgtctttttttaaattaatttatattcctagaaattggtaatgcttgctgctaggaagatgttgatgagaactagtaaaacaactaataatggttactccttagtaaatatttacaatatgaaaacatttctcctaaatttgt

SEQ ID NO: 115058 - DNA, 1051 bp, Homo sapiens
tttcctgatagagtactacagaaaaatataatttaattcagtgtgataacatgaggtgaaataaggcaaacatgaggaatcaggagacttctattttcagctttgtcactatctcattaaatgagctcaaaaaagcatttaaccttccaagcctgacttttcacttctggaggaaaaaaaaaagaaaggtggaacaattatgagaattacctaacaagaattttcagaaattggaagtgtgagtttccagtttctggaataaagattgctagaagcaagaactctttgaatgcatcattatcttgaactgaaatcacccttttagattgaagaagtatttcctagttatagagaaaacaaacacatttacacctctctcaatgtctgtcctcaacccagaatcattgtttgagttgagaaggctggtgaaaaagagactggtttctaatctggttctgacattaagtttctctgtgactttggtttacatctgtgatctcagtttccttatctgaataatcagaggattggattatgtactgtgtattgtctaatccagttttaactaggattgatgtatcccaaccatctggaaggatgcctggcacataagagatgctcaataaataatagattgaatgaatgaatagatccttaaagtaccttcatttggtttgttagatagggtactgtagacttgtcagatacagggactgcaaggatacttgtaaaggagcaatattatggggatgaagtttgaatgaactaatgattttctctcacttgctcaaacatgaagtggagggggaggctattggaattttgctgagatttgcttggtcattttttgtatttatgttcctatcctccctccctttcgactgtaaatgaatttatataacagaactggctttgataataataatcattatatatatatatgtattttaaagtttcctcacatagtttagttccataatgctctccgtatttgtcttctgatactagtcagaaaatttaaaaaaattaatttgaaaataattttagattt

SEQ ID NO: 115059 - DNA, 1051 bp, Homo sapiens
gtgtagggtctgattgctaatctggcacatcattagctctgtgagatagtgtggtttttgtatcctctaatattgaagtttcattgaattcatgattgggtaaaacagattgtttctttatttccaaattgtatatataaaggctttgattttagcatattaattttgcttattgttatgccttgcctatagtaacttattttagtttctccctattagttcatttcataatactaaaaaggaacatattcatgagggacattagtacatagaaaacacaaagagtatagtgaataaatggagtgaatctgaccaatcaggcccatattttgctgaatagagcatctgttgttaggcagtgggtgggacctgagagggctcagccaactggagtttccaaagatctgagttaaaccatcatcaagcaaaggagttcatatccctatcttcaaagtctgaatattaaccattttgacttccttttcttcctaagtctttttgtattaattataacctgaattttatagtctgcataagcgtaagagtccaaaagacttgtagaatgcctaaatcgacactaatgaaagtcatataaagtcatatactggctatagaatattgctttcctccctacagaaatactttttagcattttcaagataaattatgtttttaaatatgtcataaaatggaagttctgtttgatttctgtgaggcggtagcagtgtttttgtatgtgcttgtcagtgacattttggttcacaggatttcaggaaatgacatgcaataataaaacactgcataatacactgataaaaaggcataaaaatggatcattcttaaaatatagatatgggatatatttaaaatcaaatgaagcacatttgagaaatcagattcatcttgtaatttttctctatatagcacattccatctaaaatggaataaatgttcagttctcaaagcctttttatgctaatttgagattaataccaaaccaagatgattcttgctaataattgctaatatttattgaaggcttattacacgt

SEQ ID NO: 115060 - DNA, 1027 bp, Homo sapiens
gatttcccttggatatttgttttgcagcaaacaattatgagactgggagcttctacccaccaggaccagcatgggtctctggagagagattgtaggccagagaataatccttgaactctgaccccatgagaaaccactaggtgactttaggggctcctgatagttgaaagtatgcccacaatcattcttactgtgtccctatgtggcttatttcttgaaagcaggtgaggtttgtaggaccagtgagcccagcctgagttccatggctcttcctcttcctcttactatactgatcaaactaagttctcactttaccttcaaggatgtgtggaatatgtcatgttttttcatagctttaatctagccaagttttagatatttcactttttaaatcttctcttagacattaggctttccatttccttaatcattcccacccccctgattttttctggatatcttccaatttgtctgcattttcatgatattgaggtgccccaaacaataaaatattcaaggaacagacacatatagactgattctatgatgcagtgtctttatttattaaagctgtggtatttatccactcatttattcaatttatttagggagttcactgtagttgcatacactgtgttagatagacaatggtgatataatataatgggaagtagagatagatgtgatccctggccatgttacatttactgtagttggagaaataaacctttaaaaacaattatccacatacatacaaaaatacaaaatattttatgtatatgaaggaaaagacatgattcagggaatgtattactaggccacctgaccaagtctgagagtaatttcttcagtctatgaatgctcatttgggtttattatgtacatattgtggttgtggcctttctttatatgtaacagaacaatgacacggttgttgcctaatatagaagtatcaaggggtagcttatgagaatttatgcccaaacaaatgtttttgtaatcttatgtgaagtatgaataaatatct

SEQ ID NO: 115061 - DNA, 1051 bp, Homo sapiens
tttttatatgtgtcctttccctggaatttaaaccatgctaccttatgaatcttactcagttttacattcccaatgttgtaaaaatgcacataatagacttttcttgccaaactttcttagaggcttcatttttttttcttcaacttttattttaacttcaggggtaaatgtgtgggatgtgcaggtttgttaaataggtaaacatgtgccatggtagtttgctgcacagatcatcccatcacctaattattacatacagatatggtttatttttaacagcttttttgagacaaaattcatataccatacaattcacccatttaaagtaagcaattcaatattttctagtaagttcacagttatgcagccatcaccacaatcaattttagaatattttgtcatcctaaggagaaaccccatatgcattagcactcactttctctcctctcccgccctcccgctcagccttaagcaaccactaatcctctctctgtctctgtagatttttgcttattctgaatattttatatcagtgaagtcatgcaatatatagtattttttattggcttctttcacttagcataatgttttttcaaggttcattcatgctgttacctgtgtcagtactttattcatttccttgctgaataacattccattttatggatatactacctttaatttattcatttatcagttgatggacatctgagttgtttctgctttttggttattgtaaatactgctgatatgaatattctcgtacaagtttttgcacagagatgttttcatttctctttggagtgaaatttctaggtcatcataacagacctgtaataaatatttattgactgaatggacaaagaattattctccaagcaggtcatgagaacatttaatcttagagttaataaattcagatgaaagcaatgaaagctcttattttttcctacagtaatacctggcatctccttcccactggcacctgcaagtatgtgccccaactattacatttccctgcccaatacacagatgaataaatgaaactgca

SEQ ID NO: 115062 - DNA, 1600 bp, Homo sapiens
tctgttccccccaaaatttagtgattgtatttctttacatcatactgtagagagttgatgtttgtgttcactccactaacctcattccactttcccctgccagtatacttcagaatatctcagatccaattcaaaatttaatcttaaaaggtataattattttcacagtttcatagtttagttttgatcactgaaagcatttctttcattttgtctaatcgaacaaatttatgcaaagaattggggacttattcctcattagtattgttcatctataggtggaaataagttcaagtatgtgttgcagtattaattaaaggcaaagtgacctacttgtactatattctgaataaatacttattgaatgaatgaaaaatagaagagtgactcaattattttagaatcttaagttatacagatttatgtaatgtctattttgatttttattaattaaccatgaatttatcctactctagtattgagaaaaagaaaatggaactatagacccttctttcatatgatacttaggaatgtatctgcactgtatccagaaagtcagttacatgccctgtttaccaattgaattctgcttcactaaggataataataactgacattgagtgcatggcatatgatgggcactgtgcaaattgctttgacatgttttgttcatttaatccacacaatggtcctatgctataaaaacagttaatatctacttttttaatagatgaggaaactgcagcttagagagattaggtaagctgccttaagtcaccctgcctgtaagtgtttagagctgagattcacattcacggagtcctcctgaagaacctaggattaaccaccacgttgaacagctttggcctgcaagttacatgcttcttagaaaatgaggctattatctataatctgtattttttaatatcaattttattcctttcaactggtcagttatatcataaattccatggaatttttatggaatccatgctttgccactcttgtatccctatagtggtgctggggaatcaagacacatttatttgccttagcactctttctttctttctttttttttttttttttttgtaattttacttataaattgggagggtggccataaaatttatcatccaaccactgaaagtgaaagaaggtgctatttatgatttccccaggacaacaggcagaaaatagtctctggtcgtacatttagcctgcagagagaatttaagtacattatggatagtctgccatagacacagcagtagcatctgcaacaagtaaatgataaacaaaaatcaactttcagggaaatagccatttttagtagtaaacatagggaaatagccattttaagtaaatgtcaggagagtctcactataaactgcctataatgagacagtttagtaagcttaaagttttattaatttccaaaagcatctaataggttgagatttattggcattcaaaagtatgattcacagattgtaagagaagctggcaaagaaagtcatgtttttgctggcctatggaatgcactcgagaattctttgggcttgcatatcttctgattcatgtgtcataataataatgt

SEQ ID NO: 115063 - DNA, 3951 bp, Homo sapiens
tttagttccataaaagatctggtcatttatgatgtgctcaaatatgcttgttaacactattataggggaaaatatacagtatagttatacaaaaataaatcattttccaccagagggcacatagcaactaatctagaagtaaatcttttgcactggctacatattttattttatcaccacggactagtttcttttacaatttttcatgtagctttatttgttttcctctaaaattttctggattttctgttattttagtttcatttattcccatatatttgggggtataaacttatgcatataagctaactttctttgctgattagattcaaaatttttagttcatcaacattagagtaggagctctgttttggcagtagattggatccctcacttcccagtattttttgctttgctaaagtgatagtaagttactataaaataaccagaacatactaattatatttgattatgctttatttaactcaggagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttcagtatttgcttcttttactttgaaaaacacatagaatagtataaaggtccagtcatattttctgtaatagtgaattagtgtcttgtgagcaaaatgagttctaattcctaaactattacacagattacgttgctttcaacttatttaaatttcccttgttcttcatgtttcatggacagtacaaatgcaaaccttatttttatcctttattctaataacataatgcattgattttaaatgtaaagaattttaggctgcatggtggctcacatctataatctcagaactttgggaggccaaggaggatggatcacatgaggataggaacttgagaacagcctgggcaacatagtaagaccctgtc

SEQ ID NO: 115064 - DNA, 1052 bp, Homo sapiens
tttagatgtttgtagacattattcagataatcatgttgactccattcacataggctgctaaaataaaccaatatgatatgagcttccaagttaagggcacaaaataactacatcagaaatcctataacaccagatagagaaaagcaatgttgtcttagaatcatagactcccatagttggaagggaattgtatctctcccaagagaatcccttctctttctggagaacatagatatcttatttatgttgatttgaacttttaatctttcctatttccacgtattggcgtttttcttgttcttagcatcatataacaaacgtgacagtcattgacatatttgaaaacagaaccttgctcggattcctctattctccgagctctgcctcccactgtctctaaccattcttctgagctcacatttggaagttgcattctgatttaaaacacactctgaaaggatggtaccagaacagtgtggaatggaccatcacttctgaacaatgtaaaatggattcaatatatagtgtaaaagatgaattatttttctgaaaattggatcaatgtacatcattttgctcatcttgtatagcaccataaggatcactgaaggtgtttagtttttcttcaggttatttcactatctttagattgtatacaaatatcaagggcacttgaaatcattcagaacaatgagcttcttgatgtccctcaaaccatttcttgcaatagttgctgaggtgttttcttagtggccattattctgcttttgaagagtacacacaaaagaaaaacaagcactcgtgggatttctttttttttagaaaatattaattatcagttaattgtaagtaacactgtcttataatatgcattatgatttgataattgacgcctgcccccaagaccttgaagggcaaggtattcattatgcatactggttatttagtttccgtcaatctttagaatctgaggcccacatttgtagtcctgctctgataaactttgggtggaaaaagaaccatttttaacctctatttcagtgtaataagca

SEQ ID NO: 115065 - DNA, 2043 bp, Homo sapiens
tgcctgtgcttgtgaaggaaaaagtactttaaagcactaggcaaggataggaatgtgagactcagatgattgggatttttctgtttttaattcttctataatatttattcatgatgacctatttgcttctttgtagttttaaacattcactgctaaatccttatagcaatgtatatattttttctttgtttgctccctgggagatcaaactctgataagacttaagtctgttatagataacctctcacaaactttaatatgcctttctctagtaagcaatattgttggcattatcttatagctttcactgaaaaactatgtcatgtatcttttatgtgctatgataggaatggattttaatgtctcctcatattaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcaggtgggatttcttttttttgttttttgttttttttagaaagtattatcagttaattataagtatcatttacttatgatatggattatgatttgatacattgcaatgactttaggatttttggggaaaatcttcattttcttatttggagcagtatttaggtttacaacaatggtgacagtgagctggaaacatatacccatggtcttcctgtttcaattcctgaaaaaacttagtattaaaaatgccttttttctttctcttcccccaccacccccctctttttttttttttttttttttttggtgctactggtacctaagtaccaattaggtgatatgtattctggcactggaatattagaaaaatctatgatagcttaatataaaaagtctaaaagaaacaatttttctttcacttagattatcatttaaaaaaatattttattaaccattccagagttctcattaaagagagaccatcctgtcatgtcctatttttgcggcctgtgcctgatgggttacaggttgataaagcagtaatcctctagaaaattgaccttacgtcctgtattctttcctgattttatactaaatttttaatgatttaaataatgacaaactaagcagtcatgtttttgaaaataccaggccactaaactatgtttgatcagaaatgcagataaggtctgtagtgcagataaaggaggtgtaggtgtttaaggtagcatgtctctccttcattccaaacaggagaaacagcatagtacttacttacttaggaaggaggtttaattgagcatatatgttccataaaagtgacaaaccaacttcacagtcaaattcttcttttgttacacagatgaggggaaagaatttgagcagattgaacagctgtaagtattattttttacagattaattttcacttgggtaaaatacagggaaacataaaattgaatgaaatgtttgcagttagggggagaaaaggcagaggagtattttctgtatatgtccacgtggtggtggaaagtggctttccaagtctgcctacctgcgtgagaattcttcttcatcacttactacctgcacttctctgtacttcagctttcttctctacaaaatggatttaataatagtactcaccatatgaggttgttggatggaatgaatattatatatgtgtaaatgcatagcataggttatggtgcacagaaggtgtgcagtaaccatcaggaagtatttaatattattatttttaaagcaatagttctcaagcctggcaatttttgatcacttaagagcctctttaaaaaaatacagttgctcagaccttgctgaatctcctggatcagaacctcttgggttggggctatggcatctgttatttcttga

SEQ ID NO: 115066 - DNA, 2357 bp, Homo sapiens
accttctctaactctttgctggcttttcataaattagtatcaactaaagatttcctatcctggaaattttatctgctcactcaaatgctacctgaggttaaaactttgaagaaaataattactctaaggtaacttagtaggtgggaagaaagaacaggggtttgaaaacatgaagcctctttcttacccaaaacatttaacttatccaaaaaggaacaatacttttgttgttaggctcaataatagaagaccttccatttctatacattggagacaattatatcgaatctatctactattattattactactaactacaccctaactactataaattagtttcattgatatataactgaaagtacttaaaataatgtaatgaaaaaatgaaaggagacaatatttgcacatttaatacatttcctttacctaaactctttcagtaacatacatttctctattttattctcagtccctgaacttcatgggaaaaacaagccattgatctcttacgtaggggattctactgtcttgacatgtaaatgtcaaaattgttttcctttaaattggacctggtacagtagtaatgggagtgtaaaggtaagatagttccttgatttgaagaaaacaacaacaacagaaaacatttatttaaaaaataacaagattgtaacagactcagcattcctaagatgatttatacttttgttatcttgttgtttagcttatgttcataaagaaagagcagtgacaaacagagttgtcatttgatggtttttggcatgtttacgttatacatatgaagatactcttaacgtttcattagctggtagtttgttttttaggtttaacaatttaattacattctttgaaaagaaattacattttgtgtgtagttgcctagtttagaaataaccccattagaaaatattctttttaaaaatcattccatgaaagtaactagaaaaaatgctagacatctttttgggcttctgtctcctgaaacatctgtgatagaatgcaaaatagtggcactatttgagaaaataatgaaaactttgtaacttaatcttacatcttaggttctatcagaaagtgtcattggccttttcaagctacctgagagaagccaaatacttttaattccttttttactgagagaaatcgctattcaaagagctgatattaagaaaaacatgagtattttataaataatttctggtttcctttcttctccccaaatagcctctaatggcaggaaaatttaggacattgtcctttaagagacacccttcctttgccctggcactaagaagcattacaattaaagtcccgttaaaggcaagctataattgtagaaggaacatgtgagacagtgtagatgttacaatgaaatattaaattccttcttaggcaaaattggtgttattatagactattgaaggatgacagatgattcagaagggagtgtgacttattctgtgctaacaggtttagtttttcaatgaaatagttccaaccaaatcccatagatgcagactgaagccattcctactcctttatgtcttctgatggatgatgaggaaaggcagtcattgtgtatatgtaatttttttttaaaaagtgtaattttgtaaaaacaaatgtcaactatggtatttgaaatacacagctttatttattgatgtgtatgtggtacaacaatatgtgaaaaacattagccttcatctaattatatcagatgttgaaaatgtcgttttagacgtaccagtgcttttgtccattgctatactagtcattatcctcttaatttgactctaagcatgagtcttattaggatgtgagaaaagtttggggaataggatgcaggtcaaaacttgagcacaagtgccttttcaaaatgtagaccaaccatgtgcatcagaatcagctgggtacttattaaaaatatggtactttgattgattagctctgaccaatctgtaccaaacattccaggcagtgttgtgcacatggtgccaggttgctgtaattttttttgcacgaataatatactcacagataattattccttggataagctctgagaatatttgtatgcagattagcatttattgaatagcacggttgagtgatggagcaggaaaagcatcaaatggcttgggaataaaatttaatttaaatagattaaataaaacagccccaaatagcttaatatggcaccttgtgaggctgtggaaaacccagcaaatcttagaagccagcttatctgagtgagaaagaaattcagatatgaaaagacagaaggtgtgcagttcacttcggatcccaggctcacagagggtcccctccattct

SEQ ID NO: 115067 - DNA, 1142 bp, Homo sapiens
acagcaaaagtgtacactggaagtttgtgactgctaataagttgctgattacttgccacccgagaaagagaaagatgagtgatggtctatagtgtttctcagtagtggatcaaatattctgagtggttgctgaaagcttccataatatttatcagtgttaaaatctcttagtagaaagtatgcagaaatttaattggtaaagaacaagaactttttggaagtcatgatgagattttgatagtaccaaatgtagtgaagcctgtcaaagctcaactatctgtcttcccctggaagtatctaaaaatataaagtatggaaaggtagcataatagaatcagctaggacttcagccctggatcccagtgttgaagtatagttagcattcttttactacatggagtaatcttttttcctaatttagtggtacctaaaagtctttgaaccaatatgacatttaggccaatttgttctagttcatgaatatacaaatatagtctccaattttacaactccagagagctgttactttcactgggtatatccaaaccccatcttcctagaaactagcctgaatcagcaatttcaccaccttcaaacctggtttattccaaccgtagcactcgtatgcatcctactttatgcaaagtcttaaaaggtcgacagggcacattagaatactgtctcactgtccttatattagtaaatatttccaaatataagctgtggccctgaaccccagaatagttcaaacaaatgtcatgttccctgaacatagtgcattttataatttaaatccacactgctgttattagccatatatagcagaacaaaagcatggtttatggtattttagtcattagtctaggggataatcaagaaaactgaagagatggcaagaaaacagaattttggtttcagcttttccatgttgtcactcagtcattgtcagctacctgcaatttacagcctgatcttaatatttagttgggatggtttaataacatagtcatgtgttcctcatcaaatctcagaatactcaactttcttgaaaagcgcctcgcagcttccattatgcttcccaagcaggtagctcttcaaggaatactgaaaagcagtgtatattctgccaggtttttccccaa

SEQ ID NO: 115068 - DNA, 2584 bp, Homo sapiens
taatatatcactcaaatccatgttacacacaaaacattctctagtagttattagatccataaaacttaataactactaacaacatgattactcaaaattattgaaacaggcattccattctcacccatgagtgtgtgtttgtatttacagttgtgctgtttttacactgtcagagcatacggcacatgttatagggtactctctaccctatattctgctcagtatagagcttaaggagataactatcacagctttaggttttttttaattgtgttaatgttgaatcaaaacttttctttaggtgtgcatataaaagggaataagaaagggaaccaactatgttgatagaggaataattcttcaaatgaatgttacattaagaaattgtcaatgaaacactgctgttaataatataaaaggttttatgtgttagattcctctgaatataactttcacattttgtcctcttttgtgctaatagaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggtgagtatacaaattttaacctaccttgctcaccaaaagtagcttaattctaaatatttttgctgactgagcattctttcctctgcagccacttgaatgttatgctaatattctaatttgcatatttacagaattatttctctttttaaatttttattaatggctaagtcttttcattttcattaaggttttgagaactaagcctatattaataacttgaattatctttaggttcaccatcattaatagcaaacaaatgggaagttattcttgtttctttcgagaggaaaaggaacaaaggggaacatttaatttcaaaggtcagtattaataacttgaggaatagttaataacttcagcattatgttcttagatttctcaatcctgtaattttaaaattatttttacaataataaacataatgtagctgaaagaaagtcatatgctttccagagccacaagaggcagccttgaaaatggtcttgtatcccccaagtccacttccttcctgcttctattcctcaatttaaagcacatgttttagttcaaaaggccagcctaccacattattagtgaattatatcagttgcctgaatttctttatttatctctctaaattcatagctcttataatagtcctccacgtttctaagttattgtggtcccagcctctgagagtgtgggttgatgttctatatccatagctccaggacatgggattttaggatccataaaacttaaaaataatatggagatgcacaaacggttgcctactttttatctcaccaagtaaggaggtttaaagatatatacaagccacagaatatcatccacatttcttttgcttggaaacaaacgaattaaaatattttactgttaccatcattaaaccaaaactcaagaaggtctcaatctcataataaagactagttatttgagttagataattatcattatgaaaaacccagtattttgtggtgattagtgaaccatattatcgtgctggtatttgggaaatgcaatctgtcgccatattaactacgtcggactctgctttgcattaattccccaggaaacatgaaaattgttgtaacttttcctaaaactcctaaagcccgactgtctgctgtgacagaatgtggatgctattctcaaggctccatcaatagcagaatggcttgcttcaccattgccatgatctaatggttcactcctgtgtccctcattgcatcccttctgcactcacagagtcattttatttttatgtctttgtaattgttccaatgtggtgaatataataaattcttgtatttatatatcttggtctctccaaaagcagaaactagtatcattctttgattattttagtcatgtatattctttcttaacttttttccctccatttgcctttaacttggtgaaggactagataacaccatatacatttcctttcagtttccttttccttatgcatttcatttttccctcccctgccccatctgcccttcccctcctctttccttaatctctcttttcctttccctttttctgtcctttcttccctcccaccttttgagttcatttccttccttcccttcctgcctccttccttccttttttcctccctttctctttttcttcccaatgagcaaaaaataatactaaacacacaaaatttcagtgaacatgttttattgagtttttaaaaaatatgtaaagaaggcctacagattctgaggaaatgctcacagaatcttgtgacttaaagtgctcccaagatattcaactttaaacacttttttctttttttttctaagacattgtgctctggaaatatatactagtcatacctgctttcaatattgaagataacacatttttctcattagttttgataattacttaaattattatgt

SEQ ID NO: 115069 - DNA, 1102 bp, Homo sapiens
ggcaaagcaaagaaagattaacacaagttgtctggcagctggataaaaccttacacctgcgcaaaaataagcctccctcgtaagaaagcccaaagatgtccggggtccgggaggagaaaagtgtttctcatctgtcccatcaaagcaaattagtgaaacctgcctcaggtgaagtgcaaaggccagtctgtaggcagagtttcgacctctccccacgagattggctagacatcacctgcccaagctctctcccgacctgctagagccgagagggcggaggccggagaggctgcagccgggaagtagcaccgccaccgcacatccgggaacgccagcagccggctgagggctgcataactgatggagggccgggcgcggtaagagcgtctcgggggagtggggcaaggcggccgggcccctcccattccgccttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccaggtgtgatgggtacagggtccagggtagggagggcggagggcgcgcgaggctcgggtccccgcgggcagagggcatcgccggcgcgccgggcaagggtggcggggagaggcgcggggatgctggtaagggcgggtgggagagtcggcggcggcctcccattagctacgtttgtgtcacctaagctgaaccctgaaactgctgcggctcgcgttcctgcgctctttggggcgagtcttgaacgaacagcgccccgcgagtcgggcgcgtaggtaacagggcagagtctggtttttcctaggaagaaggcagtggggtgtgtgggtggttgcagggaccagctagcgacttggcttgggcaaatatggcatgaattttgaaagccacatttccccaaggcctactcccttttcttgattcgagagt

SEQ ID NO: 115070 - DNA, 1090 bp, Homo sapiens
ttaaaattagtgaagtaaactagactaaatagtcatccatttttaaaagtccaaatattaggcattctggtgagaaacattagtctttgatggttcacttgttcaagaaaatagtgggatttaagtcttaaatcattacttgtcctctttcctttataccaaggcccagaagtgccagaatcagcttctggaaaaagtaattgcactggtttaggggtgaaaaggtagtattttttatctgttgctactatgctgaaaagtgaacttacctttaaatggttttcctctttgaaattctctgagaggataaagcttctctgtagcaaaagccaagtttcatctaactattgattattctgtagataacttcattcacagttgggagacaagataataagtttaaagataaaaacttctttccttgagtagcctgtggtttctaatcgtaaatttttgtttgatcccactattgtgggtcacccaaattatttacagccatctatattatcaatataatgaaaacacaagtgtgctctgtggaataaatctgtaatgcagtgaaattggagacttaatttgagcaactacaaggaaataaacatactgtgatctaaatttactaaacaatgctttaaggcaagtatttaaattggtaagaattggattggttttctcttaactgtttgcagtctcttgactattgcttatatttaataactgaatatttgtgttggggcataattactcaaaattacgtttttcttcctgcgaatacaatgttaatgtagtaatgctaactcagctactctttcataaacttccatgtctttttttaatctggcaaaagccttctctcaggataatcattatgctcggtaatcctcaccgtcatacttgaagtagttaatagataatcctccaagcagcactccagatccatctgagtacccagtaaaacacttcttgatgctattggagttttctgaatttctttatctgggagacaatggaaattccatggagaatttcttctattagaatgtatattcaaatcttacattgtttgagtaccctcttctaatcttaaata

SEQ ID NO: 115071 - DNA, 1016 bp, Homo sapiens
aagcactgaggaccaggctctgcaggccaccctgaatatagaagagtccctgtcctgaaggcattcacagagcagggatgagataaagcagcaaacattatagtataatgtcataagtgacaagataagtgcagggagccacgggagcatgcagggtgagaaagaaacaaatatggatctggtggtcagaaggagaagaaagatattttggtataaggactgtttaaaacaggaaagaaggaggaacaaggtttttttttttttaagttttgttgctaacattaggcttgattttattgtgtttaggagattttttttttatttatgttagtggcatgaggtaaagtattataataaactcaatacagagatgtaataataacaactaaaatttattcagtgtttctgtggcaattaaaagagtgagtataagtgccagatggcttgactttcaaaaccactcatgtcagatatttgctgtgttattaggtttaggtatattaattgtgctttattttccccatttataaaatggctgtgagagtcatctatatgttatagatctgtggtgatgtttcaataagttaattatccaaaggacttacaagagtgcttattcatattgagtgctcaataaactttagatattattattattattattattttgagacagggtctcactctattgcccaggctggagtgcagtggtgtgatcttggttcaccacaaccttggcctcctgggctcaagcagttctcccacctcagccctccaagtagttaggactacaggcatgtgccactatgcctggctaattttggtattttttgtagagatggggttttgccttgttgcccaggctgaccttgaacttctgggctcatgtgatttgctcccctgtgcctcccatagtgctgggattacaggcgtgaaccatcacacccagctattattattatttggataatctcatttaattttttcattaatctgataatataatgtggtagaca

SEQ ID NO: 115072 - DNA, 1033 bp, Homo sapiens
ttttttaaaaaaaatgaatattaaatctttatcaaactattgtttggcatctgttgaggtgtcatatctactttttcctttaaacaataaagtaacaaattgtattagcaaataactcaatgttgagctatgagaattatgtgttttgtcatatactttagcattaaagaccttaagttgctgaatgaattaaacaactctttgagcatttgctagaacttgcaaacaaatctgtctgagctttttagggatggttctgggtcagttgtcttatttttctgccatgattattatctcttctgtttttctgtttcttagtcattttaaaatatgtcttcttactgaaagtttctatgttggtgaaatgtccaaactttttagcaaaagtatagtatttggtccgtaattgtaaaattcttccatgtctctggttatttctcctggcccatttttattgttcatatttgttcttgttcttccgtccgttggtttgtcttccaaatagtttagccatttaaaagattctttcaaacaaatagctctctttaatgttgcattcaatttctaaatgcagtaatcttgatactacatttatgaattctttctaataatataccttaggcttcccctctgcctacttttcctggattatttggatcagttattaagtaatcatctaagtttgaacatatgaaattttctttgctctatgaaaatatatcagtattatcctccaaagtcaagattacatcattctagcttatgtccctaggaacagatttgtccttttataattgtgatctattaattaacttgtaccatctattgaaatttatttcatacttttagtgaaatgaaaatttagagggcctttgttgagtcagcatatataatagcatgtatataaatgaaatactaaatgatatgttgactgttcatgattaagtgaagaaatagagaggccttgtgatttacttgtacttctttgtagattttattttgaagacagttttttttttaatgtcagagaatg

SEQ ID NO: 115073 - DNA, 1048 bp, Homo sapiens
tcaaaagttctcatatgtttcatatttattttcataatttgattatatattattgcatttaaagtttcttttttttcataccattgtttagagttggcaggggaagtgagaacagcctgggacaaataatgctgaggagctttttaataaaattgaattagtataagcttgccaaatgttttatcagagcaaaactgaaggtataattgattatacataagtttttaatatacatcaaatattgaattgtgcatttcctgtaaaatcagtgaaagagaacttttaaaacaggtgtgctgctgaatacactcacaaagccatttgtctcccactaccttttgttctggggttttactgcaccaagatgttttatatataaaatccataatatatgctcaagacttgcctattatagtcacttgctattttagaaaggtaaaataatttgaccattaaattgttttcttactttattattttaaggaatcaagacagaatagtacagtggaggaagattctgaaggtgacaatgattccgaagaattttattacggagggcaggtaaggaaacctggtcttccaaatacctagtcttaaagttctaatagccatgttgtcctagtggtaatctgtgcctgagagttaagggacctgtgtgttgttcagggttctgtaactaactagaaaatctatataatttatctttgcacattttctacctatttttagaaattaaggttcccctgcagtcctttcaattgtaatcatttatttacattgaagtcatcttaattcattacagcgattttgcagatagtattttattatgcttttgacttgaatttcttaagcatgttgtgttcagtcactattctgagataatgacacttgtaataaaagtgtatattgttagttttaaatagaagctggttaacctttattaaatttgatgggcccacattactgagcatcttcatcatttgtttatttgtattcactgccattgaattcttggtgttgaaaaattgttatgaagaatcatcataat

SEQ ID NO: 115074 - DNA, 1032 bp, Homo sapiens
gtagataagactttgaatatatttgttattattttcttaggattaacttctgtgagcaaagtgtggttgtagacagggccccttcacactcctgaaactttacttgaacatcattcatcatctttcctcatcattcagtttagtggctctttctttttacatgcctcacgattttatttattaaatatttgccagtgttcagggtcattcaaattatgaccattgggctgtgaggtttgttttgaacagatctgtgaactacaaatggttttgctttttaaaagggttggagaaagaaaagagagaaagagagagagagagcaagagagaagaaaagaaggaaagaaggaaaaaagaaagagaaagaaaaagaaaggaaggaaggaaggaaggagggagggagggagtaaggaagggagaaagaggaaagaaagaaaagaaagaaataacgaaagaaagcaagcaaagaaagaaaggagagagaaagaaaacgaaggaaagaaagagaaagaaaagaaaagatggatgcggcagagactgtatgtagcctgaaaatcctaaaatatttactctctttaccttcacagaaaatgtttgtggtaccctgaactagaggcagagatgaaagtgttcatttgcttggcccttattcttgtcatactttctgtatactttcataccgaaatttgcacataatcttatcctttaagattaatgtttatcatgtagtacagacattatagatgctttgatggtttttaaaaattaattcctatgtaaatatttattcatttatttatgtaacctataaaaatattaccatgaataaaaagtgcaatttccttaaaaatggaaatgtgctctctctctctatatatatatatacacacacacatatatatacacatatatataatatatatatattcatttatttattttttgagatagagttttgctcttgttgcccaagctggagtgcaatggcacgatcttggctcactgcaacctccacctcctgggttcaagcag

SEQ ID NO: 115075 - DNA, 1097 bp, Homo sapiens
gttttggtctttgtattattaatttataggaataatttctatgttctggataaacatttgtgtctagtgttatataacccttctttctctctttctacatatgtatcatacgcagttttctccggtaaaggcattagttctagtgcatttcggatttttctacatttttgtagctagatctcttttgtttctctgccctcatcttcccactttttctgtctgcctctgaagagactgtatcttcttaaatcttcttagagaaaatacagtgctttctcatttaattccactgaggttttcaagatgttagaatgttcttattcacttttgaattttgatagccatgggtttaggataagtgggattggagtgatgtttactctataccttactctttgtacaaggattagggagttcttaggaaacgaactaattttttggggatacaaacacccaatttccttgattgatggagcatttgtgtcccagagtagtggccaacaggggataccatttggcttacaatatagagcatgtgtgatctgagaaggtcctatgagcaacacaatctttgctctaattatctgctgccccacctgttgctgtgaatggcactatctaagctcttatatgtcatcttttcatttgcacactagtctctgttcgctttcacctaattaggacaccatcccagcaattcagttctcctcctcctccttcttgtactattcatttctctttttctcttagaagattcacatcagcaaatatttctcttgtcttaaaaaaataaaataaaaaccctcttgacctcaaatgcctcttcagtttggaccctaacactctgcttcttttgactgttaatttccttgattagagttgtctctattagcttacttcattttcttttttcttttctctctttgaatccactcaagtcaggttttggtcccatcatttctcaaacactgctcttgtcaatgtcatcagtaacttcattcttgccaaatgactcataacctatttgggttttcatcttaattaagttagcagtatttcataacagttgtttacctcctccttgaaaatcttttttt

SEQ ID NO: 115076 - DNA, 1048 bp, Homo sapiens
acggttcttaccaagattcagctgttgattctgagtaagtactccttgggttgctgcaagttttaaaattaatttccagaataccaaaagagttgactcaggccatttttgccagtttcttttaaagattttatagagaggtggaagtttgggttcctcactcagcttttttgctgatatcattccttatttcaaagttttaaacaagcaagttcattgtaccatatctgcatagtattcaaggtccagcttttgagttaagaaataataaaatatagataaatatgaaaataatgattgagctaatatctatcatagttaacagaagaaaggaggttattgagggttgtgtgccaggcactgtgggtagatatttggcctattatttttttatttgatcatcacacaactcttgtggtttaggtacttttgctttcatgctgcaaatagggagactaagatttatagaggttaagcagtttgttcaacaccacccggaaaatataggtagaagtttggctttgaacctaattctctctgactttaaaactgcatcacaaacatttaatttaatatttgataagtagaaggcaccatgctagattctgttacactttttaaaagaaacctgtcttgccttttggaatatatgtttgaaaagataaaacacaaaacttggaaagcaataattttattagaccttttttgtatttcaagatttatacttttaaaaaacatgtcttgtagccatttaagaacacaatcatctgtcagatattttattttatttgcttaagggaaacaatccgtgtactatttttttgccagtcaacttttctctcagagatatgttattctgaaaccaaaatcaactaaatcagcatttaattatgaaataactgcaattttgtcatttccatttgttacagagaaatgtgtccttatgagaatagggggatttctctggtcatctcaacctgccccacttagatgctatgttttcactttgtcagtactcacctgttgatattgatctattgcttgttcc

SEQ ID NO: 115077 - DNA, 1021 bp, Homo sapiens
gcgcacatatttagatcttgcttgaaaatgaattgtcagctatgtgactgtatgctatcatttgtatactgtcaaccatactcttgttaacaatattcaactcaaaataaaataaaagcggttgtgagatttgaagtgggtttttgtattttaggattctatgttgactttattcattatggcttagtgttttagtggtgaaagcctgaatcaggagccccataacttttttgtgtttctagattttttccgccatggcttatagaaggattggcattgttttctttgtttcttttctctgactgaagtcctggagccatcttattatagtcttcccttttatgtacaccaaacagtcatttctttcaaattgaccccagtggaaaattcacatatggaaataatatatttctctagtgatatacagacttgcaagagcttataagcaaatgctgttttttaacatcactttttcattaaacagaaaaagaactatgatcgagtaatgaaagcactggatagcataacttctatcagagaaatgacacaagtaagtatgtcatctggtcttgtacagtatatttttaaaatgtctgagagttctagctatgtagtgaaatgtagacttctctataatacatatcatttaaaaatttgtgcggtattaagatgttttaattaaatcacatcagtgtactagcatgtaacactgtgacttcaggaaagtaagtggataattataagataattatactcctaatactctgccctcaaactcgggcaagagcttgggtacatgtaggtatgtcgggatattttaaggcaaaggttaaatctggtaccattttcctagactgtcaattttaattgatggtagcaatttcaaaacattatttgagtattaaaaacagaaatgttctttaaaatggaacttttccataaatattttatataatgcaaaatcccaaaaccactttggaagatgccaggctcccggagagtatgggtttatgtttttggt

SEQ ID NO: 115078 - DNA, 1049 bp, Homo sapiens
tggcatttacagagtaagctaaaatttgtgaatattacagacaaaaaaacttacataatttgtcttaattagaagaaatgttaaattctgcatagaatttaagaacaaataacaacaaaagttcagttgtaatgtaaaaatatttttctgacattgttcacatttcccaccctttattttctccttctcctagccagatagtgggaatgaaagttaggttctaaaagccttttaaaatcaagttttaagaatttttaaattatattaattttatgcagaagaattttcgatccttgctttcaatgcaaaaaaataactttcccaggacttcccaaacccactgatcttccacctcaggggctaagggcacagccctttgttactgtctctagcctaatgtgatcaaacctttacctagaatggaactttgcatagtaggtcgattgtactttcagctgcatcagacagctttgtccctaaattattattttgccgatgttttcagggatgaacaagaaacagaaggtgtcagccaaggacgagccagcttcaagcagtaaaagcagcaatacatcacaggtgttgtagtgactttagtgactgcttatgattagtgaactgtggcctcatcagccagcagagcatggaaaaataggctttttaagtctgaaaaattatttaatgtggtcattacttataaaggaataaaactcactctgaaatgcagtaactgaattgcctctatacaataattaatcaacagatatttatttatctcccactataataccagagatactcctaggcagtagagtgtagtgatggccaaaagtagacacatattccgtctcttggagcctacatcctactgaggggtataaataaattaaatacatatttagatagatagaatgctagatattatgaagaaaaataaatcagggaaatgagacatttaatgctgtcaggtggaagagggatctgggatgaatgttaaatgggatggtcaggaaaggatactctgagaaggtgacatttgagtcaagacc

SEQ ID NO: 115079 - DNA, 1047 bp, Homo sapiens
gaggcaagagaattgcttgaaatcaggaggcagagtttgcagtgagccgagaccacgctactgcactccagcctgggtgacagagcgagactccatcttaaaaacaaaaacaaacaaaaacaaaaatcactatatttttgactaagagaaaaactacaggacatactgtagtaatagcaatcacaaattttttggtcaaaattttctccatattttggaagaatttaattctgcttaacagcagtacattggatcaacggtgtcattcagtggaaagtagcggctaatttccatgcattagctacagtttttccctgatctcttagagaggtgagtctgataaccttcaaagcataggcaaaatcagattctttaacaatgtttagtaatattaaattatcttcatgttagcccatgtttacatgataccaaacagatcatatttttaaggactattccagcatcttgaagcaaaacagtttctttcttaaaatgagaaacagagcaatacacaaaagtaatacagaaaagtttatttcatatatatacatcgaagagtgtatacgctctgaacctctagtgttaaccaagatcgaataatgagtttgatataaaaaatttttcattttatagaaacataatattttggagctttggacaagggccttactagcctggtgaatttttgtctcattggaatacatacactgatgttttgagcacagagtaccttagcacctctggggagtttctactagctgcgaggtatgaaccaatatgataaccaaagtccttatctaatcgaagttactggagaggactgtggcccacatgagttaaaggtcattctgggagaataactggtctccatgaaagtgaattgatacctagttctgtataagaacccccaggatctctccttcaagatgattactgtcctgactttgactcatcctggtcaattaactctgggaaatggggaacctaactttagagggaagtgttggaaaacacccccaagcaccaatacccataatatgaggtcta

SEQ ID NO: 115080 - DNA, 1054 bp, Homo sapiens
attggtataaactactcctaaagttttagaactgggaaaaataagaagagaaagtctttacttagctgggattttcatgagataatgaaataaaaagagaatgttaaatgtctagcaaatttatggagtaaacttcgctgaaacatatgaagccttactagcgcttttggctttaagcctttgtgagctgattaatgggtgttctaggagattattttgcctaacttttgtaattgtgattctaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaactgttacagtacatttctcagcatccttgtgacagaaagctgcaagaatggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttg

SEQ ID NO: 115081 - DNA, 1032 bp, Homo sapiens
gagaacgatggtttccagcttcatccatgtccctacaaaggacatgaactcatccttttttatggctgcatagtattccatggtgtatatgtactacattttcttaatccagtctatcgttgatggacatttgggttggttccaagtctttgctattgtgaacagtgccacaatagacatacgtgtgcatgtgtctttatagcagcatgatttataatcctttgcatatatacccagtaatgggatggctgggtcaaatggtatttctagttctagatccttgaggaatcgccacactgtcttccacaatggttgaactagtttatttggtttacagttagtaatacagttaagagtggagaccttccttgagttttcattctttgagcttctttttttttaatagaaacagctttcgatggtaaccttaaccatgccttccataactcaaaacatgatggactcttagttaactctatgtaactggattttgtttttctcctaaagttgttctacgctgctgcgtatcattcaatgttgatgtgaaaaattcaatgactttcagcggcccggtggaagacatgtttggatatactgttcaacaatatgaaaatgaagaaggaaaatggtaagccagtgggttttgttgttgttatttacttatttcacaaggtaatgagaaatattatttgactacagtttcttttatgaatgaaactttaacagaatgaattatttatggtagaaaatgcagtctagtcatttggcaatggaagctaacttaaagtaaaaaaaaaaaaattccttggcaatattagaggaagcgattagtgatttctgttgatgcctggattgacctcaaggaaggtctgtatccaaaaaagctattgttccataattatgttttttggcaagaattctttaattgttctcatttcagagtagcttaaatgcacttgtttgaaattcagtaggaaggattcggaggcaaatgagatggtgctctgaaagggtttaacacacttccgtgag

SEQ ID NO: 115082 - DNA, 1037 bp, Homo sapiens
gtgactcacgataataactacattttgctttttgacccagtgcacataaatatatacatataaaaataaggcaaagtttcacaagataattcttattacatgtgatgcactgtgatggtttctcatcaattccattctaccctaatctctttcaatgaaaaaaaaatgctggctatactcagtctgttgatttcatgactgggtcacaatccgtacttagaacatttgatttagaggtgataggaatctacaggccagccagactgaatttctgtgcctcccttttcccctggcctctttcccctgtgcctttagaaacagaacactctaattgtttatgagtctggagtcccagctgcttctgaagaactcagctgtcttgtgctctgtgtacaagtcatttttaagtggctttggtctctcaacagctctcccggtgtcatttaccaataaaccagattatgagcttggctggccttaaggaaaatacataaggtcttccaactaattgtgtacttttaatttttaataacatgggctaagatatgatagaaacaatctgtaaaaataatttaaaagaaaagttacatagttacatttgatagttcaacagaatacagtgtcatttctaaatctccttttaagtaagcaagtaacctaaaactggcaaaaatgaagcccacttcagctaggggagggggagatcaattgcctgaaatgacatttcagattatttctaacctaactacaccatggattaaaggtgacaggttgaagagcccaaacactccaagaagtctctatatttaaatatgacatcattttataaggaactttacagattacaaatgtcttctatatcatctttgttgctacactacaccaaaagcagtgttttgactagactatttcttatttttttcatgagatatttaaaaaggctttatttctttgttgctcgggaaatctccatttcctgtcaacatgtatcttaagatgacaagtagctgtgattatgaaatttctgtttgccaagg

SEQ ID NO: 115083 - DNA, 1066 bp, Homo sapiens
ccacttaattcaacagctaatgaagatatctgcctttggaaaagcatatttagaaatgttgaagtagtaggtatgtttggaaagaaaaaaaaatgtttaaaactaaagactttctgtcttcccctatgtaaccttgcccatgatgtctctcgtcatgattgttaaaagaggagccattgaaatagatgtgatattcatttgtctgatttattcaaatatattttatattcgtatagtagaatggtctatttttaatacctgttatgattttgttttttaggaaatatacgaagagtcatcaacttggaaaggaaacaaagagtgcttttgggcatccaacagttaatcacttatgtttttagagcatgcaatcttaactttgttaaactattattattgatcacattttgatttttttctctccacatcaggatagtttactgaagcacaatctcttatactagtgggacaaaagggagaaaaaggaagcaagataaatgggtatgtaggatgaagggttatttaaaatggaactaaagatagaaggaggactgtaggaagaaatggaataatttaaatgtgaggaaagatatctgtggtagacatgtccttccatgactaatttctaattgtaactcaacacacattgaggtatgggccctcctcagtgactttaactagctcagaaacgtactcccccaccaaccccacctcaccgccccccatcccggttctgggagagcattgttattaaggatgcatgacaggaatgttggcagaactggaaagtattaaaaaagcattatcagacagtcttgatattatacattttcagaaatatattaaaaataataaactaaaacccatgatttcaaaagtttaaaaagagtattttctttttttttaaattgcctaaaatagttctcattatggagatttctgggatttcagaatctataatcttaccagaaaactttttgttgttttttattagttgttaattttgtatcaatatacaaatcagcacaaaattgtcataaagctaactagcaacaaggtggtttgt

SEQ ID NO: 115084 - DNA, 1078 bp, Homo sapiens
agaaagaaaagaaagagaaagaaagaaaaaaaggaagaaagaaagagagagaggaagaaagaaaagaaagagagagagagagaaacagatcaagcaaaaggcacttctgaaaaatgaaagcaaaaaagcaacccggcccagcccggagctaccccgcgcggcctccaggcgcagccagcccgacgggcccgttttgcaatccgccagaccggagcacgcccgcggccaccgcgatctttcgaaatctccgagggctgctttcctccgcgcccacgtccgggcaccaggcagagcctctcctctaaaggcgggcaacccagcgcagtgccatgcagacggcgaggggcagtgcccaggagggcagtttacaacatacttaaaatgttaacgctgaagcagggaaagtaatgccttaaggtggggggaggggggagtcttcctaccatttcacggttataagtacctatctcatacctagcaagaaatatttgcaagtgatttctccctcttccccctttttaatgttcggatttgggtcgagaagacttctcatgaatcaccaatatgactttaacaatcattggatcgcaagctgctattattattttaaacattctgcccaaagactaattgaaataaacaaatctatttttaaaaggcaagcttcagaaatttgctcttaacccatttcagaatttaagtcagttatgggctgctcactgttttacagaaagctaagggtcagaaagaagaatgaggcagaggggaaaaaaactgtaaagtgctcaaagcactttggggtaataatttggcttttttttttttttttttttttttgcgagaatgggggatggggttggaagaagcatccactaggcagaaagctacttcccttgaaaatcttcagcacccacatttccaagtttgggcaaagtttctgaaaccacgtcccccagccaccaaataaaattcagtatctctcccccaaacccccaggttttcttttctttctttccttttttttttttaagtatccaaaagatgtgggagggagagagatgagactgcaaatgggtcg

SEQ ID NO: 115085 - DNA, 1034 bp, Homo sapiens
ctgaaaaaaaaaaaaaaaaaagacatacaagaagaaatacctcttttcctgcgtctgaatgcagttatatgaggacataatgcctagaactgtggcatcttctgaactagaagggacaagcataagagcttagctaacaagaaggggtggaggaatagagagaggaaaagagcctagggcttagttgacatcattgagccaatcctgaaccgacttttaaaccaaacctgatgaaaatacctccaaacttcctgttacatgaggtaataaatgacttaattgtttaaacctccattagttagatattctgcatccaaaaacatcttttcctatgctcttacatgaaaaatacttctctgacttccctttatgtcagctctttctgtagactctcctagcatcacatcttccttcttcgtagcacctctcatgtctcagttttaatacactatcattgtcactttctctacaatgtaaagtaagttatctgaagacaaggatcatatctgattttgattatcattttcccagtatctagcctagtccctcacatatagcagcctccaaaggatgtatggaataagtgaatgaaagtaactggaacttttaaaatgtcaaaaaaatgaaaaaaaacagtgctatctctatttgctattttgcttaggaaaagctcatacaaattaatgtgattgctgtcttgggtctatagatcttattggtttctaaaatttcatctttgatcagttgccatttcctgaagaacttggtgagatattggggacaggagctccacgttgctggcaagagatcggaaaagataaatttaccttttactgggcttgcattaaaaaaatgtaataacctctttcatttccttttttcttacatttcaaataaggatatagacctgagagtggaacagaaataatttgctgtgtgcatttttttataacttcaaccaaactatgcattctaccagtaagcgtagtaaaatgcctatgtccaaataccattttattatttcaaataggagt

SEQ ID NO: 115086 - DNA, 1030 bp, Homo sapiens
tctggcaatactttggaaaagtactactgcaggttctcaaggacccaaagagctctccagcttttccagtgggttcagccccaaatatcctaatttcttcaataaattacgagttgcaggtgtttaaatatgcaagtatattttggtcttttcgttatcattgtaaaacaccagtcctaacaagcagtaaagattacactttatggtggtaatatttacagttaatgcacttctgcatttcttcccgcacatttttcttcttacttatttaaactaagcgtttcccctctttttttaagccccagtattaaaaagaaaataaaatcccaaagaatttcgcaacattgcgattgcactggcttgagaacgaaggaagttagtcccttgcggtgatccgtcctttcatcctggcgtttgcctgcagcaagatggcggcggtgtcaatgtcagtggtactgaggcagacgttgtggcggagaagggcagtggctgtagctgccctttccgtttccagggttccgaccaggtaatagaattttcacacttttcttcaagcttcttgggtccctccatttttgcggagtctctgctggctgagttccggaggaggcctcggggaaggcgtcctctgttgacccttttctcgggagaagtcgggcggactagggactgtctgctatcaatgggcgttggccaggcgagtgagggcgtgagtgcgaggccggggaggaggacctgtggttttctggaagctttcgtattcggcttgtcgctgagggagagggtccgtggaggttttgcctccggagctgcaagctgaaccttagccctcagagaaggggaggagtctcactgatttctgtttccactttctgcatcccttccatttgtcacctgtttgcccaccactccagtccttacagaagggttaaatcactgtatcccttccatggttttaagtggttttaatttggtttctgcataggaagattgtttattcatcagtctgcttgggaggaaaacttgtttg

SEQ ID NO: 115087 - DNA, 1479 bp, Homo sapiens
tcaagttctattttgttgtctgttactaagtattttggtaggtaaatatgactttaggttctttagaactagttagttgctcaaaggtaaccttttcttcttgtctgtactcactagacttaatttttcttttatgggctcattctccagttcactggtttttaaacccttgtgcatcaaaattatctgttgggtgcctaaaaaattcagatgccttgccccccagtctatattggttcagtaagtttaggttgaggcttagctctatggtgattctaatgggaagctagggctgaaaacggattaaaaaaaaagtttccatattatatcttgtaagacttaggaaatatatttttccttgggagagagttcagggagatttccagaaacaaaaattcttccatttttgcatatttttctattctaaattaagttttatgcttttcacccatgcacataagaggtattttcttggggaaagtttccttagagggaaaaaaggcattttgataattttggagaaagcaggccatattactctctctctagagactcttattcttccttttggaagggctcaggtttaatatagcacagctgttgaactctgcccttcaaaattttaagaaagtgttttatcctttaaaatggaaaaggcttttttaggaaggtggtctttcactggatgtagttctctaagaaagtttcatgcttctctactcttttgtgtttgaatcgtttcaaatgttgagagaactgtctctgggagtaaaatctggctgcttttgcaatatattttctgtattcttaaacaaagctatatgaagagtttatttctttgtgttttctaggactcaaaaatatgttttttcctttattcagccacttcacacataagtaaatggtccttgaatagggcttactggacaaaagattctgttctagatgactgttcagcaagccatatgcttctcctaaaaatgtcagtctgtcttgatgagctttaaagtgaatacagatgttttggctcttttgaggactaccactctttgtatggaaagagtacttctttttcaagtgatctcttcaatatacttacaggaatttgcatgaaatttatgacttttgccttttaagtctaataagattagacttagacatgtgtaatttgaatttaattttaatattcgtagtacaaatgagatttggggaataaaatacatttcataatatggctttttgttcagattttgtattcaaccttttaaaaaatgtgaaagtgctttgtaatatttacttttgtgcaataaaaagtgatattttggcaggcaaggttacctttttagatgttcagtgtcttctatctttgtaggttaactctggagttatagttcatagatttatgtaatatttaagttggaagaaaactctagaatcattaagtccaaccctttatttaatgcaagaatccctagaact

SEQ ID NO: 115088 - DNA, 2067 bp, Homo sapiens
aacatttgagtcagtgggctgggaaaggcagacccacccgtaatctgggtgggcaccatctaatcagctgccagtgtggctagactgtaaagcaggctgaaaaacatggaaagactagactggcctagcctcccagccatacatctttctcccgtggtggatgcttcctgcccttgaacatcagactccaagttcttcatttttgggactcgggttggctttccttgctcctcaacttgcagatggcttattgtgggaccttgtgatggtgtgagttaatacttaataaactcccttgttagttgtgtccctctagagaaccctgactaatacagagaagaactggaatatgggtgcccagctggaatgactaacaagccttttgaggaatatagagaattacgcatgattgattggtagaatgatttttttaaaaaaatgccaaatagctttgaagtaatcctgttttgattgaattaagggtcttgttgctgaaaggtgaactaggcagtttagccagaaatgtccagtagaggagtaaactggttaattggacatccttttccttgtgttttgtctgttacattttcataagcatatttaagatttgctcttatgtgcttgcttataacataaatctattaataaagattcacagttatcaactatttttatgtagaacatgttggataatgatgctatgcaaagtctaaaaaatcaagaggttaataattggtaggacatataacaaaaactatctcatattttgtgttacataggcaagcactagtagtttttaaaaagtatataatttgggaaaatttgttccatgaggcagtacaaatgaataatcatattgaagttcaacagcttaattctggacttctgaaattttccaaggagatgagtgattaatagatacaaacatactatttttatgtacatatgtgaagagactgtctctaggcagttataaatcttcttcatctttgacaaacttttgcatatgtgtctttattggtgttgtaaaccagggattatctgtttcttcacaaggcatgctctttttaaaatattgtcgtggtttatacatactatgaaatttaccattttaactatttttaagtatatttcattggcattaagtacattcacattgttgtgcaaccattaccatcatatatctccagaactttttcatcttctaaaactgaagtctgtacccattacacagtaattctctattcttctctctcataagcccctggcaactaccattttactttctgtttctgtgagtttgactactttagataccccatataaatagaatcatatactattcttttgtgattggcttatttcacttatcacaatgtcttcatggttcttccatggtgtagcatatatcataatctgcttccatttaaggcaaaataatattcaattgtatgtatataccacattttgtttacacattcatctgccagtggacagtagggttgcttctgtcttttggctgctgtgaataatgctgctataatcatgagtgtacagatatctgttctagtccctgctttagtttgtctgaatataaatcccaaagtgaagctgctggattatatggtaattttattttaaatattttgaggaatcacactactgttttctgtaatggctgtgtcattttacattcccaccagcagtgagcaagtgttccattttcttcacatccttgccagtacttgctactttttgtttgttttttttggggggggggggtgataataactatcgtaataaatatgaagtggtatcttatggttttctttttcatttccctagcactcttttgcatgtttttgtgtggacatatgatttcagctcatttgggtaaatacctaggagcacagttgctgatcctatgttaaaactatgttttagctttgtagaaaactgccagactgtcttccaaattggctgtaccatttcgcattcccaccagcgatgaatgagacttctgttctcttcatcctttctcaaatttggtgtggtattttggatttt

SEQ ID NO: 115089 - DNA, 1027 bp, Homo sapiens
ctacaggactaaactaataacattagttatacaaatcattcctatgtaaaatacttttggtgtgaaattagagtgaataaactttttattatgattgggatttttttcttttcgtttctgatgccatccgtttaagaatcagtgttccagaacaattggtatagctttgcatgtttctggctggtcgtgacaaatcagccactgtacactcatagacagcagtacagtacttgtcactggtggcctttctgtgacagagagcctgaagactgacgtaaagcgcagcctgttgtgaactgtcaagtgagtctgccaaaaactcagcagacagaactaattgcagagaaaaaggacttttgtgccctcttctctttctttcctttcctttttttttttttttaataagacagatattgttaaagtagcttgtttatgtaagatttgtctgtctctcctctcattgcctggatccttttttaacttaaagtcttgcactgcaggtcgttgaggacttccacatggagattggcacaggaccagactcaagacacacaactcataacagttgatgaaaaattggtaaggattttctactacacactgctatggttctgccttcagggttatttttgtactatagatattcagtatggtgttccaggttttcaggaaagtgatttgaatttgaatttctagattatacctaaattttaagaagaaatatttgtcatcaaaagataatttatattaagcattataaacaaatacaaaaccatatgcaaatattaataaattaaaattatgaaaggttttcatttttgtggtgtttataactagcagaacattcattactttttgtaatgaatgttttgctttttattttctcagttacactcctatttaagttgtgagatacttgctagtactatctaaaactaaatatattaggttttcttggaagcatgcaacatttattatcactatatgtatatatgtatatgcatacaaacacatacacacacatttt

SEQ ID NO: 115090 - DNA, 1028 bp, Homo sapiens
aagttctataaaaattctaacattgtgtactatgctcaatacttggttgatgggatttatctgccacaaatctcagcatcacaaaatatacccaggtaacaaacatgcacatgtacctcttgaatctaaaattaaaaattgaaattctgtaaaaaaaagaaaaaaaagactgttctagtgggattggtaatgacactaacggatgtgatttttgatactgtgtaatgcaatatattaacgtttggaatatctatatacctctatgaactagtatttttcgtatgaccagtgcatgatataaaatcatgcatgggtaaaagtttcctttaaagtacaaaatagagcaatggattttaagtaatcaagtatgaaaatattaaggctatgaatattttgctcctttttctaactacatatctgtatgataatgagttttcttcatatattgcaataaaaacaatccaccaaaacagtttgaatgcaagaacagatgttagaattcagctgtcctccattaagctagatagtagattttcaaacgagtgccaaaatgcaaatgagtgccactcttctcacttttcagttttcaaaaatagagttttttaaattaaaatctttatattattacataactggcttattttacattaaatttatattgttttcttcattttaatttattatgtgatagatatttatggatatacaggcatactttgaagatattgctggtttggttccagaccaccacagttaagcaaatgccacaataaagtgagtcatgaaattttgttttggcttcccagtgcatataaaagttatgtttctaccacactgaggtctgctaagtgtgcattagcattatgtctaaaaaataatgtacataccttaattttaaaacactttattgctcaaaaatgctaacgatcagctgagcctttagggaatcgtaatcatttgactggtggaaggtcttgcctccatggtggtggttgctgaaggttggggtggctgtggtaatttcttaa

SEQ ID NO: 115091 - DNA, 1099 bp, Homo sapiens
acaaaaagataaccttaagttaaaggcttacttttgctttgactgtttactttttttttccccctctaaggggtcagttttcttttggtgagattactttcttttggtgtatggcagtgctatctctgctagattactggaaggagtagtgtctgcgattggggttatacagctttctagcatctcaagtgtctgttttgtctggactttactcacgcagcattcttgtgcaaaaatttcaaggctttagtctggagcactgggtcaaaggatatgtctctttgaagggtagacaggagttttttatgttttattcactaagtagtatttcattttacatcaaagaatagcagcctttgagaacctaccatggtggcagtttagcgtgtgggtttttttctttaagactttcactaaatatgtataatgtttcttcaagtgtttcatcctacaaaatgcctatttttattcttagatgaaacttctaatataaaaagagaagaatcatgactaaatataaatgtttgttgcaataaattttgttttaaaagcaactatagtttttttttttttacaatgtatttccctgtgtcagtttttacactacccacaagctattgaaaaaaaaaaaaatggatgaatagcctttaagattgcagcaatactgttgcttaaaattctaaggaagcagtaatgactagtgattttggaagtgtagatttcatagtgaaatggtcattccttaattgttccttttttagtactgtcatgtgtgtatgtaggagagattgattttgaaaaataccagactcaagtaatggaaaatgttaagacttcttgaagctagaaggaaagctcttctttttgtactttttgtgtaagttaatcagtaaataatcatataaaaagtgattgctttacatgtttggaagattattacattgtatttcatatttttgtctcatgacatgtatctataaacatgaactaatattaaaagttttttatgtttataaataaaacatgctcttaaatagttgaaagtttatcaaaacagttaatcatttaaaatgaattttttctactctccttgatgtaa

SEQ ID NO: 115092 - DNA, 1057 bp, Homo sapiens
ggtatgcagatagatccctgatgctttattttacactctatttgaatttggttttgggttttttgttttgttttgttttggtctttttggtagtaaatagtactttgtttttaaagttatagctcttgaattagccagcttgccagataagtttataactcaagaattaatccaaatacttaaacttgttaaagccttatatctgccattttgtagtaagttctcaatgaaggtagggtgagaggaggtaaagaaatagaagtagtatcttttggtgacaattatattttctttttatatcatgtatctcagaatagaattagagcaaaagaaaggagaacgtagactttaaaatttgagactagcaaactttgattctatttctgtgttcaggttttctaattttatatgacctagtgtctgcttctattctactcttcaaaataccacctgcaagcatgtgagatattcatgttttataagatggggaagtttgaaaaatagggcagtgatatggaagctttactgtatgcagtatactatgtctccacaaaactgcttctttataaggcatacttttctagaaatgtgtgaataggctttttgttcagttgctgtttcatgtttaatactttacttctaaaggctttcagcatatttcatgttagttgatgagggtttttaaaatgttaatgcttccaataaaatagacatgaaaaataaacttggctttctctaaacaacatataggatacagaaatataccaaaatgttgggctgagaatgctaacttaaagaactgaggatctgattagtgtaccgatgtacatctattccagtgattactgagtatatattgtgtaaattaagatgtatccattaaagataatttttaaacctaattgggtagtttaagatttgacatccaaagaattaaaacaagatttctgatttagtatgcattataatatcttaaacattcaaatatggcagctatagcctgtgcctaggttgctctgagattagaagtcctctagatctagtagttttcatctag

SEQ ID NO: 115093 - DNA, 1049 bp, Homo sapiens
aagctattatggttaagggcaactttaaagaagctcaaaggaaatggttagtttgctgccattttaatttgaaggaacctaatttttgtctttgcataggttttatatacgatataacaatttggtgattttttttctattaaagaatcttctgaatttgaaattgctttttgagaaaggcagtattgggaccaggaataataaactcatctctctaattctccatagcccttctttctctgccctgcccccttctccaccaagggaaaacatgttaaagatttgtcatagtggtaaaggaagataagaataaattggctgaggtgctgtccaccagtttggtgctgatagcttcaaatatatttgagttctgcaccttgcttttgccagtggcatgggttgatggtgatagttgtctgtcttcatcttaactttgactgcacttcctcttgttctgcctctcctttcccccctcttactctctgcttcttgaaatctctcttcacagtttgtatggcttttcccctctgtcttttgacactctgtcttttgctgactatgtagctgtaggtcatctctctctccctttctggctacatgtgttttcctgataccaccttattcccttccatttttttcatttttcctgccttcccttctgtctctctctagttttggctttctgagtcattctttggccgtcattttttcccccactcccctgtctcttctaccgcccgttttcttcttccttccattctttttattccgtacttctgttccttttatctttcttcttctttctctcactttcccaaaatgactaaggagcaacatcaaaactagtgggagagacaaaaggtgccccaccctctaagcacttttttaaaaattgtcatatttcctcttttgtaaatatataggacttttagaaacatttaataactgaaaaatggtttatacattattacattatttgaaatgttcactctagtgagatacatgggataatggcaagatcatggactaattataaatatagccttaga

SEQ ID NO: 115094 - DNA, 1119 bp, Homo sapiens
ttaaaatcgggatttatgagtcctccagctttgttcttcattttcaagattgttttgaaacaaagatttcacgtgaattttaggatggatttttctatttctacccccaaaatgtcactttttatagggattgcattgaatctgtagattgattgctttgggtagtattgtcatcttaacaatactgatgtttccagttgatgaacacaggatgtcttcccacttacttatgtctttaatttcttttaacagtgttttgcggttttcagtgtacaaatctttcgttttctaagtttgttcctaagtattacattcttttctatgccattgtaaatgggattgtttttgtaatttactttttagattgttcattgtgagtgtatagaacataactgatttttgtatattgattttatatttgcaaccttggtgaatttgtttattatctctaacaggtttttttggtggaatctttagggattttcacatatgtcatctgggaacagagataattatacatctttacaagtttggatggcttttatttctttttcttgtccaattgctctggctagaacttccagtactacattgaatagaattagtaaaagtgggcatcattgtctttttcctcatattagaggaaaagctttcagtcttttctgggtttgtgttgttgtttggtgtgttttgtttgtttgtttgtttttgttttttgagatagggtctctgtgcagtggcataatcttgtctcactgcagccttgaactcctgagctcaagagatcctcccacctcatcttcctgagtagctgggaatataggcacacaccactatacccagatagttttggctttattttttgtagaaatggggttcgccatgttacccaggctggttttgaactcctgagctcatgcaatctgcctgcctcagtctcccaaagtgctgggattacagttttctgttttcttttatcatcattactgtgtaggtaatgtgtctttcttaagactacttttatgataattatcttatctttaaacttcagaaattttgttatactgtgtttttgtgtggttttctttacatgtatcttggttagggttcattaagatt

SEQ ID NO: 115095 - DNA, 1125 bp, Homo sapiens
ggtttatctgagacattgttttgaatcttgaataattttaaaaaacattcattaattctttttgttctggtgttaacaaccagtagcatgaaaaaatataagaataaaattattatttaaaatatttacttatttgatttgattagaacagagaattgctactctttttttagcattttaatgacacaaaaatagtatgtaattttactgcttggacatattgaattctgacttctctttgtgaaatattttaaatctttttctaaaattgttagaattgtaagctgaaggtttttcatgatcatctaattaaattttatcacttaactaagaaataaacctgtgtcccagataaattaatgagttgaccatagtttgggttctcagcctgcttatattttattttacaactatatataaaatactaatatgtagaatattaaaaatataaaatatttaaaacctggctagataagtccatatagacttgtattttttttaatcaggagaattactgtatttaatggagcaaagagaatgttaatattttaatgtgttttttgctgtgggtcaaagaatgattttaggatgtgctaaaagagaaatgactatccatcctatacctagaatatatttgtttccaaagccacaaggtttcctaatttaggggatcttgggcttaactttattctttttttttttttttttgagatggagtctcactctgtcgctcaggctggagtgcagtgggcgatctcggctcactgcaagctccgcctcccgggttcatgccattcttctgcctcagcctcccaagtacctgggactacaggcacctgcaccacgcccggctaattttttttgtatttttagtagagatggggtttcaccgtgttagccaggatggtctcgatctcttgacctcgtgatccgcctgcctaggcctcccaaagtgctgggattacaggcgtgggccaccgtgcccggccaactttattcatttcttctgatagatactgtctaggtctatcatattgatggaatggcttggagggtttaacagacatctaaccctgctgatgtaagagtattacagagggttggaagtgtgcagtataagaaata

SEQ ID NO: 115096 - DNA, 2121 bp, Homo sapiens
taaccaccgttctgacttctaacaacatagattagttttgcctatttttttttttttttttttacttaaagagaatcatcctttatgtgctcttttgtgactggcttttttgcttaactttgtgagattcatccattccatgctatttattgatggttatttgtgtaaatttctgtttgggtttttatgtataatacagtactaaaatgaagaatctcgtatatatcttttagtggatatgtggctttctaatatgctaattagtccctgaaatattagtcactagttaatattcaaacaattaatatagagataacaataatctattaattatctgatcccttatgtttctcaagttaatgacagtagcaacttgataagttttgttccaacagacagttaaattactgatagatccaccttgaacttgtggaggattatgcatcattggagtggatctgtttcagttttagccttagtcttggaacctagtgttaaaaaataaaaaggcacggcctttctgaagttttgatggaaagcacaaggtgtttacccacattctcccttcagactcagtctcccctgtaacaggcagctgctgaaatctttgctcaattctttcagccttcccagcttcattttgaaaccttgctgaatcatgtacagttcaaaagctccctgctctgtggatactctcttccagctgctctggcaatcctggactccgtctccaggctccttgcactgagattacggctttctgcttgagttctcgatgctcctagcttgtctagactagagaataccttatgggaaacaccgtataaagttggatctaaatccaactttagattggttccttttttttaaagattgaattctctagaagtttattttttttttctattagtcactctctggtctctgaaaattatttttctgttttgtccagagtttatagttaggcagataaatctgatataatattctgccattacccaaattggaacttcagtaattgagaaatgagcaaataaagtctaaaaataaaagaacaaattatctttagtggaccaggttgaaagagagattgtatacagttggaggagggtaggatatgaaagacttcatggaataggttggtattcaaagtgaagcatgagggattatttggatggacttccatgtgcagagagtaggagagcatttcaagaggaaggaacaaattgaactgatgggaaagtacaccttgcatttataaaaacaattagcaacctgatttgactagttggttacttctcaggggagtaattaaaaagaaggctagaaagtagttctgtccatattatagaagtgcttaaatgccaaggtagaagactgaagttaatgtgatagacagtgaaaactgtttgaaatttttgaactgggcagagagtgagtttgggatttgaactttaggaagacatcttggtgaagggtggattggagtcaaggaggcagaaagattagttaggatggggttatgggaataatgaaaaagagcttaaactggtggtgacagcatacctaaaaaagaactacaaaatacaggaaatgaaggagaatgagaagggtagaaactgaatggctggaagaatagtggcttcttccagtggatgaatgttgttactattggatatattggatataagttgttactatttgatttctatatgtatgtattcataaataaagtgaggataataataaaggctataccatctttgcaggaaacagagttctgatctcctggcttctgtcttgtttcttattctcaactaagccaatgtgcctgtcaacacttatcagattactgcatcatatttatgttgatacttctgttctcagtatatatactttaactatcaactggaaaatcgtgtgcgctttgaaaaggaggaaccaatataaaattatgatattattagtactaatatagccagccatatgaagctcttttgcttacaaagggtaggggtgggttatgataagaatatatataattataggaatctcagagtagcaaccatggtctgtgaccagaacattggcagcagtaattagtgggtcttcccgtcagtg

SEQ ID NO: 115097 - DNA, 1081 bp, Homo sapiens
agttggattgggtgatgtccaaaaactatagacttaaggatgttaaagcccatgggctagttcgtctttatttctttgctatctagcccagtgccttactcatatgctgtatagggggaaatgagtttttgttaatacagctgattctgtgttaatagtaaaatatgacaaaggttatacgtttatgggcattaatgcttgcctttcagtagtatctagaaataggaagttagggtaaaactgccacatacctacacaaaagatgatttatgtatcacttatcaaattgtattttatattaatgcagcctaaaagtatattagcttttgacagttatttgatttgtatatcaattatcaaatacaatttgttatcaattgtatttgagatacagttgattatttgtatatcaattcagggactattctgaagataaaagcctacctgttatctccttagttttttcatttcccttttaaatgtcaaataaaaagagaagtcatgagcatggtttcccttgacactaaagattgtagaaaatcaatacatcaaggggagtaagattttcagattcagttgctttctggaaaaccttttttttggaggggttcggggctggagacagagtctcactctgtcacccaggctggagtgcaatggcatgatcttggctcactgcaacctccacctcccaggttcaagcgattctcctgcctcagcttcctggactacaggcatgcaccaccatgtccagctaattttttttttttttttttttttaaagtagagacagggttttaccatgttggccaggctggcctcgaactcctgacctcaggtgatccacctgccttggcctcccaaagtgctgcaattacaggtgtaagccactgcacccagccttacaaaacatatttaatgccctctaattatattttgagacttgggtaataagtattgtcaccacagaaagtaacaaacactaaatcatgagccaggcactatgctaagtgcttttcattctcatttagtaactctgtgaagcaggaacagttatctccatttaattgttcaaggcaac

SEQ ID NO: 115098 - DNA, 1074 bp, Homo sapiens
tctctcttctttacctcacttcttatggaaggctggtgttctgaaattggggagtggaaaagaagaaaagactgaatgctccctatgacttcattttctccctgttcccactaccatgtccccaaacatactgacacacaaagaaaatataaatacccctgattcttttagccttaaacttagggcctcatcctaaacatcttaagctcagcatctattccaaaggaactctttaatgataacgtttctttgtaaagagacgaatatcatctggggtttcctctgaaatgtagatgaacctcacttcagttctttgtgtactaaaaagacccacccttctcacccatgtggcttttgtctttccttgtgttatgtaataagtgatggggtagaaggatggggggtggaggaagctacatcatggagagaggaggtagaagacagctgtggaaaatttggatggtggaagactagaatctactaccatttacatgctaatgaaaaccagaaatggtcttttttcccccgtttgatctgatttgaaagtttgtgacttttgtctagtatgtcattttaccccctgtgtttttctcattgttgttagctataaaaactctttgaaattctcaaaataaaggaaggtttctttcaggaataggagggctgaggacaagctgtgaaactgcattcttcatagtgggtctattggggtggaaaacccgcctctgaagtaatagaaggtagaagcacggaaggaaacaggtctggccctggatccaggaaaataaagaaagaaataattggagatgtagcttagtacttagaattatcccagaagtgaacaacatcagtaaggtctgggcttccacctaacgtaacctcttatgagggtctcaacctcacatccatatatcttttaaaaaaacaaaacaaaaaaaaaaactttcaaaacaaaggcaagaatcatgactttcatataggtataaattgcaagtaaaaatttattttactcatataagggaacaaggcaggtgttacaaccagttcagagtaaaagtcaaaacagcactaatt

SEQ ID NO: 115099 - DNA, 1100 bp, Homo sapiens
agagtcagagtcagcagagttctcttactgctttggattcaccttttagagccaagaaaagaggtatgcaggcttaagcataaggtacaccatttcttcgatgatgaagtttgcctgcctttggttgataaatctataggatgtctcaaggggacctccaaaatggttaaaagaaattttccagaaaaagatacattgactctagcatagatatacaataaacatgtattgaaggattttactcatctgatataagggagccaggcaaatgttataaccagttcaaaggacaagtcaaacagcacagatttatgtagggtaaagaaatgttgagatgagttgctaattgagacaaaactgatttttccaggactgggttgagaggggagtcaaatctatgagagaggacagactttatgtatctctcaattatagttgttctccttattcacagttatgttctttaaagtcactatgaaacactaaattagcaagaattcttatccctcgggatatacatggttaggttcctgcaggcctctggtcacatagtttgtcgtctgaccagtacataaccttgttttatatgtgtttttgtttaaagacaccttatttaatacagttaattcatcaacattgaactcacagccaacagcactataactcatgcctaaacaaagcgtatctgaaacacatattggcacatcacagctttcttggaacactagataacatttcagcagtgtttggggaccattttaaacagtgaaattaccaaaaagcagcacagaaatgcaaaatactggcactaaatagagcacaaaaagtatgcttgtttacagtatgagagctaaaacaagaaggcagagcattatcctgcttcacctcatttagaaatgtatgttacgggactcaaattttttgacattctccacatgtcacaaatgaccacagaagcaccatgggcattgatttaggagtcacaaataaactttacgtgaattcatgaaagattttttttttcatagatagctttttcctcccaatgtttaatcctggatcctgtctgtagctagggaagtactgctaaggcgcgagca

SEQ ID NO: 115100 - DNA, 1146 bp, Homo sapiens
tttacatatttttctgtatccctttggaagagttccaaactcttgtaaagaaaccaacttttagaataatagtgagttggttataatgttcatcgctcttcattgcaactattttaaaggcctatgttaaaccacatagagtaatggaaatttttatgtaatacatagatatcagtaattgagcaaggtgaaattgaatcatagtttacatctttaacaacttgagatatggtaaataatctgcaggcaatcttttggacccttttctcacagaggattgattataagggaacaaatagtaagtatatctcagatgtgttgacatatactcttgatgataaatgaacattaagttaagttataaaagctagcctctgcttgctgtgcttttcaggtatcctctttaattctgtttctgtggatttgtctttgttttttcctcctaggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacagatacattttgtggtgtctattttaaatgttttttgatgtctcaaattgagcatgtttcaatttcctatatagagagaagatttgaggtgatcatacctctgggaaatcttggtacttttagaatctattaattaacaggaatgcttgaaatcaactgcaacattgaagttttatatttgctttttatagccattctcaagttaatatggtttataaatcaccagccaacattattaaaatgttgtcttagaaatggttttatcataggtagagaagtacacgataacattgcagtcttataaacttaaacccctatgtcgtcattattaaattaatttaattacaactttataatttacgaaggtactttgagcctgaatgaattgcatttcatagtaatctctgcccagaaatcaacacttcatgattatgaggagttcaggtgaagatttcatgttcttaggaattaagactcaga

SEQ ID NO: 115101 - DNA, 1089 bp, Homo sapiens
cctgtacttagaggctaacagattcatgtggacatttaccaggcaagaccaacttgtattgtccatgatttctacgatttccactatcttcaaatgaaaaataaacgctgagtagaactggtgttttcagactaactcctttcaactttagcatttgggagtcccagatttctgtttacgtttgtgtcgcctgtttgtctccaaaataagttctgctgctcttgggtcaaaacaaatgattaattcgcatttcctttgaagccattgtgaaaaccttaaaagaaaaaaaaaaaaaaaaaaagcaagtatcttttccagttggtttgtcttcagcagcaatttactcttattgaagctgttccttcggagtgtgtgaacagactcaagatattattataaagcatcatccttcaatcaaaggattattttataatatgtgctgtgaaattaacttgagtggcaaagtttggtgcaatgagttatttcattcaatggtgattgatgctgttaagtaatatttttaagtgactcgaggaaatactgtgcatttacagatccatccttaaggatgcaggtctaaaaaaagagtaagaaagaaaaatcaagtggtagatagatagaagaagagagaaaaagaaaaaaaatacgtaattgaagatgaaaaatttaaatcccagcttttgcttggtcccaaatgcaacgttatcatcacttagtatttgactacacagagagcttgcaacgtttcacttctaagctgggaatctaaccttcattcctaggtttatttctagtgtaggcaattagcagttatcaacttcctaagcatctcagtcctatccaagtaaatgtgaacagaactgtaagattttgaagcaaatggggttttcttcatgtccatattgcatattcagacttgaatggaaatctaatattcgtgcctggcttcatcctctttataactttagagtgcattttcattaacctcctgacctaatggcgcaaacagaaatgaaaaggtatgtagggtggtggggctggaagtgggagttgccctttgggatccctcattttcaatgcatttggaag

SEQ ID NO: 115102 - DNA, 1595 bp, Homo sapiens
ggcttgcacgcagatcattcacctctaaagaaaacactcccaggtcacaatatataacccacattataacaacagctgcggacaggcatccacattgcaaagttgtaggcatcacagttcgtataaattccgcctcgaaattcccctactttatccctcagaattttgatatgagaaagtttctgatataattaataacctatttatctttattttttcctcttaagatcaaaaaatattttgaacttgaaccacttgcacgtggaaaacgctggattctacagccctgctcactggatgacatggatgcactgaaagacagcttctctcagctgattaatttgttagaagaaaaagaccatgaagctgtaagaatgtgaaatctggcaaagaaaacaggctcccaaaaggccttgaacctatcatgttagtttctcattttaattttattttggtatcaagactatattggcttcagtatctattttcctctggtcatttcagactctcatctctctattaaagtgaatattctgtagatcagatgaattatcatcggcattaacgtcaagtacacactactgagagagaatttattctctgtttaccactaattatcttccccgcatgtctcttccttctgttgttctaagcatctcttctatactctgtgctgaaacggatggaattcatggcttatggaaatcaaatcccttttgaaggactcagaaagactcacaagaccttgatcattttctctgggtttgggagtggagtattatgtgactgggactccacaaaatatttatattattttcaagacctattgggggttttgttttattttatctaatttttttttttttttggtatactgagcttatagactatgagagaaaagtgagcaccaaaaacttcattaatcaccttatcaggaaggaatatcctgccatagtaaaattggctctgaagagcttagaggcaagttacacaatgttttcttgattacatctgaagtctcttctcttttaagagcaaagacattgtttcagtttctgagagtggttagaggaaatttaggtacaatgcatgcatcacagactgtatttgattgattcgagtcttcaaatattgtttaatggaatgatgagcctgcataaagtgaagctgcaatgtaacataggtatctttttctaaaaacttcaagtgtttgattaaaatagagaaaataatttttaaaataatagataaaaattttaaaaacagccagaaaaagtataatttatactggttagggtttaagatggcatggatttgacaaagataacaaagacagaatcatctatatattcattcattacgtgttactgtagtttattggaatctgttaatgccttcctctagtagttaaaggtttatcagtatttctattataaacctctattttcaggggtttcaatgtgcccttaaaattgtgctggggctgcagcaaataaataatattgggactcatattcagtctttggaactagttttttttccatttaatttaaatgacaaaattgcatagggataaatgtacagttttactaagg

SEQ ID NO: 115103 - DNA, 1693 bp, Homo sapiens
agagaatagttagttcagttcacttccacctccacctcatgtgcagaacttccccccattatgttgtacctcttaattgcttccatttttttctctttccccaggttttgtaggaggtaaaccatatcttggtgatgtacagggccagtggtcatgctggaacctgtcaaacccccatcccatagtacaatgctttttgttactgatccaagccctgcaacctaccggacacatttacagatttatcaaatcagtttgatagaagattgccccttctcatggtgccaaaaagcagttcaacctgtaagtaggttactacatatttggtgtccacgacttcatataagaagtcagaattcaagtatttcagcagctgcaggagatttcagcatttccgtatgttttatgaaaactataattgacttgctaaaaagtgtgcaggttacatgtgttgtatggatagatgagaagctacagtcaaacaggcaagaatttgtttctgaaatactgatttctctagagccacatcttttcctttttttcagtgaaagattagatgctgtgactaggcacctaaaatttacaaaccctatttcaaggactctgacgtataagtgtccttatgctaaatgtgacagggtatcaggaactaaaagtaagtttgtggacacatagaggcaaatgccatttacatgtatcatttagaattgttttgttattaacacttaccttctagttaaaaatagatcattggtacaagctatcatttgtcaggcattggaattatatgatttttgtttttaagcgcttttctggaattggcattttaccaaaggaaaaatgaatttggtaagaattcatttggaaagaaacagatgataatttcaaggtaaaataggactattctgcaaagcactaagattacctgctctctaaagaaatgtagtgtggaagattgtaatcagggcatgggctaagaaaagctcaggacattttcttgatgggtatactttataatagaattctgtttctgttctgggtctagaaaattggaataagttctatttaggaaatattttacaaatacattcagaataacattatgtttaatattttaactaatattatatttaataacaaggttttcagttataaccataatatgctttcatagagatgaatatttctacaggaaactgtaggggtgtgggggtgtgcacatgagcgtgggtttgagtattttaattttatttatttatactcgactgtcacaaaaaaggatttgaggtgatagacactagtattgattctgacagtggacatgcttttatgtaacactctaaacttcagactgaagtgggtgttaatgacttcccctctgagaatgcttttgattcagacatgatgaaaagtgtgactggaaatttagagcagaacgtgtagttaaaagcccactcatctggcctggtctgaactggtagttgaacagttaatcaagaactggctaaaaggccaggcgctggtggttcacacctgtaatcctagcactttgggaggctgaggtggtcagatcatctgaggtcaggagttcgagaccagcctggccaacatggcaaaaccccatctctactaaaaatacaaaaattaggtgggcatggtggcaggcacctgtaatcccagctactcaggagga

SEQ ID NO: 115104 - DNA, 1005 bp, Homo sapiens
cgctgtggctcacgcctgtaatcctagcaatttgggaggctgaggcaggcagatcacgaggtcaggagatcgcgacaatcctggctaacaaggtgaaaccccgtctctactaaaaatacaaaaattagcagggcatggtggagggcgcctgtagtctcagctactcgggaggctgaggcaggagaatggcgtgaacccaggaggcggagcttgcagtgagctgagattgcgccactgcactccagcctggatgacagagtaagagtccgcctcaaaaaaaaaaaaaaaaaaaaaaaaaaatatatatatatatatatatatatatatatatgaactcttaagccaacctttcaaccttcttctccatgcccattccctctagtctgcccccacccaagaaaaccaaatacacacatgctcacctacacatttgtcaaaatcttgactcttaaacccgaagaccagtaactatagatatgtgtcatatatcagtaggatatcaccacaaggtatgtctaagaaagctaacttcagtattcccattttacagatgggaaaatagatggaatgtgggaggaatagtaacatggagaaaatagtttcaaggtatggtggccatgtagtagttaaatgaaaagtaagtcccctgctaggaagctgtacttcttgctagcctcaatgaaaccattcaaggatggccatccttgcatggaaacttaaagtaacctgaaggaagaggcagcagcttcatcgcatccagttggttaatcccctctctgtcaatcacctgcatacaagctgaaaaaactataaattcacatttctggagccacatggtcaaaatagcactttatattcagtgtgaaattcttaaaatgaaacccagctggcagatgggaaggactggtgtggggaggaatattgagtgtgcaagggtttcatgattttccagagagctttttatgctttgtgcagatataggaatatttttaaacatctatgatg

SEQ ID NO: 115105 - DNA, 1054 bp, Homo sapiens
tgcagtcatgaaccactgcacctgctggcagatactttttaaaaaaaaattccagaagcaccaggcagcagctacagtgatgctcaccatttggcagttgctcagtgactgtgcaaattatcctgaacccataaaagcactcactttgtgttgaagagccattttttaacaaaatgacaagaacatatattatgaaaggcaaccaagcaagatatacaccaagttgaaaccacaaatgaaaaacatagtgtgggaccctatcatcatgtcttcaattaccctccaaccctacatatatgggggaaaagtttctaaaattgggctactctaccaaaaataaaataataatttgggtaaaatagacccccaaaagttatgaaggtacttacgggaaggaaggattgttcagggctttagcatgagacttccattttttttaaaaagttattcacatattacagctttctattaagtagttataaattttattcataaagctaccaatttttgagcacctactctgggcagtcactgtgctaaatactttacctatatttgtgcccagtctatacccaatcccttcaaagacagctgttattcccttattttaaaaaattaggaagctaaagacatttactgactcgtcggttcaagattacttgattagaaaatggcaggacagtgatctttctagttcaagttgcacagctctgatacaaggaacaaaacaacaactcaaacaccaatgtcactggttgctatgagaaacgagtgagctgatccaaacacatggtatttcaggtacccagcatggaatagtaggtgctcaataaaggttagctctatctgcctccccttgttccctccctgttgccattcagtagaaatagaccatggcagcagctgctgcaagtctttcaccttaatccgagctgtttattctgagtgcacacacaggcgtgctcaaacctttcctttttttcctttcccatcctgttttgtctccctcaatcactttcttctcacttgtattattgtttatagaaagcactag

SEQ ID NO: 115106 - DNA, 1032 bp, Homo sapiens
agtctccttagctgtgaaatgagagggttgaaatagatgatttgtaagtccccttctggctcaaaaattctgactcagagaagatcttttctgtatcagttctttggaatgaatcttattttcaatttatctaaacagttttaaagtgctgtttagaataattaaagtaacactaagaaaggcttgaaaagtaatcaacaaaattgggaatatctcccataatgtggcttgtgtgacaatctgctaaaattttttaagctaataaaagtaaaagacaacaccaaatgaatgctttttaagaaagctaaggagacgtaatggcaactttccaaaagctgctaaagctctcagtctgctcctcccagctgttacttctcaaggtgctcatgggccttcggaaatctgacacaatgtcagacaaatacctttctccggacacttttattacctccttttcctgaaagtcatagtctaacgccaggaagagaacttatagtcatgtctcatttatcttcaatgttctgctttctaattgaaaattttccttcagcggtttttcaaatcagatcttaagcttgaattacaagtcgttataagtcttttaactttacagtgtttacttggtctgaaaaatagtcaggttttttattttattttattttatttttttgagacggagtcttgctctgttgcccaggctggagtgcagtggcgcaacctcggctcactgcaaactccgcctcctgggttcatgccattctcctgcctcagcctcccgagtagctgggactacgggcgcccgccaccacgcctggctaatataatcaggtttttaaaaatgtattgtttaaaaaataaaacttgataagttttttaaatattatgagatttttattttgacatgctcaagaatataccagaaccgaaagaatttcatttaggttgaaaagaatcagtttaggttactagtaaaggagatgcctttaggtaaatcatgcttatttgagaaagctttgtgcatttgacaaccta

SEQ ID NO: 115107 - DNA, 1038 bp, Homo sapiens
tttctcaaatattaaatgttgtttaaactactgacataagagttatgctagacaaagaaaaactagtgtaaatgtgatgaaaaccaaatgagactttttaaaactccacatcaggctgtgtgtgtgtgtgtgtgtgtgtatgcgcaggcgtgcacatgtgtattttgtacttattccctgataaccttttatctctcagacacttaatttgtcatttaggatatctgtggttaggaatggaaggcccattttgtaattggtcactatgccagaggtgaaagccattgacaccgagcctccggggacggagaactcttggcaaggcttgctaccagtgggtgtttttttcagttctgtcaggtctgtgttcccttgggggaatttgtacccaaagagtattgagttttttctgttgattttttccaaaagcatgtgttttctgcattcctgttttatggttccctgcaaaggaggaacagtttctatccttatttggtttggatttgattagcagcatttgggattagtttagtctttttaaagtaaagcaaatgataggtagcagagggtggtggaaatcgcactgggcaagaaaccagaattctggtctcaacttttccctctagcgaaccccagcagaggaactctcactgcttaactggctcttgtcctcaggttatatgcagataaaatgcatgcaaaaaaatgagaaaactggatagtctcaaaagaatttcaaaattctacattccttttaatgataatgacagtaacaacaatggcaagagcagctatcagatactttaaacacattgtttctaattcccacaataatcttggaagttttgtttgtttgtttttcagataatgatgcaaaagtttgctcaatagcataccaatagcaagtggcaaagccaggattgaaactcaagttagtccaacccctgcaattaccccaagattctgattatccaagctagacaatagtgtcatagatatgcacataggttttagactcagacatctgggtttaaaaac

SEQ ID NO: 115108 - DNA, 1043 bp, Homo sapiens
tccttctgcaacctccctttttatctcatttttttccactggtgtctcatttaatttctattttctttaatcttgtagtgtaatgcactcacggagatttttggaggaaggtggagagggctgttttcttctaaactagattcttgcttccttcccagccctccccctttctttcatttttttctttgctctgggagtcctgcttagttgtcatagtcttttctctttgtaaaacttaagttgaatatgaacaactcactcaggatcttttcttcattctctaatgttggtgaattgtccttgtcttgctttttaaccgtctctaattagacctcggggtctagtcccagagctgcattcagtttgaggagtcgacctgaagacccacatgctggagatgaggtagagttagttgagctgggctgcgtgctgggatcctacaatcccagttgttggtaggatctttgctcttcctcagtaattgtattaaatgccctgcatcagggtttgctctacatattcacagatatatctctggaggagtgagatacggggctttggattattcctccaattcaaggaggtgcttgcaagccatttgtttgattagttttggctaagaatgtcagcctcaggtgtctccttcccttgccacatcctatctttcccccagcaagtgtttttatctctttccagctaatggagaaaggagaaacctgtatgcttttaccatggcattattaatccacagacagggaagggaacctcacctgggaattttctgcctttaattctccttctctcccagccctcaacacacacacacacacacacacacacacacacacacacacacacacacacacacccttatttatttttctctttggctagacctttgtttactgtttaagatacagtaaactctgatacagactagcgaacctcatgttagcaccaactaagatttaacacaactggcaattggctatctccttcccttcatcccagcccttgtccttgttttattagctctacaacaa

SEQ ID NO: 115109 - DNA, 1049 bp, Homo sapiens
tactgatatttttagtggtcatcatatcgaaaatatatagggaaggagtatatagggaaggagtaagtaaggttttccaaaaagttatgtgaaggtattcttgtgttctctagatcagtgcttttagaaaatttgtgtgatctaaagaacacaaagaatacctacacagaaccacctgcagactggtgccagtccacaaaatatctgtttgagtatgcaagaagataaatacagaaattgagagtaaacatttaggaaatttatagcaatctgacatctctgcaacatccaaagtatatgatttttgtattctacaaaagcttagctcagatctatgatgggttagaaaacaaatactcaaaacaaaccagctccttcaccacagatggtatttgaagttctgatcaagctcatggtctgcaaaccttttctctaaagggtcagattgtaaatataggctttgtaggccatactcaaagtccctgctactcagctctcccatacccagctgcaatagacaatatataaacaaatgaatcttgctgtgtttcagtgaaactttatggacattgaaatttgtatttcatctaatttttatgttcttaatatgctaatattgttttgatttttttcccccaaccatttaaaactgtgaaaaccattcttggctcttgcaggccatatgaaaacagggagtgggctggatttggccctcaggccaagtttgctgaccccaagctagatcagcagtccagccatcgtcaggaacagatgctgttatttcttagtctcagtgttcccgtctgtctcgggattttaattgccacttactttcactctgcagtttgggttattattcaagaaataccttagagcactcataatgcttagaacattatgtttaataaaatccagaaggaaaatgttccaagtatctcactgtgggaatacattttaggatttactatgacctactggtttacatgaactttgctgagaaaaaaaaaagcatggagaagattgggatggaagatctctttattgtgtgt

SEQ ID NO: 115110 - DNA, 1045 bp, Homo sapiens
acttcaaccatttggatgatgggattaggtacagcttctttcttttaaaagtggtttttgcatcacaaacaactagtaaattttaaaatataaaatcaatcaatgggaatgatttttttttttttttttttttttttgagacagagtctctctgtcacccagactggagtgcgatagtactaccttggctcactgcaacctccacctcccaggctcaagcaattctcctgcctcagcctcccgagtagctgggactacaggcgtgtgccaccatacctggctaatttttgtatttttagtagagatggggtttcaccatgttggccaggatgatctcgaactcctgacctcgggtgatccacccaccttggccccccaaggaaataattttttgttgtttttaagatcacatgcttgatccttgtatatataattatttctaaagtctatgactctacttattaatgtttttcctaatctaaacagcgatttaaaaaatttcaagcctaaccataaccttgtttcatatagaagcagttatcctatttcctatttatctttggtattccccagtccacaactggatgtagatagagaaactaaagggaagggcagatgcctagagccctaacatttggaccatgtggtacaaggacaagatacaagaaaccctgacaaaaacaagcctcttctgtttcctgcagtgataggtgctttagagaaggttacaaataaagacagcctcaggatcccacccacagtgttccagaaatgtgacctgttatcttttaatatgtgagtataaaaggcacagaggattgaaagtggaatactctgagctgggagttcggagacctgaggtcaagccccatctctgccactagctgtgactttggaagaatcacttaaccctcacctccacaaagaggtgaagtggctacttatctggcaagaaaacaagtcagacatattgatatttatatgatgaaatttcagtcttgcaacttgggcacctattttacaaaacatcttgacgtctctttac

SEQ ID NO: 115111 - DNA, 3000 bp, Homo sapiens
ctcaaacttcatctatgaagcctgtgagatattaaactagatgcatacttgtacatgcatcacactttggacttacttcttccaaggttctcccttttatccagcatgcaatcacctttacagtatgccaagagagttaaaccacattttcatttacatatgctcatgcagtaaatgcaaagtttatcttaatttatggtattttaagtgtcccagctcacgttcctgtcacaacttctcaaacatgggatttttttttcttttttttaccaataaagagttttagccacttacatttttattattgaaacaaagaaagtttttgtaaccttcttattccagaatattctaggcacttgaggaaaattgtcaactcacaaaattcagagatcactatcccattgcatgctttgtagtgggttttgttgagatcataaagcagaaatagattttttaaaaatattaagcatcgaaaagatgactgaaaataggaacagacctgcttttatctgtttgataattctctctcattcaccagaacgtgtttctaaattatttaatctttctctttgttcactctgcattttgctcctggcaaaatgtgctgaagtcactgttgtcacatgtttttaatttttgagaatccatctttctaagatagacacaaaaagaaaaactaactgcacagaacaccacattaagaggaaagtagttgaagttctgccatgaatagttaccaaaaagaaaaaaagtatgatactatttggccccatcttcctaactagggaattcaaattgttgaatacctaatagtacttttgcaagtatttcagtttttaaaaaatatgctatggtggacaaagcatgcctattatgtaaatatatagttactaaagacactagcatgtatgtgccttttcttcttgttgttgtttgtttgtttgttttttgagatggaatctcgctctgtcacccaggttggagtgtagtggcgcgatctcggctcactgcaacctccacctagcaattctcaaacaattctcctgcctcagcctcctgagtagctgagattacaggcacctgccaccatgcctggctaattttttgtattttttagtagagacggggtttcaccatgttgtccaggctggtctcgaactcccgacctcaggtgatccacccacctcagagtgcgaggattacaggcgtgagtcaccgtgcccagcctgcgtattttaaaagatataagatgtgcccaggtaacaaaaaatgtgtttaaatgccctatatcgggccgggagcggtggctcacgcctgtaatcccagcactttgggaggctgaggcgggtggatcacaaggtcaatagttcgagaccagcctggccgacatggtcaaaccccgtctctactaaaaatacaaaatgaatgaatgaatgaatgaatgctctatatcaagtggtaagcccgtccgaagactgcagtccttcagatcactaggatgctgctaattgagtaggacacagcagcttacagtaaatattactttctggctactttcttatgatagttgaaattacatctaatttatcaagaaagtgaatgcttatttgatttggctatgaaattatgctgctcagttttaagatgtcttcatgaacccagtctcagtgaagatgtttctgtattttagggtttgtttgggttttttggcctcatcctcccacgaatgtttaaaattagcttggcattttaaatctgtgcttttatgttaggtcttagataattataaaatagaagaaaaattaagagcaaaaaattagatatgccaggttttgctatcttgttgaaagtgatcgatcatctgaaagctgtataatttatttagacaaccagttttgtagagtatcagtttacatcatggtgcatataattttacttcagcatactaactctctcttatattaaagagacgaaaccagaagtctaatgtcagcttaatgcccccaagttgccactcacatctctcatttctctagtgacagccaggcttcttgaaaacactgtctgtgtctaacctcccattttttccttactcctctagacctggaatctggcttctcaccctacacccatcacaatcactgaacaataactgctttttacaggactacttctttggtactacatttggtcctcacttctctatttccctccttcatagcttctttggccccacattcaattgtctagttacttatcgtgggcctcctctgtggatcactcttcctccactgcttcttacatgctgatgttccccagcattccatcccctggcttctgatcgctgggcaaatctctcaacatgaccacatgtcctcccctagtttcagcctcactcacatgcagatgattcctagatctgtctcctgaaggcagctctgtgtatccagcaccctactggacacctcacaagtcttaggttaaatgtacaaaactggatccatttttacctattgtttttctacctactcttcttattttctcagaggcagtgaatagcagcaccaacaccaattcttattttctttgtgatccctttgtctcctcccatatccagtttctaaattttatcaagttcactatagccttcatatcctcaaactaaccacttttctctccatcttcattgctgaaatctctcatctgcttttgccttctcccatttggcttgatcttatcattcaatacttttacatgcttttattgtcattctagtgaaattttgaagagagaagagataacttgtgatgaattcattgtgtgtacacggaagtctaagccagctttaaattaaagcattaatgttttggaaaagttagaaaatacaaataaacaaaaattttaaactaaaaaaacctgaaattataatatactgaacactgactcttaactaacatttgtctatattattgcagatttttccattccaatatgtatgtc

SEQ ID NO: 115112 - DNA, 1021 bp, Homo sapiens
catgttcaccaggctggtctcgaacttctgacctcaggtgatccacctgcctcggcttcccaaagtgctgggattacaggcgtgagccaccatgcccggcctaattttttatatttatttgtagagacagggcttcactattttgccaaggctggtatttttttgacgttaaaaaactttaaatcaagtttatatctgctgtaaatttccattctctgtttatttcttggacctttatgcttcgatttctcatactcggctgtgctttataaattgcagttccttagccatcactgccattgtcatcactagtaaataatatttatttagtgcactcatgctttttctatagcagttgctccaagtaacatcacagttgcacaaacaagctggatatgatagagtaaaaagtaattaatatttttagaaatttatcttcaagtatctttaggtcattgcaaacatgaaaataaggaaactctgctagtattaaacttgaaatcacttccagtacgtaacagaaggcaagagacagaccatcagatagattttattcctatatactccttgacgttgaaatctcagtacaataccgatattggagggtgagactaattctcatttgtgatttaactgtttaaacaggttcatattttatgttccacagaaaatgccttgaccggtgatctcggtaaacctgtataataataagacagtgatttctggctctaaagtctctagaagaaagtcataattataatgttttatattagtttggacacatgtgaaactgacacaattcaactgtttttgacgtacaaaaaaagaaacaaatgttacctggtgcaacctaatatttgctttgtaaagcaagcataggagatatctgtactaagacccggaaagattaaatgacttgttcaaggtaataaggttaacaaatagcactacttgaattttaaaaaccaagttttctgagtcaaagtccagcatatcttctactataatatactgtgctact

SEQ ID NO: 115113 - DNA, 1008 bp, Homo sapiens
ccacacaaccactgctgtcagtcctgctcatataccagggttcccctcatgcctccttcacagcacctttgtttacatctccctgaggtacacataaccagaagactttttatactgttgccgctcaccttcttataactgattaccacctcacagacagaaagtagaatggagaagttcagtaaagaagccagaagatcagttttctctcctaggtcttggatacatcacctatgattatcaagggctctctcaagattcaaccagattttaattaattctagaattagagttgcctcaaattctgtgtgcagcaaagcagaggttgtcattaatccattaataaattggacatttaagatctataaggacatagtttttgttctttattttgttaactattagaacaatgtcatgtttattaaatatttgtcaagtgattgaaatacacaaatgatgttagacaagaagataggctgaaagtacctaatatagtgacctttagaattctgccattatttccaatatctatgcttttgatctctgctcacagatacatggtttccaagcagaaaacagtgagcgcagagaaacttctgtttgcttttaaaataattaatgtctaccaatatatggcagaaattccttaaaggggcagggcgtgttttatagattacatttaagggcagattattgaggaggaaaacaaatcacctagtaacctcataaaaatgacatttttcagattaagtcacaagtaaaggagacttaattgacactcccaggcacttacaaccacttagctgcccaggcactgcctgtgctcactttcttctccagccagatcaacctggtaagtgtgatccaggtctaaggcaacttgccaagaggtgggtacatgacagtagcttgctaaagggtaggctgtacccaatttaaaaatcagttgaaaagttaacatgggatttgtttctgtgggaaaacagagtctagcttgtatgcaatgtt

SEQ ID NO: 115114 - DNA, 1057 bp, Homo sapiens
ttggggcaatcttctagactacggtttggggctgcttgccagccttgcccctccacatttgcccaagttatttttttctgtgctggaaatctactcatctcagtcccctgcttaaagttaagtggctccccatatccattagtataaaagttcaagttctttggcacagcatagaagacgctctatgcatagaagcccctcatcacttatttccagccactctggctcatgtgacatcccagtgaaatgttgtagtttcctaaatgggtggtgtcactaccctgttcttggagcatgtgcaaatattattcctcctacctgcatgtacttcctttctactctagactcagccctagtgcatttttgacatgccacttactcagctattttggtactcgtgtggttgcctatcacccctgctacactaccccagtagaccctcagtgcagggattatgtcttatttgtgtttttgctgcctgcatagcatagtatctgggacctggagggtgcctaaaaaatgtttattaatagatgaatgaactaaggaaacaggaaatcaatttctttccttccaataaacagaacattgatggcacacaggctaaatccaggatgtgcgaatcttcaatcctaaaggtatcatgagtctgtgacagcgggtagctttccttgatagaaaggtatggccacttaatatcctttttgccatttttgttattatagctacacacccagatgacgtaggcagagccagggaccctggccaagcagctgtactgatgttcctagacctatcagcagccttagtcaggtcaggtcaacatgttctactcactcacccacctgcaagccttgtggatggttgtgtctcaactggctttggtccttccccagaagaatcatatgacacttttttcttttaatttcttcagtttcagattctttctcaataggacccttggcattgccacgccccatgggcctagatgctcctagtatctttccaatgtcaaataaagccagcaagtattgccaagagagggaacagaattaga

SEQ ID NO: 115115 - DNA, 1688 bp, Homo sapiens
tcagaatactggactttagcatacctcttgcctgctgtgatgcttcttttatttctttcttttcttttcttttttttttttttgtagagacagggtctccctgtgttgctcaggctggtctcgaactcctggcctcaagtgattctcccatcttggcctcccaaagttctaggactataggtgttgagccatcatgcttgccctgtgatatttcttttagttgctgtgacaaatggatgactccgggagtagatagtaaaacaagtttcggggaagctaaggagagatttcaacattcagtctttagaacattagggtgggcattaagatttgatgtcaggagtctcttattctcattgcaaaccaagtggttgcctgtgactgaggagttatgtcccatacatacagataccactatttcaaatatagatgaaaatatatgtgaataccatgtgattattaaaaatacaaatttacccataaacattcctgaactggcagtgacttaaagcattgtatattttctcaggctacagatactaagcaatataccacttgtaggattcgattcttccctaggttcctttttttccccctttctttacattgaaatgtttgggaacacatgacctagacctttttggatttaggtgttagctggagactaaaaccactaaataaagtttttgtctcttagatggttttgtgctaatgagtctttcctcctattataggcgaaaagcctcagaccttccatttaagtggtgcactttgtatctttcatctaaagaacataaaatactttataaaactccacagtgatagaaaggaggaaaagttgttggggcgggggggcagaggaccgggggacttgcccaaggtcatacagggtaccagtggaagcactgcatagagagcaccagattctcctgacttgaattcattgttctcagaccttgtttccagagacttgataagacttttctgctctaatttcatcatcaaagagcttggtttgaaatacttacattttgtgctggtatctttcaaaatatgatatcttctatcagcagggtcaatcacttgccttagtttgttctggcaaaattgcatggacttaaattctgaagtaatattgatctatattccataaaaactcagaccaggtattcatgacacagatttgatgggaacacttacagattaaacaggaatcatctaagaagtgaagttattactgacagccttttagttcctcaagtgggaaaaattactatgtaaaagactactgtgctacattaaaacaaaacaaaacactattagtgggaattttttttttttttttttttttgaggcggagtctcactctgttgctcaggctggagtgcagtggcgcgatctcggctcacgcaagctccgcctcccgggttcacgccattctcctgcctcagcctccgagtagctgggactacaggcgcccgccaccacgcccggctaattttttgtatttttagtagagatggggtttcaccatgttatcaggatggtcttgatctcctgaccttgtgatccgcccgcctcggcctcccaaagtgctgggattacaggcgtgagccaccgcaccttgcctagtgggatatttttctaacctatgccttgaatttcctagttttcacattataatttgg

SEQ ID NO: 115116 - DNA, 1133 bp, Homo sapiens
ttagtggtgatcagattcaaagactagtgacactgggtgtcatccccaagccccaccgaaaaattcctacagagagacatcaggcagtgaaggctgtcttttgagtgtctgaaaacgagaaagtcaaatctggggacctttggatttggggatgttaaagttgagtatacgggggttaattttgtcggttgctctacttttgtgtgtatttgaaaataccataaaaaagaatgatctgttgtatacccatgtttgtagcagcattattcactgtagctaaaacgtagaggcaacccaagtatccatcagcggatgaatagataagcaaatgtactatatatacacatgcaatggaatgttattaagccttaaaaaggaagggaattctgacatatgccacaacatggatgaattctgaggacattacgctaaatgaaataaggcagtcattaaaagagaaataccttgtgattctcttaaatcaagaatgcagagtagtcaaaatcacagagacagaaaggataatggtggttgccagggtttggggagagaaataaatgaggaattactgttttatgcataagagtttcagttttaaaagatgaaaagagtaatggcgatggatggtggtgatggttgcacaacattatgaatgtatttaatagcgctgaactgtacacttaaaaatggttaagatggtaaattttatgttgtgtattttaccacagttttttaaaaaaatctgagcccaacctaataggagatagggggaggagtgtgagagtgtgagcagagggagtgaggatgtgggaagaaagacctgctgttcttggaggaggggagtggtggaaaaggttgattatgtagaattgggagcacccttggtattgtgagtacaacatttgcatgtactcaccctctatgtaaacacatgggctagaatctggctatgtagttgttccattcttgacaataatttagatagtgagctttttacatagataagtagaaagttcaatatttaaaaagtgacccccttaattaggtcctgctataaatgaagctggattttacatatgtgagggtaaattggcaggataaacagccataattgaaggtcaaaggaagtggcc

SEQ ID NO: 115117 - DNA, 1035 bp, Homo sapiens
aggctggagtgcagcctggctcactatagtgatcctagctcactatagacgacctgggcttgagcgatcctgctgcctcagcctctcaagtagctgggaccacaggcgtgtgccaccatgcccagcaaatttttaaatttttcaatgggtttcactgcatttcccaggctggttttgaactcccagactcaagtgatcctctcgcctcagcctcccaaagcgctggaattacaggtgtgagccacagtgcccagccttgtgctttctttaaaactttttcatgcctcccaacgtgctaattactgccctgttcttaatctagtcttacacaacaaagtgcccttaaaactgtttacattcaaagtgccttttgcataagcatatcaaaattctttataaacactaattaattcacactattctgtggaaggagtcgctctcatttttcttttcaaaataaggcttttggttctttggcattgtgtacctgtcttcctacagagaaaagttatcgtcagtttctcaagagcagagaatcaaacctcgcagaactttataaacctcacttagcattgagctttacaaacaaggggatacacacacccatacacacacacacacacacacacacccctccctggtaagggtttgttgagaatgaagatatcacacttcatattcaacagtgggtagatatatctaaatatcctagaagtctatctcatgctcagggtgattattgactcacattttaagaggagcctgagatgaatcttttttgtaaagcgaggaatgtttttgaaatttgaagaatcaccgtttagtcagttaccggataactagactttaaagtgataactagactttaaatttggccataggtgcatttaacacacgatcatagaataacattgagtgttcccttaatttagttgtctattattaataaatgccagataatttagaaatgttattttttatccttcaatagctatacaatgtatattttattttctccattttacagaggagaaa

SEQ ID NO: 115118 - DNA, 1035 bp, Homo sapiens
atgttgttaaattgctattacctagaattgtgtgggaggcttttgcaaagtagcagagagaggaaagaaagtgcacagacagataaaactctaaggagggaggagaaccccagggcaaaagcaatatgaggtaaacatgcagaaagctgaaataggcaaggtaaaaggtgcagaaagttgaaataggcaatgtaaggacagagtttgatttcaaagatagaaaaggaaattgtgagatgattgcaaaactgtcatcatcatcattatcttcatcattccttctttattttttagagacagggtctcctatgttgcccaggctggtcttgaaccctgggcccaagggatcttcctgcctcagcctcacaaaggctaggattacaggcacgagctaccatgcccagcccaaaactgcattctatgactcaatcagtggtttatcctcaacagcaaatagaaataaataggctatgctcaaaggaaagaagagagttaacagtttggttccaaggctaacgactaggagtgggattattctatcattaacaatctgcactgtgtttcctagacgaaaatgtgtatcaggtgaaatgacacatttctacttaacatcatcctaaattagtgcttttaatatctttttttccacaaagaaatggccacattttttaacttctttttttttttgagaaggagttttactcttgttgcccgggccagagtgcaatggcgccatcttggctcacagcaacttccacctcccgggttcaagcgattcttctgcctcagcctcctgagtagctgggattacaggcatgcgccactacgcccagctaattttatatttttagtagagacagggtttctccatgttggtctggctggtctcaaactcccgacccacctcggcctcccaaagtgctgagattacaggcgtgagccactgtggctggcctgtgaccttttcatgcaatgtaccaatactgtacagccattgtgcctaaatatgtgatatcttacacatttgagatggat

SEQ ID NO: 115119 - DNA, 1039 bp, Homo sapiens
agtttaactaaaagtttaagaaaactgggttttttgctcacccatctagctgaacattctcctgaacatctgcctgaacatcctcctctgaagaagccaatgagaattattgataatgtatgaacccccaggagacaaaccttttacaaataaactgaaagacaaggaagtaaagttatatacagttattaaggaacactcaaccacccctgctttttaaaaccacataatgaagctttagcacatttcacccttattctgtttttgtttctgttttaagctagagactctttgggtcagtggtttccaactggagaaagtacttttttgcctaggggactttggggaacgtatgggaatattctgattatcactataactggggtcactgctagcattttgtgggcaggggccaggaatgccaggacaaggccaacccccgaaaagggagaattatcatatcttaaatgccaggagcatcctcattgaaacactgagcattttaatgaaaatgtactcttcctttgccaaattttcttactgataaactatgataaactactcttgaagatgagtaatctatagctattttgcttatttggaccttagtagtgtaactgttttctgacattggacactcaataagtgtctgccaaaatactgagaattatgagtagtgaggcatcaaatatttaaaacatatttctgttttatacataagcagtatagtcatttttaaaatcatttattgcacacccctaatgtagacaaatgtttataaaatattatttgaattaaatgcaactgcacactcacatcatttaaaaaaatccccaattgcttttttttttttttttttttttttgtgacggagtctcgctctgtctcccaggtgtgcagtggcacaatctcggctcggagcaacctccacttcccgggttcaagcaattctctgcctcagcctcctgagtagctgggattacagtcacccaccaccatgcccagctaatttttgtatttttagtagagatggggtttc

SEQ ID NO: 115120 - DNA, 1045 bp, Homo sapiens
ctcagatttaacaaaaagttaaaagaaaataaagcccttaaaaacaaacctaatacacttatcattgttgtattagtatgaaatgttgtttctttacaagcctaaaaggagaggtcattatttttgtagctttccatagaataaggagattgatactttataatgttctggaaaccagatagattttgaagttttgaaaaggttcagtggtggtcatcatggagtagttgagaattgtctaactagagtggggtattgactttacaaatatttatcaagtaccttctgcatccttagcactctgttaggcactaggatatggggagcttgtgataaagagatggaaaagatagtggctctcccctcaaaggtgtgtataatgtattaaggtacataatgcaaggaaatgaataaaagggagggtggattactgagtctagtacctaagcacacacaacccatttctgggggagagggttgcaggcagggctggctacataatttgcagggcatagtgcaaaacaaaaattccattgttcaaagtcgggcaaaaagtaccattaaaagtactaaaatataaagttttatcctctgctcatccgacttcacttacaaaacacaaattcagagataaaattattaagaatttcaagatagtaacagcagagtactaaactaagcccagagcccttctgagcctgggccccttttgaaagtggggtcttaggcgactgcacagtggctcacacactcatgaggccagccctgggtacaggggtgattcctgtgaaatctaatatgtcagcactaaaccttttttcaaggaagggtttatatagagaaatttgaacaagtttgtacagatcaaaatggatatgttttgttaggtatatgttttatttatttccctttttttggttaggaattagggacagggattatttcttataagggaagacagagactagggtatgaaaaactcagaggaagtatcagacttggagaaatatagtgatactatatgtaccgcagagacaggctgggt

SEQ ID NO: 115121 - DNA, 1743 bp, Homo sapiens
aggggcacaagaatgatgtttctaaatttctcaagtttaattccaggccaaagtagagatagatagatagatagatagatagatagatagatagatagatagatagatagaaagaaaatattttctgactgacattctgacattccattccagtcctttagatgttagactacaaacaatcacaggtgaattctttggcaacttaaacctgttttcatagctcaggctttgtttgagggaaaacagtttgattttgaaggaaattttcaaaattctcatgaaagaccttcagcagaattgtggatcttcaatgtgcatgtacttttcataactcctatctataaaaatccacatttgtgagaaatggctggctgataaatgtcaccagtttgaggatgtaggggattgtggtatgtagccatgttgttcccagctcacgtgtggttgttggccaaatttgaagcaaagagatacagcttcattcatacttatgtgtcattattccattattccattctcactgtcactgttagataagtcttcagctgtgaataccacatttcccccactgtggtacattgtatttgtaacttccaaaatgagctagttcataaactacattctaagttaccctgggagcccatttgctcattcagaatatattttgaagcccatgcccttcaccacagtgcttcaggtacagcccagagtgtttacacatttagtctccagactaaagcaggggctttttccattgactactactaatggccaatcgtttttgctcaatttgcattgagttcagaaaattattaactatcaagacctggttaaaggcctacttttgggctttctcacaatgcagaatttgactggtcaatagaaaccactctgggtatctctgaaatgacagagatacacagaatcattagcaatgagagcatagttagaaattcagaaacatatattacagggcagcaagaagagacctgtgatacagaacttgtcaactttgttgaagaaatttgcaaatatatgcatctgttagcgatcagtgtcctgacttaataggcaagtttaaaattactgattatgctgatgtgcttctgatttctttttgcaaaacagatgagtagtttttattccaaaatttgttccaaatcctattttttggcagtgcgctaggtttagtcacagtgtgaataaagtatgctctctctgtcttgattactctgcctaaaatatctcaacacagtgtacatttggtccctcttagattattacaactaatgttaaacatcaacaacttcttcttttaagctaatgaaaaagttgcaattgacactcttattacccttatgacacctccccaaacccaagttcctcttctcaattctccactattttgactactcaataccctctctaggtcacttcctttgcctctcaaccattgccttttggttttgtgtccctccattaatgtttagaggacgactgatgtctttcattcatctttggataaagggcaccattattaaattggctttgctttattccatgtgtgtcctggatctgcctcccctcttagtagccaaggacacatttctgagttctctatctatgcttgccaaaatgggaaaaagaaaactgttgaacctgaagtcttgtaagatacgtaaccaattcaatccatatttttcatataagtgattttttagcgtccagtgactccaaccattg

SEQ ID NO: 115122 - DNA, 1062 bp, Homo sapiens
tttgtagctcatttattgaaaaatcaatctacttgttttacttcattgtcattgctttgacacttataaagtaattattaaatgtaaggtgaatgttactactatgcatggattgtttagcaaatctcctgttcaaggagcagatttttagtcctgttgagcctgcccttcaggaagaaatgaagtgagtggggcagtgtttttgtgtttttcgggagggctttccttttactcaggtctgctaaaagaatgcaaatcgcttcaaaacagtcatcattctccctttctttgtggccttatgtgttggtcttaatctcctcctttctgtctttttgtttttgtttttttcctcagtaaagagagtcaggagcctgccctttcctccctttctctcacctcacctccagggtggcctgagaattgaggaagaaccttaaattctgctctttgttaagagctctgataactggaactgttggaatattgctaaaatgggttttggagatgttccctactctccctgcctgccatttccacagattactgaggattggctctgttgccaaatgaggctgatattgagcctcaaattttgacccatttttcatcaagtttgtcttaatatagaagttgcaagatttagtagtgcagcaattattgttcttatagaaaaagtcaactgcatgtttgctgaattccatctcttgggctgaagacaaaagagtttgtgcacaatattcgcagtccatagtgttgtaagcaggaatgtctgcagcagccagagagttcagggcaatgttttttgacctgaaacagttacctacctagcaaatgtaatacaaagcctaagtattactttctatggaatgtggggtgtttcataactaaacaaatcagtgatgctggaataatatgctttaaaaaaaccttacaaatctatatttgagtgaatgaaatgaatgttagaaagtttacaatttttatggaaagctggtaattttaggttgttgggtggaggaaaaggagggcaacacactttgctaagttacttgaagttcctgc

SEQ ID NO: 115123 - DNA, 1947 bp, Homo sapiens
gtgaaagtataggtctggttttttaaaaaatggaaatagatggtgcttacattcctacttgattcttcaatttataacaacccaattataaatattactttttgttccagattttttacagaatcaagtgtatgtttgtataaggctacattggcatgagcattagaatgtcataatattcacatttccttttcaaatttaggatgtagtttattacatttctggaattatgcatatgcagaagatctaaagttgaaatttgaaaatttgtaaatacattcagagattgagataattcagtgacttcatggccccaacatacttaactgtcgttcaatatgatattaattgaaggcttttaagaaatccttccaacaaataatagatttctaggtatagccctctgtagttttaccgaacactactttaagtagatatgaagattctcagatcatttgttaagataaagcttccgaaataataatgtagaccctcttaaaaataaaaactaccagagaattaattgctttagccttatctcaaagcaaatggaaacctacttaaacaatacgtcgtttacttacctttgacatatgtggataagggcataaataaaatcacttggaaaaaccttcactgttagatgacaaacttaggtacgtctcaactgggttaggaacataaaaagaaaaaaaaaaaacctgtttatctttttcagggtgtttcagaaagtcttatactttatgataataaattcatcaattttataaataaattaacatacatattttttcattaaatttagtagttaagatgccaatgcatttcattgacaaaaaactgtttaacaataaagaactcaatagtaccaaattcgtaaagaatctgatcttgttccttaatttagcctacatgcattatcttaaattgtgcagattatagaaaaaaacaacaacattgggaactataatagattattcactccgggtgtttagttctgttttgttgaagaaaagggagaaactttcttacatgtttgttacttctcttccccaagttaaggctagactttacggtttgtttagctgtgaagggatgacagacttgggggatggtgaggggagcttagttttggaatgtaaatacatgtagagcttgcctccttttgtttagcatctctttaaactaagacaaaaaaaatcagtgaatgaatgaatagcagcatggtgaaatacctaaatgtttgagttaaaatttttggatgtttgaaatcctatttggatccttttcccagatcacggtgcattcatatgcactcagcaggaaacttcatggagatgcacatttgggcagaaggtctttgacggtgcctttttcttaacttgtgccttttcttctttagaaaaaagtaatggcttaagtctgactgaagaacaatcttttttgtatgttccttataagaatttacttatggttcacagatttttacccaccatctatgtctgcaatccttggatttaaaatagcatatatcctactgcagactacaggaaacaccaaattaaagacttaatgacatactgttgaaaaagacaaaaggcaacaaattataaatcaatccactaaacctttaaagtgaaattcacagaaaaaaaaatgtgcatttgagctaatggttttgtgaagcattagagtttttgtgcttatgtaaaccaaaatacaggtaaacttggcggtacagttggatttgaatccagatattttttaaaaactatgatgaacatgtggaatgtgcttcttcactaggcaacaagcctagtgattatatgggtatttcggtacttctaaatgctgctcatttaaaaaaaaatgtttacccctttttcttatttttagaattattcttcaaatcctgattgtttatggtatctatctagtaatgtggtg

SEQ ID NO: 115124 - DNA, 1139 bp, Homo sapiens
gaactccagaccttaggttatctgcccacctcggccttccaaagtgctgggattacaggcgtgagccactgtgcctggccctaaaccatttttatgatggctgattttaaatccttgtcagaaaattctgatatctgtgtcttggtgttagtgtctcttgactgtcttttcttttttttgagacggagtttcactctgtcacccaggctggagtgcaatggtgctatctcggctcactgcaacctctgcctcctggattcaagcgattctcctgcctcagcctcttgagtagctgggactacaggtgccagccaccacagccagctaatttttttttcttttaatttttattagagaccaggtttcaccatgttggccaggctggtcttgaactcctgacctcccggccacctgagcctcccaaagtgctgggattacaggagtgagccacgaagccctgctgactgtcttttcttattcaagttgaggtgcttctggttcttggtatgacaagtcatttttcatcaaattttagacactttggctattatttcatgaaattttggatggatctttttgagaccttctgtctagtagatgtcgtctgatactgctctacctctttacttgttcaatggggttggatgtctgggttacccactaagtctttgttggcatctggtgggtaggcatacctcattattgcttggcaggggcaggagttcaggctccttaccagccttcccatgatacccccactctgggagaggtggggattcttactgctctgagtacagtctctactgacactgcaggggggtggccttggtactgcaaggtggtggtgaaagtcctaactagtaggcctccgctgacactgctcctgtaaggaggggaaaggacacatcattcccccagtgccagtccaggttcctggaacgtacacagtctccattgacagtgtgagagggggagggtcaccactgatttttaaaatctcattttaatatttcagatatttccaattataagtaactttaatacttcatatgtttacttttttggttatatttcttttagatctacagatatatttagttttttcatactagttttaacaaagctcagagcttacaatt

SEQ ID NO: 115125 - DNA, 1039 bp, Homo sapiens
actttccatttgttccacaaagaaaggattgtttcatttccatttagtggcaggaaagtgctctcatgtttttctgtagatatcaaatctgcctgggatttggccctacttttcctttatctttattggttttagtaaaagtggaaaatttatgttaaaaaatatgtgtatataacataaacacacatactacaaatagacatataaaacctacttttatcattttttgtatcactttatgttgaacacttcatgaaatgtttattccacattaacttatttggtaaatgcataaaaaatgtttttttccttcttgaattgccttttcaaaagcctctggattttatatgttatactttgtgagtatttgtattaactatagatatacatatgtatttgtatatatatctcttttcttgacactacaaattctttatccagattattgagtaataggttgttattgttagctgttctggttaaatatgagtaaccatatgttgtttagatatgaggaaatagggttatgtgttatgatgaacataaatacattcttcttgaatatttgcaaagtaactcataggcttgcttaggaatcctcattatacatcttattcctggagacataataattatatgaattgagttagtaccataccgaccctaaaataacaagtaaaattgtatcagatattaattttaaaattgtgtctttttactaagtttttatacaatacaaagtattaaaaagtatggataaatctaacatcgcagtacatgttactcacgaatttggttttcttcacaaatctgcaaaagtaccattacctgcatgtagcttcatgttacataactgccattgatttttattttggaataattatagagtcacaggaagttacaaagatagctgagaaagatcctgtgtactcgtcaccgagttttctccatggttgcattttataaaaccatatagtacaacaaccaagccaggaaacttgtatcgtaggggccaagggcaagcctccctctttgcctt

SEQ ID NO: 115126 - DNA, 1053 bp, Homo sapiens
taaattgaaaggtataggccaggcacactggctcacacctgtaattccagtactttgggaggctgaggtgggaggatcacttgagcccaggaattcaagaccagcctggccaacatagtgagaccccatctctgcaaaaaatacaaacattagccgggcattgtggtgcacacctgtaattcccaggtactcaggaagctgagttgggaggatcacctgagcctgagaagtcaaggctgcagtgagctctgattatgccactgcactctagcctgggtgacagagtgagaccctgtctcaaaaaataaagaaagaaaataaattgaaagctataattttggtatgtgacagattataagatagactttgatttttactatgtgcagaatatgatttttattcacttaataattatttcttgaacacaatatgtgtcaaagttgaaacaagctagtcagtctaaaaattcagcattaactcagttactaatgaaaaactataaggaaatgatttaacgcatgaaattatttacttctttgataaatggtcatcaccttggtactaaaaatgtatttaggttttcttggtttgtttttagaaattatcccatcaagccctctgcttcttggtagaggctattataggaagttggtatttctaatattcctcccaaagaggcaccttaagaaataacaatacctatgatttgaaaagttctataaatatttctaagaaaaagttccaagaagatgcacaatattcaaggcaagtaaaatcctcccggaaattattactgttataagatgatgctctagtagcataaaatattcaaaatcccttcctggtcaatttatccctgggaaatagctttctcactaatgtgatcggattgtaattaccgaaacaaacaaacaaacaaacaaacaaacaaacaaataacttgccagtagcataggatctttcccactaaactgaggaaagaaaagcagtgattatcccttatcacttggtattgcttttattcagaaagaaacacatgtcttttcgttatag

SEQ ID NO: 115127 - DNA, 1068 bp, Homo sapiens
ctaaaaatacaaaaattagtccaggcatgatagcagatgcgtgtaatcccagctactcgggaggttaaggtaggagaattgcttgaacccaggaggcggaggttgcaatgagcctagatcacgccactgcactccagcctgggcgacagagtgagactctgtctcaaaaaaaaaataagaagaagaataaaaaaacccatgaataaacaaatgtgtcatttagacctaagaaaaatttaaaagccagaagagtcttctaaattttctctcttttgaggataaagtcctcacatgctccattctcagccttgagagggatagagtaggagtttctagagcttgattgcctgtagtcagtatgaggtggaaaatgtattttctgttagtaagtagaaaggctgctctaccttaatcatgccaattatatattatttaatcatacctgaccagtgattggaatgatgatgatacaaatgtttttcttaggaattaggtgtttcacaaaatttccaaacatcctttttcctttctatataacgagcccaagaaaaactttgtcattgatatcacaaatctagtgtgtgtgtgttggggattgtggaaggatgtagatgatctgtgtcatggggaaactgcatttagttcttgcattttgcgaagtctcgggtgaaggacaattattttttagacaacaaagacaagagcatgtcaagtactctcgccatgaatggtggtatattttggaatttgttttttggtagaatggggcacattcaggtgggccattatatgatgcagctctgaataaactttccataacacagctttatttctcaagtgaattatatcactgaagcaacaggtcgcatggtctgttgcctccagggtagtgcctctacagctgggcaaatgttatctagaataggacaatcctcttttctcataagtgccatgtattctatctacacttcttctgcacaagataaaacttgaatgtttcctttaagacctcttccagaatcttcccatcatgaaatagaatgtcgtctattcatctactttgactga

SEQ ID NO: 115128 - DNA, 2165 bp, Homo sapiens
cagttttaattataaaagatataaaccaagaaaatatattcttccttatatatgatgaatcgcttttacgtaaattaccatttaaaaataaaatcatccctttgaattttgtgtctttggatttattaagatgtgctaaaattgcttatctttacaattccacctaaaaccatttttgaaatataatccagtataggaaacaaaacactaaatctatttaattttggagctcaaatttctcatgacaaaatacatttttggactttaaaaaattagtcataaatataattgattctgaaataattaggtttttattagtctgaaaatagagctcatcccatcccttttatccatctgccacattaagtatctgacaatctttacaagtgcttctcattcagcttatacaaaaatatagttttttttttcccccaagtgagttcacaggaacaaagtatggatttgaaggaaaacagagtcctacgcttggtataccctcagcgtttttatcagaggggagtaaacactgaaggaaatgaggtgtttgccttcagtcagtattggaatatgtagaaatgtagaagtagaaattggatggactatatcttttaaatctgattttaaataaaaagcatttctatttaacatattgatattattactggtgccagaaatgagactataaagtaatttattggataaattttatttgaaattttaaaaacattgcaaataatgtgtagtcacttttaaacatgtaatttacatgagggatatttcattttgaataatttgatgtttttctttgattcccagaatgtttcttatatctgatcaaaatccctttttttttttcttttttacgaagcggggtctcactctgttgcccagactggagtgcattggtgtgatcttagctaactgcaactttgaacccctgggctcaagtgatcctcccacatcagcttcctgagtagctgggactctgtaggcatgcaccaccatgctgagtttttctttttttagaaatgggatcttgctatgttgcctaggctgatatcaatgtcctagcctcaagtgatcctctcacctcagcctaatattaattttatttttctcactttataagtaagtagttgggagactttagctaattttttcaagtaatttttcttaactcactgtttaatggacttgggttttaaaaaatagtcaatttctattgaaagaaacatagttcaaatatgactctattaaaacaaaaaatgtatcggaaatagactctgtattggaaatagacactgcattggaaatagctctcatatttaaaagtgggctttatcattacattatcttaagatatttcttaaagatttgctaatttagtaatgatgtctagttcctggatattcctttgtttggaaaatttgtgcaaatttcatttgactcatcttgatttggaaaagatgaggtatactcttcaaaagagttatgttttccctttctgttacatttctgatgaccaagtattaatatatcataaatacatttaattaattttgacactgcctaaggaaacctataaggatatgtgttttattctaaaataatcaaagttttttttaaagttacttttaaaataagatgaatcatcttttggcctacatgtcattcattaatcctgtatgagaatttgattactatgtctgtacatttcttcctccagacagttcctttatttgatatcataactacatctgggattgagttcttaatgtgagtttaacaaacttgtgagctgatttcataaagctatcaaaagcacttgctgataactgaggaatatgattcagtatgtctctgaacttaaaaagtattttaaaaatttaaataactgacaggtttttttttaattaacctatttcatttgctatatttgtcttgcctatgttctcagccagaagtcgttttcaaagggtgcatgtgttttgacttgttagaattttaatattttagattaagtcattcaaaaagtatatttcttaggccaggtgtggtggctcacacctgtaatcccagcactttgggagtccgaggcaggtagattgcttgaggccaggagttcaagaccggcctgtcaacacaatgagagaccgccccccgtc

SEQ ID NO: 115129 - DNA, 1513 bp, Homo sapiens
tgatgatgatttctccaaagacagcaaatgtcttagtatttgattgtcccttattttatatctgtgaatcatatatatatatatatgtttacaaataagaccagtctgttttattaagctaaaaattatatttataagtgttagtttatcacttaatcttacatgtaaattcacagagtgagatggaaacaaatggaagtcttatttatatcactctaattttggtttatttcactgttcaattattcaattacctttaaggtatttcattgttttcaatgacttacatgaggtttacacttgagttttgatgggctcttggtggaacttagttctctgttatttttggaatgcctctgtttgggattttatatatgttttaacaatttatcattataattaagtaaacttaagttcatcttgggaccatcacaagagtattggtaaagatgcactttaaaataaatctccttatatttagtctagactgctaagtactaactacatctgctctgcagagaatcagattaggccaggagagtcttatgtcttcattatgccattattgcagtgcataatgtttggataaaatataattttcctgttaactctaagcaaggtataaataagcaaaaactttttaggaattagcaatttcattacattcacttgtacatgctctcattaaaatatatgttgctataatcagctataaattactgggcattaaattaattacataggttatatacagttggcaattaaagtatgattttcaattcaaggtgttgattagacaattaaaatgattactaaataaaaaattatttctaagatatgtaatagtttggagattcggatagataatctaatactgtgatgaaaggtccataatgtttgcagaatttggaaagccttgaattaaaatcattatattgctgccaagaaacagtggaaataaatgataggtttgttttagcttgttagcatactatgatgtccccttgagttgcaaatataatatttttaatactataacgactctaatgaaatggaggtaaaaacaaatgaagttttaaaagtgcctatcatccattttcaggtgtacttaagcatttcattattaaataccgtaatcatccctgaagttcacaatggttgccaatagtcctgggtcaagcatactaaaacctttgaaatattttctagagtgtctatttttacttggcaggtaaaacctaatgataattagggtggaggcattagacatcacgtaaactttttctagctattgcttttttagttcagtggctagttttcagtgtggattaacttaatctgtgcaaataaaaaataaatgattactttcttacatttcattcatgtatttactacattttctgtattggtcatcatttttcacagaaaactatgtaaactttttctttatcttggacatatttctaagttcaatgtattccaaatagaaaaataaagggtaaggacagaatat

SEQ ID NO: 115130 - DNA, 1981 bp, Homo sapiens
tgggaggctgagacagaagaatcgcttgaacccaggaggcagaggttgcggtgagccgagatcgtgccactgcactccagcctgggcgacaaagcgagactccgtctcaaaaaaaaaaaaaacaaaaacgaaaacaagcgaacaaaaaaacctcttctctttcattcccaactagaataaatgatctattggaggattttttaccaaacaatcctttggatatttatacatagctacatagccctcaaatccttgctccgccttttctctgcaactcagagttccctgattcagagttcctggggcgtcaatttcagattgcttgcttttctcattgccctctatggatgctttcaattccaactatgaaatgaaagatgccatctaacgctaaaataaagttcctcagagttggagtgaagagtgtactatccagcaatggaactggtacctcctttgatttggaagtactactctttaaagaagcatgtgattgtaataatattttaatagccaggtcatacttgtggctcatgtagagcctgtagttaactcagaccctggagccttgagcaagtctattaacctatcctgtccttggtccctctagcttaaccataagggtcacacctgcctcctgttcatggtaattatggataatatgatgttaaattaaatttataggcaatgttgtacttgaaattcaaggtgacctagttgttgtgcagatgtagttttcagaaagacaaaagaaccattgtcaataaagtaatctatatcaaaggcatattaaacagcctttggaaaaaaattgtgtttcctaggattttgcattctttgaccttcactacttctgttttagcaataagagatttagcctgactactctataaatagattttcaatttatattgccagataatacacaatttgatgagactgaggatggttttcctgagaggctaagttaattggtttatgtattattgtcttgtatgtgtctcactttttcccctggcttccaagcctttgaggcgtatgttactttgtctaatagaatattctcttggctgacttcagcaaaggagtgaccaagtctgctctacacttgctggcagggatgttgcagtaatcacaataaaataaggtcctgaggagaatctggctcagacaataggagttacaaagtaaaaacaaggacagatccttaatgttagccttcttcattatgggagctgaacaatatttgataatcacatttcagtgtattttatagatgcactataaaaactacaccataaaaaatttataaaatctgttatagagcaatttccctccctctttttttattatgtcaatagcacccagaagtttttagaagatactttacttccttcacaggtagttaaaggaattactaaacttcattataacactgaaactctgttggacatggtggtaaaaactgtatttggctttgaggatttaaaaaacataatgaatgcagttagtagctctactgtgatcagtcttatttaataatgtttctcatgcctttttcatactttgtgggaacaatgaacatagaatccaagcttttaggtgctgttatttcatgataagactaagagaaatatgactttctgcaaaaattttaggtattctttctgaaaattatggttgtattttcaagatcctgttgttgctcttattaacaaatatcttgttagacttgatatttgattctctcttcccactggaactttaggtatgtgatagttcacctgtttaagtatgagctttctttcattaaaagagggacaaagtgcattgctgatatgcccttgaccacttttaaaacattattaatatctgcataatgctgttagccaggaagaatgtgccattggtgccagacaagtccaaataggattttaatgcatgacgaaatgtaaagataagaaatattgaagaacaaaaa

SEQ ID NO: 115131 - DNA, 1059 bp, Homo sapiens
cattctatttttaatccaattgtatgttccttatggtcaagaactatgaatacttttatttcttttctcctttctaggacttaatacatactagttcaatcaataagaatatataatttagtcattttttacagatctgtttataaccagtctacacggactatctgaacatttagatattttgaactattctttttattacagatataatcttattctaataagtacccttccatgaggaaagaaagcagtcataggtaatgcaggaaataccaatcaagtaggacagaaagagaaaactaagagcaattgaaggtgactactcttttattctgtttttagcatttccttcaagtgagttggctctttgtagtccactgaggaattgtacagagaaatggtgactggaattcattgccttctgttgactggggggtaaatgctaagtcatttctgaacctacaaccttggcaagctctgccccactctctctatgtctgaacctgcaaccttggcaagctctgccccactctctctatgacctaaagattagacagccaaaaatgaaatgatagccatgttaaggtggctttttttttttccttcttgatttctaacttgtttgctctaaggtaaatgattgcctgcttaccaaaaatctctatttgacacataatagaattgccgtcacatgttgtttaaacaatctgtatctgatatgacgtgcatctagtcacactttaacatctacaataaatgaataggagacagaactagaatctttaggagaattttggagttcagtttgacaaatttagccaaaggttatgaagaaaatacagttcttagccccaatgttcttgtagtctggactttcaagcaatcagcatgatttagtccagcttttaaagcagtcagctttgttatgcaactatacttagaacaaatggtggcccaattgtgtgtgtgtgtgtgtttgtcccaattattaaaggtatgctttgtgttttctgaccagggaactactttataatactggtattgggggtaggagtgcca

SEQ ID NO: 115132 - DNA, 1206 bp, Homo sapiens
ataactgttgtctttccatccgttctttcaatgtctcctgagaagagcattctatattcttttagtctgcaactccctccacaactttttaattcagttgtgctgtcactgtcagtactctacctccgggccacagcgatgccctagcagagtcctttactgaggttttatatgaagatgttgtaataggggttgtctctttttctgctgtggctaagataattactttcttctctgcctacccccagccccacatccaccatgttgcggggagacatgaaacatgcagtaggagagaatgagaccaacacagagagagtagcatgaccaagctattgattagttggttttggtatgctagtatcagtctagctctgttgatgtcttacatgaacaagtcaatctcccttacattttgaaactttcagtggaactacttctgacttgttttgtttaatgcagtccctcagtaccagctggctagagtatacttcctggaatactaaattttttatttcactcccttactcaagaaattcccatgtccccaccagcaagagcactgactttgtgagccatagagtctgaggttgaattttggctctttcactaacgagcaagtctcttcaactcactgaccctcctgatccaaagtcccagttcccggggttactgagagattgaagcatgacagtgtaaatggaaagcccttgataaagaccgagcatgttgagcattcagtgggaatgttgagactcctgagcacagctgtccaggcattccccataaggccctggcctgccgtaccatgctaaccatccactcccttcctgaccaaactctgttgccccaatctggcttacttgctgtccccagtaagccctgcattttcccaccatgtggctccccttctgcccttcatctacttacctgaatttagccatttctttaaaaatcaataaagtcaattccattgctctacagcagttgttgacccatgattctaacatgatcatctccctctccaaatccctaggacattctgttgcctctatcattaatctggcagctaatcatagaatgtcctggtctttcctttttttcattcaaactggtttgtattttgcatgattttttaattttttcaaacactttcattctatttttattttctgtctctctctctctctgcttatgtattttgag

SEQ ID NO: 115133 - DNA, 2047 bp, Homo sapiens
gtttggtgacttgtcatttatcttttgctcacttttaaaaactaagatacttactatttatttttaggctctgcaatttatatttgttacatgtattcttttgtatgtatcaaatagtatgttaaactattaaagcaaaggaacaggaagaaaaagtttcagctgcatgttgtaagtgtgagggtcgattaagaattcagacttaacttcaaactccagccttggtacttattagtcttgcgactttgagaaagttatatactcttaagacctcagtttcttcatacttaaaatgagactaatacctaccctatctgtttctttgtgagaaaatcattaaaacaacagtgttagctaaagatcaagcaagtgctggagacttgacgcatgtgccacaaaggagatgctcaataaatgttggcttctcataagcccaacgatggaaagcttactaatcattaagcaaatatttatcaagtgcctattctgtgccaggcactgagatacattcatgggtctctgagtagtagtattaatatcttatatctacctttacggtatcatcaaactagttatatgacttacagtttaaattactttatagtttaaaatcacatttgagccaaattgtgacattatattcataatttagaaagttaacatagggaaaggatcagaagcagaagattaaattagtaggctcttctaaaaattcagatgagacaataggatctaaaagataaaattgggaatagagagaagggaacagctgaagagatatttcagaggtagaatttcatagacacgaagattactaagcgatcacgggtaagagaatggtgttaaagattactttttctgatcatgaaattttaaaatattggtttataaagcctcatattcacttagcatgtactgataatccccagttttagacacacgcacataatatccctggccacattttcttttgcaaaattctttaattcagaagtgctccttccccagcagaaagcatctgaagagaaagtcaaacattcaagtcaagtgggaaactttcaagattaattgcctatactcactagccaccaaaaattttctgtattggttctaatagttatattgcagaacattttaaaagacagcacagtattcttgcttgtctagtaaagtaggaaggtaagtttttgctcaatggggtgattggctcagcagcaacaagaactgcacaatttcatctctaattctaatctaaacagagctgagaaataattcccttgtgtgtttataagtaagagttaaatccctcccattgtaatgtagcaccagatcgaagtaaacagactatgatttcagtgctagacacagccttaaggcagaagaaattacactgtcatgcaaaggatatgtagctgctgctattttggtgcttgaattcttcgttgtcacatagttgaaggcaatccagatgaggaagagtgttaaccaacaaaaagagaaaattccctgcacatggctaggaggatggaggggaagaggaaggctagtacagtaccatctgaacacaccaataaatgatctgctccaacaaatggtggcttaaacttgtctgcccgttcttattgaaaacaagttgtttagaacaaaatgcaagctgaagattaaaatctatatttcaggctgggagtcgtggctcatgcctgtaatcccagcactttgggaggcttaggtgggaagatcacttgagttcaggagcttgagaccagcctgggcaacatggcgaaaccccatctctacaaaaaaaaaatcagaacaattagtgaggcgtggtggtggtaggaggattgcctgagtctgggaggcagaggttgtagtgagccgagattgtgtcactgcactccagcctgggtgacagggtgagaccctatctcaaacaacaacaacaacaacaaaacctctgtgtcaccaaatggtttgcctatcattgattaatttaattggattggcttccagttgcttataaaataagtttaggaaaaattggata

SEQ ID NO: 115134 - DNA, 1826 bp, Homo sapiens
ttgagaccagcctagccaacatggtgaaacctcgtctctactaaaaatacaaaaattagctggacttgttgacatatgcctgtaatcccagctacttgggaggctgaggcaggagaatcgcttgaacccgggagatggaggttgcagtgagccaagatcacgccacagcactccagcctgggcgacagagcaagaatctatctcaaaaaaaaaaaaaaaaaaaaaaaaaaggaatgatgatgcaactaatacatgttacaacatggatgaaccttggaaacattatgctaagtgaagaaagtcatttacaaaaggccacatgtcatactatgccgtttactgtagatgaaatgtgcagaaaaggaaaatccatagacacaaaaagtaaattggtggttgcctagggccagggagagtgtagggattggcaagaaatgggatttgactgccaatgagtatgatgtttctttgtagtgtgataaaaatattctaaaattgattacggtgatggtcgcaaaactctgtatgtactaaaagccactgaactgtgttctttaagtgcataaattgtgtggtatgtgaattgtatcacaacatgcctttttaaaaaaataaaagctaagtgggtgtccaagagtgtggaatgtttaggtcgcatggagaagtttggtgtgactggaaatagattcggtgaagtgagatagatgaggtaggttgtggccatttgacaaagggccttctgcttcagattaacacctttaccttttctcatctagtattcttttatttttttgagacggagtctctctctgtaacccaggctggagtgcagtggcgcgatcttggctcactgcaagctccgccttctgggttcacgccatcctcctgcctcagcttcccaagtagctgggactacaggcgcacgctgccacgcccggctaattttttgtgtttttagtagagacggggtttcaccgtgttagccaggatggtcttgatctcctgaccttgtggtccgcccgcctcggcctcccaaagtgctgggattacaggcatgagccacagcgcccagctctagtattgtttctctaaagctcatccacattgttgaatgtagtttatatttttcacttttgtgtaatatttcattgtgcaagctataccactgtttatttatttgggacatttgctttgtttccagatttttctttcagaaagagtgccacaataaattttcttatacataatccactggtgcaagtctcagaagatagtacagtgccatttttataaagctcaaaaataagcaaactctttaaaggtatatatgcatacatgtgtaataagactgtgctaaaacgaggaaagatattaaatacaacattcaggatagtgatttatttaggtgggggcgaggtaccggaagtaaggggagagatggagcacagaggatggctgtaggttacagataatattctagtttctgattgggtggtacattcatagctagttatttattattaaataaactctattttagaatgactttagatatacagaattattacaaagatagtacatagtgttttgtgtatcccatacccattttcctctgttaagagtagggggacatttattacagttaatgaaccaatactgatacattgcttataactaaagttgatatggtattcagatttccttagtttttatgtatgcttttctctgttccaggatcccatacaggacaccacattacacttagttttcacatctccttaggccccacttagctgtgacagcttcttagactttccttgtctttg

SEQ ID NO: 115135 - DNA, 1374 bp, Homo sapiens
gctcttgggctcaaacgatcctcccatctcagtttcccaaactgctgacattacaggcatgagccacttatgccccatcaatagtatgctttaaatggtgctatacaatttctgtgggttattgcaatttgagtatgctactacttcatttataatgtttagtgaatggacaaacacttcctaaggaaaagaacatgatggtactttttaaacagtggcacagttgtgtgttaaaacctgccccatcacctttaaatatgttaccagtcttatggttttcatttttggaggaaaatcatgttgatggactatttttagaggcttcagaaagaacatttattttcttcagctctgctccaggaatatcagacagaaaatactagaaagtttaaaataagccagtttggagagagggcaagatgaacaatgattaattttataaacatcttttattcctaaatatcctacattattgtacccactgatatttataagatgctgttcctattgcaggctgactataaatcacttttcccaaaatttaatcttccttttaaggtgatttctatcctcttttttttttattagactatacatttttctttctaaaacttttctttcttccaatttatttgttattgcattattctatgttcgtatgtgtatgttcatgtatgtgcacatgtgtatatgtttgtgttcatgacacaaacctactacatgagtagtttctcatttaattcacaaagctgatctgtgagctaggtatttgtgctcccccgtatactcaggagggaattgatgtttggaaaacaacgatttgcccaaagataagcagttagtaaaagacagagctaggattcaaaaatcagctatgtcgtgcctcatagtatgtgattattccatcacaccatgctccctcctttagtggcctctggcatccccccaaccccacgaggtgtcagtttctttatttgtaaaatgaagaatttgaatcagacttttttttttttttttttagacagttttactctgttacccaggctggagtgcagtggcgcaatgttggctcactgcagcctctgcctcttgggttcaagcaattctcctgcctcagcctcccgagtagctgggactacaggggcacgccagcatgcccagctgattttttatttttagtaaagacaaggtttcaccgtgttggccaggctgtttcgaactcctgacctcaggtgatccgctcacctcagcctcccaaagtgctgggattacaggtgcgagccactgcacctggcctgaatcagactgcttaaaggtccccgccccttccccgacccttctgttagtggcttttattattggtcataataatgg

SEQ ID NO: 115136 - DNA, 1036 bp, Homo sapiens
cggggattacaggaatgcaccaccatgcccatctaatttttgtatagtagacacagggtttcaccatgttggccaggctggtcttgaactcctgacctcatgatccacccacctcagcctcccaaagtgctgggattacaggtgtgagacaccgcacccggggtttttttttttttttttttttttagtcatcagatctcatgagactcattcactatcatgagaacagcacagaaaagaccagtccccataattcagtcaccttccactggaattcaggatgagatttgggtggggacacagccaaaccgtatcagtatagaacatgatagagggtatcagttattaagaaaatttatattcattatcaccaagggtccagtgttcctttcatgaatctaaatatcagcttggaaaggaacttttcaactatttctaatatttggttataagtagaatatgaaatacaagcattaatgttccataaaactgttttttatacacattatggaattccatctgcctcaatagtgctgaaggagccaaataactaaaatggaccctttaaaaagttaactacacaataagaataatttattctcaaaagtaggttgtacattactatcaagcaaagtgtcctttaatcatcctgctttctcatcctggttccaactgtcacttggtagaggtaaccattgaaactttagtgtatatctttccagacctttctgtattctttctcacattttctcaaatactgttttctgtctctgtggtttttgcataaatgctataataccagtgcatcctggtcttctaaccaagtgatgaacaggctcatgccattatttaaatacaactggttaagctgtcacttgaacatcgaagtccgtgcactatgttgaattaaaaatcggaaaaacaccagaggacccacaagatgagttctggttgatcactttgtattctcaaggtcgtctcacttcacagtgaagatgctgtcggaacggaggccctaatcagacaagagtgttct

SEQ ID NO: 115137 - DNA, 1469 bp, Homo sapiens
ggcaaaccctttgggtgaaaaaaataatgagttattctaactcatttagacagtttcaagtgaaacataataacaagaaatgagttcacagtgttgaattaggagtttgtcatacatatccatgctcctcaacaccaaagtcaaagtagtagaagcaattaaattcaggtgctgtgccatcagtgtaccattgtgctgtgtgagaaagctgtacctcatttaaatctttgggtttactgctcatcttactatatcaggtaagcatgctgctttgtgtctgcccacaagctggactcagggattacagaatgagtgtggctctggtggacacagggaagcatggagataaagaagttcattggtttctctaaatctgtttttcccagaacagtttggcagcacagtgaaaaccaactgcagaatcctcatttcctaggaaacgtctatcaagccacagatccctcaacttgtcaccagcccatagtctgtcaaggcataagccagttgtactcggaagacacgctgcatccttgtgatgccttgccttgtatgggatttattatcaactgttacccattgtttaggggtttttcccccctctctcttcctgacatcctatgcctcatgtatgaagaatttctttttgaagttatgtagaatgattctactgtgaaagcattattgtgagagctaaggaaattagattgcacaatggggaatttaaatataaaagaagaaaacaagaaactccagaggaactacttcttgaaactatgattctacaagtcctggatctctctatctttagcatctgctaaaattcacatcctccactagccattttatttccttgctgtttctttttgtgggcttcctgatgaggaatgccattccccattttttcattcctgggctcagctcatgttttctgttaacctctcctgttaacttttagctttcttgccagattttcttatggtatatgtattagtccattttcatactgctgataaagacatccctgagactgggcaatttataaaagaaagaagattaattagacttacagttccacatggctggggaggccttacaatcatggcagaaggcaaggaggagtaaatcacatcttatgtggatggcagcaggcaaaaagagagtttgtgcaaggaagcttctgttgttttttttttttttttccttaaccaccaaatctcgtgagtctcattcactatcacaagaacagcgcaggaaagactggccttcataattcaatcgcctcccaccgggtctctcccacaacacatgggaattcaacatgagatttgggtggggacacagccaaaccatatcgttctgccgctggcccctcccaaatttcatgtcctcacatttcaaaacaagtcatgccttcccaacagtcctccaaagtcttaactcatttcagcattaactcaaaagtccactgt

SEQ ID NO: 115138 - DNA, 1079 bp, Homo sapiens
agaaggaatttgctactatattaagggaccctcttgtattacccagcacctacccccatatataaaataaccttctatgttggcgattatgctttagtttctgttacttttttagtaataatttttttatattttttaatttagtttcttgtatagtaagacaatttaacattatcgaatgtggaaagtagaggaggaaatttgtaacaccattaccctattataagatttcttaatctcagcaggttgggaagtagttttatgcgttgtaggatgtttagaagcatccctggcctcagtccactagatgccagtagtacctcctgagttgtgaccatcaaaagtatctcccaatgttaccaaatgtcccctgaggatcaaagtccccaccccacctgctcatttttgagttgcctttattcaaagatattatcaattttgaatgtccctgtcagtcttctttcatgatatatagatccttttacagagctgtagtaagtgtatggatagtgttgtattctgattgttcatgctatataacatctaagcattttctgctgttaactaggtatcagatttagcacttttatattaattctctattgaattttttatgaaaacatggcaaatggcctccttatgagtatactttttctagtttacatttttgcttttcatatatgcactatgtcgctcgtgaattcttttcctaccttttctgttggcaaatgggggcttaggcctttctagttccatgtggtctctagtataggagaaagcaccaggctttgcactcagacagatgtggattcattcctcccctgacactagtagctttgtgatttggggcaatatatactctgagaacatcttatcttataaaaggagagaaaatacagaggtattgtgatgctagaaataatgtatttaaaacatctagcagagtaagaactcaataactgttagtttgaagtagtggtaataatagtgcggtttatattccttattgatccaaatgtaatgcagaccacaaatgtgagccatgtatgtaatctaaattttctaatagctgtgttaaa

SEQ ID NO: 115139 - DNA, 2226 bp, Homo sapiens
ctcagaaaaaataaaaaataaaaaaaagtcttccctatcttttaatgctgttatatttgggattaagttttggttttttcgtggttttttttttttttttttttttttttgagacgttttgctgttgtcacccaggctggcgtgatctggactcactgcaacctccacctcccaggttcaagtgattctcctgcctaagcctcccgagtagctgggactacagacactcgccatcactcccagctaatttttgtatttttagtagagacggggtttcgccatgttggccaggctggtctccaactcctgacctgaggtgatccaccctccttggcctgccaaagtgctaggattataggcgtgagccactgagcccagccaggattaagttttaacatgagttttggaggggacaaagattcaaaccatagtacatacaattatgttttagaagaattattactattatcatcattattaccctcatcatccatatttgtttggcttcacttcattaattttgaattaatgaaaatgttccagatttctggatttatccaaatatttaaaaaaatatattttcactttcagtaattttagaatgtcgcattgaagaagtcccatgattctttaaaaatttatatgttaatataacattttgaaaatgacaatacaattaacagcaaacatttgttaagcatgtgtatcgtattaggtactattctgctttgcatagctctcaactggcattattaagttacctaaagtcaggtagctaggaaatggcagagctgagctaagaagtcaagcagtgaagtgagctccagaactcattttcctaattacgctgccatttggtcttcaacaaataaaaccaatattaacatattgtacttactaagagcctgttcagggtatcattacattgagatggcatgaccctgataagcatttcaattttttgtacttggaaaattccaattaggataaatttactgcagaatctcttgtctgctttgttttggctaattctccagtctgacaatttgctgcctattaataggatttatctcacctcttttatctgttggtcactctacaggactgggatctctttcactagggttatgtcatacagtctttcattcttccaacaaattataagttagagataaagaaacagaaaagagattcagttcttccccctcaaaaagttcacctagattggtccaaatggttgtggtcgattttccataaatgttggatacgttgactttctagagactatttctgaggtctctgcagttgtccatatcagtttcttgaattgtgctttctgttccttggtgctggtgcaatagaacccactgattgggtcttacttagcttctaaaacttctttgttctgctttgttttgtcttaattcacagtcttctcattccacactctgccttcactctcattttctctatagtctgttaaaatgggaagaagatagtttggagtgagccatcctcagttcaaatcatggctctacgacttttaaattatgagactgtaggcaagttcttggaaccattattttcttatcctccagctctttattgaagattaaatcagagaacaaagtgtcaagacatggtctctgtctttgaagtgctgacactttagtgggagagatagacctacaaacaaataattaaaacagcagtgataagtatcataaaggtggtgtgtgtgacatgctataaaaacttacaggtgagtagtaagtttttggtgagtgaatgaatgtgtgagtgaaacttaggagaaagggaactgaaatatgacttcttgtcaagagatttggcacaactctggatagcacatggtatgattttataaatgttcattcattcacctaacatttattgagtgctcactacgtgccaggcaatgtgctgtttactggagattaccaagacgatggttcatgctgagaggaaaaaactaaattgttcattgctctggctatattcagtaaaagagcacttgcgttttctctggtcaaatgatgtagcacaagcatttcatagactgtgattaggccttccttatagcatcaataaacctatttaaataggttcttcctgtacatatttttattctgaaatcccctttttgatgtaactgaataaatgaagaaaaagatgagtatatacacagctttcagatttcctttc

SEQ ID NO: 115140 - DNA, 1572 bp, Homo sapiens
ttttaaaactccacatgaactatatgactgggtgcagtggcccacacctgtaatcccagcactttgggaagccaaggtgggcagattacctgaggccaggagttcgagaccagcctggccaacatgccaaaaccccatctctactaaaaatacaaaaattagccaggtgtggtggtgcacacctgtggtcccagctactcagaaggctgaggcatgagaatcacttgaacccaggaggcggaggaggtggaggttgcagtgagccaagatcgtggcactgactccagcctggggaacaaagtgagaccttatctcaaaaaaaaaaaggaatatatattattaacccaaagactgttttgttctagcttctgtttttgcttttcgcctttggctgccttgtgaataaaatcttaaatgaccgtgatagaaaaattatgtaaagtagtattcactaaaactttacttctgtaattcaatatgaagaagcttcacgtctacctggggaaagtatatcagttttctcaagcctaccttgtttgtctagtgacaataacagattcctagggttggaagaaccccctatatttattgtcctgaacttggcaaagatcatgaacattcatttaaccatctaaattataaattatcttataatagcttctttgggccaggagactttaacttatttaaagtaatacagtataatgataggccaggactttttttttttttttttttcctgtattctgtactaagaatcattctgtcagatctgctttgggtttttctgtgagtgtttctcttaatttatatttctagagtttttgtgtcttgtggggatataaaattcctcaggagtgtaaggagtaaaagactaaagaacattaatagtgtgtgaagattgctaccactgagacctggggaagtgaaatatgggcaaatggactcatttaatttaaaattctttttactcttttaccttcttatatgtgtcttttatttgagcatttttaatgtgatataacttaaaaattaagcttcagagtcaaatagaaaatatcaaaattaagaaggaaatagatgtatttttcactctgcctctaatactattaaagtaaaatctctctgacttgaataatagaaactgacagttctgaaaacatgtgccttttcttaataacacaggcaattgtcttttatttatttcatcagggaaagacacttaagctcacatagatttcaatagctttatgcatcaaactttacaaaagcagaaaagcagataaaaattaaaagttaaatatcttttcctcttaggatcttatcttctttattcttcttccttcttctcagttgtttattagcttactcttggatttacaacattttattgacaatctgtggtttgtggactttattagtcccagtctgtcactttaagaaggagaaaaggaacagaaatgattatagccactatttttggatgtattgtaggttttaggcatttagttctcacagccacactgtgaagtaggtgcttcataatcatcctccttctttagatgaggctca

SEQ ID NO: 115141 - DNA, 1050 bp, Homo sapiens
tcccgggttcaagtgattctctggccccagcctcctgagtggctggtattacaggcatgtgccaccaggcctggctattttttgtatttttagtagagatggggtttcaccatgttggccaggctggtctggaactcctgaccgctggtgatttgcacacctcagcttcccaaagtgctgggattacaggcgtgagccaccatgcctggccttaatatgcatctttaaatttgtttttattttgaatttttggtgttctaatacagtttacatcactgcctgtactcactgcccaattttctacaggtatctatctatcttgttcatttgaaaatagcatttagaaagggaaatgatagaattttttttctcatcaatatatcttaattttcctatacttgaaaataagagggattattcaaaatcagtttcagaaaatgttgacattgtgtaggtttgcaagtgaaaagaaggcaatggaattttgcattagcacttaatattgggccctatttgcttgttacttgtttctgttaagatccatggttatatccaattttctttcaattctttactctgtggttattgggttgggtgattttgattctgttcaacaactggatgctttgagtaatgaacttcagtgcataattatccagcgaaatcatagcaaagggatgagatgacaaaaagccaacttattttcaggaactaaaaataatggtataatataggaattaatacatgtatgactattccagcatctgactttattctgatcatttatttttatataaattgtaatttaaaattgtaaaattttaaatacttgctattaatctgtaaatatcgtttactttttaaaaataacagtaaattaaatctgatgttttagtgaaatgcacaaaccactgaattcttttgaattaaataaggtattgatagtaattcatttaaataattatttcccccttttatcactttagttaagcgatactttactactaaaacaagcatgttatttataatagcacttaattgtaataaaat

SEQ ID NO: 115142 - DNA, 2454 bp, Homo sapiens
agactagatgagcccaagaatagtcttaccccacccagccactctatcaggaaccatctgtggactgagaatccgctcctattctgaagcatacggtgtcctgaaaggccttctagaccccttctgggtttggttacacaggctgagagtgccaagcccactggctaaggctaattgtacaagagcactccaacggcctgcagtgcccctgcccttcacccctagcctggctaatgtccagtggtcctcctggaagacttcctggtttcctctgagatgagactcctcccaaagactgggcgactcagccccttggttcccatggcaccctggctatggaataaacgctggcagtgtggggattactacccccatatagatcattcagtcatcttcttttctgtatgattaattctccagccccctccctactccatttaattttagcatatgtatgataaatcttcattgaataatgaacaactcatcagtgataaaccttttctgaggtattgttgtcctttgaaacaaaaactcccagattaaatggtactcaaaacttattagatattttgcagaactcacagttctacattattatagtcatgtattatagttatcgatttactttaggaagtttgagttgtaagtttgacagctcagagaaccaacatttacatctattattaataaagacaggtgctgcactgataatatagttaatgtattcctaaaagaacctaaatgaggagaaaatgacattttctctttgattttagttaattggtgatattttctcatgaaaaaacttttgacccaaagcaacagtatatatcacatttaagtatattcagattcatttcattgtcaatgtccagccaaagcacatttaattcttgcgcaaccatccctgcaataagttaatcaaatgagcactcaatccctattgcatagaatatttaagagaaacacttaaaaattaaagtgtaccattgcatcaatttcagttgcattagaagttctccttagttccattagcctcaattgtttaaatagccacagtggtactatgtatttgctacacactcaacagaatatatgagcttttctctttcctttattcttcttttttaattggaaggcactgctcatgaaatacaattctttgatttgttctctagacagtagaaagacgtcatggttatttcttccttggtaaattaagccccattgtcaaacataactagtgagaaaaataaatgcattgtgtgaaatcctaacctttaaacataccacatttgcttacatatttttctttctgtttcccttatttttactctaaaatatgaagattcgtaggcctcatctgtcttttcatttttcccatattttcaacaaaggtagccactcctccagagtcagaaataaaatgataaaattagttcaaatctaggtcttttactatgcccaattcttcagcagcctctatttccttaatataccatttaatggaaaaatttgacaaatttgcatataatcaaaaggtgattttgcatctaattttcccccctctaaatatgaggcttgagaaggaaaaagtaaggccttagctgaagcttcatcttccttctgagcattaaaggtgcaagagcaatatacactcagaaacaaagaggagaaaaacacagaaaaaaaggagagccaaggggctggtgtgagggcttcttcctattttatcttggtaggagttgattagattatgtgtctttagtgtatctctggaagatagaacatattcaacttgcagtcacaagagatactttttcatgatgataatttaaaatgttaccaggattttttccttccaaatgtgagtatctgtctatacacacacgtatgtatatgtagtttttgaaagggtaaaacttctaaaaccacagcgaatattatggtggttaaaaaaaagtcaacctataaggagaaaaatcataaaaagttaaaattccctttgaaaatattttagaactttcatgctgtagttttctttccaacagtggagcattctcctatttctcctgttatgcacaagatgtagtatttgatttgcattcaagggtcaggatgaaaaagaatactcgtttttaaatactagaatcacacactgtagtggaagtgttctcatcatgagaagccccagagaactgagacccattagggggatttgtatttgtctccctccctcctttccttctttccttccttcctttcttttttttttgttacccaggctggaatgcagtggctcagtcttggctcactacaacctccgcctcctgggttcaagcagttctcgtgccttagcctcccgagtagctgggattacaggtgcccgccatcactcccggctaattttgtatttttagtagagacggggtttcgctatgttggccagac

SEQ ID NO: 115143 - DNA, 1254 bp, Homo sapiens
attctgtatctaagagtacaagttagaaagtgttagcctaataaattttgcaataatttatatattgatagctgaagggaatttaaaaatattttatgtacaattgccagatgttttaaaccaatactaataaaaatatttgtggggaaatacccatgtttcctccctaattcatcaccaactggcaattttagtctgtacgttcagtgacatgaagccactgattatatatttgggagtcacagctatgtcacactgcaacaaaaatttctaaaaaaacttattctcaatttctgcatttattacattttgtcctcggataatattttgatttgctatttcaaattgctttgctgtaaactatagcaaaggagaaggaaatgaggtcattgggagtaaaataaaggactaataaataaaataaatagacttataagacctgttaaatactgtcaagtaaagccaaagattgttctgtagtatcttttgattcacagtagtttgctaagcattctgaagctcacagggttaaacaattcatttattcttattgtcattgtttccctgttctgtacagaaaagacatggtagcagtgtcatttcagttcacctaaagggaatgactgcagccttacgcaaaatgtagtatccaagatatatttgttctataatttcagtgaagtggattctcaaatttcacggttgtttttattaaaatctgtgtatacatatactcagacattagccaaagccataatatctgaaccataaaacagcctcactaaggattcataaatatggcctctcccgcccaatcattttcatatcatgtttgtccctttagtaggttccaagatgatgtttttcaactcccattacaccctaagaatttgcttggatgagtgaaatcagttgcagtttttttcgccagaacatggtgccacacccttggcaggtaggcaatgttgtcttcatatgtttgcagaattactgaacattagcactttgtcctccagagaatacccaaccctacccctcagctttcagtgcactaatgccacagacaaatctggctctggaggggagatggcaatgtgaaggctccccacaactttgtgcatctgggggtcgtacaaaaacaatggcagtcttacagcttctcccagggagatgtcgaggggcagcgttgaggagaaagggtagacagagtgattgttctttctgttgtgctttttcccttaaaaatgaataaat

SEQ ID NO: 115144 - DNA, 6279 bp, Homo sapiens
ggaaaggtagcaatcaaatagagcattgctgaatgtgtgccaaagtgagtgcagggagaatgagcaggctctgtcacatccttaccctggggccaaatgctgcccaagttttctcggttcatgtcaggccaggtttggggtgctttctttggtctttcagtgaccccagcaggatccagagaacaccctggcctaggcatttggctcaatgccaggacacctttcatgtttgagttgagctatggagaattcaccttagaacagagcaaactccctaggcaagacttctgtgagcactctacattcaacaatagacaccattctcagtgattaccaagaattcaattacacatccttctcaacagtgaagcactgcatctttaacatcaaagcatggctttgtgtttgttcatcactcatcctttatgaatacttcctttatatgtctgcatgtaaatgtgcctataatatatatgtgtatgggatgtaactatggaccaataaggctctttaaaagacaccccagaaatgtatgaatgccaccttcttctaagcacagagacttttaaaatttatgatatattgttttacaggaaaaaataaggtaagttaaaatgatataatttgggtcttcttttcctatttaaaatacatctaagtttgaaaattagtatcagtgtaggatttggcagaataaagatccgcctaaagatcctctggattggagttatctctgagatctggtcagagatatcttagaaacccagcccagtaagggagagagcagcctctcgaggcttggtgccctggtgatttcaggactagaggataggagaagacaaggagcaaatggatctaaacgctttaaggaataatgcaaagattaaaaggttaatagcccctatatccaggatcaccttgagtggttctctggttatttcagtggtctcctttgttccactgaaatggtcttctgggttctaccatatgagccatacaagaaaatctctattttttattttttgtttgcttttttaaaattaaaaaattgtacattccatgcttggtcattcatttcattaggaatttgtctaagaactataggtatgtgcttgtttcacccatccatttattcttatattcaatatggattgatggagcatctaattccataagcctggtaaataaaatgtactctttagaataaaacatctttcatcacctgagggtattgacaagaatatgccaaggattctaaagccagatgccagaagaattccaaaaagattgtggacatcacttggaataaatacatagcacagagcttcaccaggagactatatttgtacgtgtattttcaacctaaacattccggaacgaacgtgtatagattccatatcctggtgatggtggtggtggtggtggtgtgtgtgtgtgtgtgtgtgtgtgttttcaatttgagcagtctattaaccacatgtaagtagctagaggcaggagagggagaggaatgtgcggaaatgcatttgacttgggatgtctcattttccagaatccctgccaagggctggcaagcccagaaaggcagaggctggcaccattccctgccactctccgccctctatggtataccccatcagacgcctgttgtaggcgtgacctagattccctagctgatgcctgggaccagcagggcccattgcattttttttttttctgtgtttcctcatctcttcatctcaagtcttgctcagccattaagttaaagaaatgctccaaaggtctgtgccaaaatgtgtctgcccttgttcttagtggcacaagcccgactgtcagttgacaggtgggcacaccacctggggaacagttagcttcccataccagatggagttttactggtccaggagaaggcccacaactgggttgctggaacagatgctctgcagacagtctctggatctgttttcttcctcctccccatgccccacctttgcttactgcatatgagcagtgccctgtaggactgctacagactacagctctgtagcattataggagacttctaagctaaaatttctttaccgaccttatgtttgagtaacattctccagcccttcaaaacctgagaaataaagtctctgaaaacagagatatgtataactatggaatttgaatagtgaccttaaaaaacataggttatgaaaacatttatattagcatttgccaaaaggttgtttggctggtcttgggagtgttgacactttaattgcgtttctcgcctctcaatagcacaatttagattaaatctaattatggtagatggtagtacataaaagtagtaccttttagatttccaaagtgtggaagaaaaagattttccccatggtctgatatatattcttgttttattgcaaataattgaagaaaagtgaaagtagattcctctggttttcaacctagtacttaaaaattttagaggaaatttaatctggagaaactcttgttttttacataagaaaataccagtgttttcagtcattcctttcagccataaaacatctgtattgtgacaaatgactcatcaattttagtgaaaggagtctaatctcagccctaagcgtgatgtcttgttatagccccttgtggttgtgttgtgcatatttcttgctaagtagtgtttgtagaagtatgtgtactttcatttaaaagagagtcccatggcaagcttcttttccttagcattccaaggattttataattatccttttttatctttccttttcctatcctcctctctccctcctcctttccttctttccctttctttcctttcttccttcttccttttctgtgatatataaaaaatgtataatgtatggaacatgtgtatgtagtttaaagagtagtattagagcaaatggcaatgtctccactacccacattaagaaatagaaatagaaaactccctgtgctgtattattctctgagcccctcattttcatgcatcctctacctcccacctagaagtaaccactgccttgaattttgtgttgcctgtttctttttttttgcttttcaatacttctgccacccatatatacatctccaaataatatatgtaatagccatcttatatttttaactttatataaattgggaatcatgctaaatgcattcttctgtggtcttctatttttgttcattattattttgagattcatccatactcatctctgaggctatggtttattcgtctttattgctgtgtaatattccatcatattgagtgtatcacaattgatttattcattctactgttgatggacatttgggttggtttcattatttggacattacaaacactgatgctgtgaatgttaatgaatgtaacatttgtatatgtacaaccatttctcaatggtatgtacctaagaatagaaagagttatagggtatatgcatatccaaccttattaggtactaccaagaagtttcccagagtagataagaatttccatttgtttatatccttatcagtatatggtattatctgggttttaaaattttgcaaatctttgtgcataaagtgacattttctaattgttgctataaaatacaagaaatatacattcgtatgttggtttttgtagccagaaaacctagacttttaatccttttgattcatttgaatataatattaatacatgcctgcacatattaaattcattagcagatgaaaatttctttcatccttttcatgtcttattttgattactttttcttgtctacctacattgactggtatctcctggacaattttgaataggattggtgacagaaagtgttcctgacttcctctggcttacaaaaggagtgctttcaacatttttcctttaagtgtgatgttttctgtgggatatttacttatttaaatagataaatgcctttaatctcgtagtaggtaaaaaacttttttataaaagatatccttttctattgtgaagtgaattttattatgaatggatgaggaagtttatcaaatgcttttccataattatggggaggattatgtgatttttttcctattaatagtaactattaatgttgtaaattacctaaatttattatctaatattaaatcacccttgtatagtattagatgtgatggctacagaagaaatgtctgaaactctttacccttaattaacgtacagtctaattggagagacaaaacatgattaaagaaaagttaatagatgccacaagggtagattgtaattattttctgcattaatggggctttgagttcagttggcaaaaaccgttatggactgcagtgggctgagccagcttcctgaggcggggggtgctggagctgagactagaatacctgtttatctttttacagcactttgaatagcattactttgcattaccaagttacttctttttgagattctaacactgatttcaagtaatcattcatatgcgacaacactccatatgactgttgttcttcagtgagatttgttgcactttgtctgacaaaaccacctttaggatctactttgttcccagccaatattttgctgcagctcaatttgtaggtcattggtcccatcctgaatttgctgctacaaaattcacttccaaaatacttggacttttttattttaataaactacttgattgccaaggctaattagaaaagagagctacttaagtagaatttaatttaataaacattcatagaacacttacagtatgaaaaggactctgctaggcctccatgtaaacaacaaattatagctgccctcaggaagctttctgtctgctaggagtttatgcttcactagggctgtgctgcctagtgttgtccttggacacaaactgaggaaaatcctcattacttttcacattgagaatgggttttgccttggttgtttcatcaggttaatctacctctgaccaagctgagtaaatcattttcatgctaacagtgggcaaggatgggaaaatgcttgttttcaatggccaaatagatgatttttttttacagttttgttttaaagtactatgtgtacatactatgtgtctttgttctgtttaatttagtcttgcaggttttcttttactcgtttacttcacattttctgccatttcagtcacatacgtatagcccagttttgacaaccccatatgacctcttcagtcagcactgcatacttcacattcctttatcttaatttatacatatctttgtcctgacaattccccaattgtagaattaattgtttttttctcttggtctttttgtgttttgctctattatttgccccttctttatcaccttcccatatgctttctggaaacagtcatgctagttggcagtatatcttgctatcttaacaggaaaatttcaatggatagttcctaggatgcatcatatttttgtaactgtacaatcaatcagctaatatccaaaatacagtaccctggttatgcttattaatatttggagccgactgggcacagtggctcacgcctataatcccagcactttgcgaggccaaggcaggcagatcacttgaggtcaggagttcaagaccagtctggccaacatggtgaagcctcatctctactaaaaatacaaaaattagtcgggcatggtgtcatgtgactgtaatcctagctactcaggaggttgaggcaggagaatcacttgaacttaagagactcaaatatatatatatatttggagccatttagtttcatttttgtttcctgtagatgtagcagtgttactggcttcttccattgtctttgtgaaagcggtgaatgccaatggaaacgagtcacatgtttatattttaacagtcacatgtttatattttaaaagagtggaatatttgtggtaagtgcagttgtggcttaatacctctgctattccttttagctatccaaaccagaggtgctacttcctgaaagtggcagaattcaaagaatctaaccatgacatgcttttgatttttgttattaaggagatctagggctagaaattgctaaagtagcataataacatggcttagtatagaaaccaggagctgcagcccaagatctcggcagtaccatgtataggttatatgactctgagttctctcttttttttttgagatggagcctcgctctgtcgcccaggctggagtgcagtggcttgatctcagttcactgcaagctccgcctcccggattcacaccattctcatgcctgagcctcccga

SEQ ID NO: 115145 - DNA, 1040 bp, Homo sapiens
gtagataatggtaatgaattattattaaggtattatagcatatcttaaaatgctttattttattagggcatttaagagaaaatggtaatagttacttaaaatacatatatgaattatataccccagtgccttttttgttgctgttattttacctttgtgtagtctctatatcattactggttttttttttttgtgctatgttatatcttagttgggaatttccatgttttattcctaatcaaaaatctttaatattgttgttttaaaacagaattcatgtacttctgacaggatttaattagcaaaattattctttttttcctctgtattttaagaaattgaagtactattaggtattgggaaaatatggcaatttttaaggcaatccaaataaaagccatatgagactctacgtggtctggtctaggaagtcacaaatttggtgagtatcaaaatgaactggtatgacatttgctaagcaggtggtaaatgtcaaaaatttgtctactagcccaggatggcctatatgcctcaagtcttgagaaccactgtgtctctagggtaatcatctgaaatgcctttcatctgtttcccgagttgtttctcagactaaaccctgtatagaaaccttcactctgagaccacactgaaaacacatctgcacttaagaatgtggattttaaacactgtgtgtgttgcatgcacataaattatatttaagagaatctgtttttatagcagatccttgatattcatcaggatgcattctaaacttcccaccaatagcaaaatcacttgaatattgtatgataatggtatttaagtaagaaaagagtaaaagtcatttttgcacatttttcagaaatcactttcatatttaaaaagtttaataacccagatcagtcttttttcttttttttttttttaactttaaatgtttatattatacttaaattattaaattacctccagcattcaatctttgcaagaaatccaagtcagtcatttaatgggtagactatgtgcaggaagcatagtgt

SEQ ID NO: 115146 - DNA, 1093 bp, Homo sapiens
gcacggtggctcacacctgtaatcccagcacatgggaggccaaggtggatgaatcacttgaggtcaggagtttgagaccaacctggccaacatggtgaaaccccatctctactaaaaatacaaaaattagctgggtgtggtggcgggtgcctgtaattccagctactcaggaggctgaggcaggaaaatcacttgaacccaggagttggttgcagtgagccaagatggcaccactgcactccagcctgggtgacgggacaagacttggtttctaaaaaataaaaaatgaaatgaaatgaaatgtcattgctcatttaacaaaacaacttgtgttcattctcttcaaacaatattttttgcacacttattgtgtgccaccattgtgtaaggaggtacaaaaatgaataacagaatgacaggtacaaagattaataacctacatataacagataatcacaatatattatggtaaaagccactggaaatatgtaaagagtactaaggagtgcagaggaggaactgaaattaatatgaactaacatgaacagtggtaagtatgtttcacatacattgtatcaggcacttctcctgattgttctgggaaatgtggtattatctccttatccattttataaatgaaagacttaaggtccacaaaaatgaagtaataaattatgcaagatccaacttctaatactgacctaaacctgactctttggactttgtgtgatatgctctttcattctaccacaacaatctcctgtcattaaatttttttaaaaataacaaaaacattttattatttgatttttaaaatgtaatctaattttttttttttaactttgaagtcttgattcaagtttttttctctttggatgttttttttatgttttttgctacttggacaggccccagttgccattttgcagatgggccctttttacaaatgagctcaattgaaatgagagtaatatattgaagaaactaagccaagtgtgtttttatatatttgtgagacagagtggctattgtattctagtacttggggggagaaagcctgctgatttgggcttaacttactgtcctgtctatc

SEQ ID NO: 115147 - DNA, 2091 bp, Homo sapiens
aatttcaaacatataggtaagtatagaaaatatcagacaaacccatccaacccattacccgtgataaaatgttaacattttatcatgtttgtttcagatcttttctttaatgaaacaaatcatgaaagctgcatttaaagccccttcctttcccttcctcatcattttcccatcctttctccttcagaagcaagaaatatcttaaagttggtgtgtatctttcccagtgtacatttctatgctttgactacatatacatgtgtctctaaataatatatgataatggtttgtgtgataaaaatttatatgtgatgccttacagctttttaaaaaatgttctggtgttttctttatatttaagttctttctagattttttgtgattataaacagagctgttgataaatatctttgtacatgtctccttgtatatgcaagcatttctcaagtgaatacatgtaaaattgcagttacgggggggtcacaggatatacccaggtttaacttgatgaatatttaacttggcactttggtttggagatgacaaacagtaagactgggaagtcagaacttttggatttaaatccttctcactgttgaccatctaaattatattgggcaaaaacttaaaagtctgttttctcatctgtaaaatggggctaattctagaacctaccttgtagtgaatggtgaggattaaaggagggcatagcacatagagagtcttactcattattaacagttgctccctgctttcttccccctcctcctgacagggttgttttgagggttgaatgagttaatgttccataaggcaattatatcagtgtctggtatagagtaagtgtcatgggagtgctttttaaatacacaaaagtcaaacaaaaaatatttaatttagtcacaaaggaatatatttatattcctttgagggtacttaaagaataaattccaaatgtaaaaaagaaaatactgcaaagctataaagcccttacacaacccttacaacttttgctaggttaaattataagcagttaacttattttactttcattcatatatgtggtattgcgggcagaaatttttttttaatcattagccgataaaatgtacttttctctctagttatgaggaaaccaggaaaaccaaatcttttggtgattttcacttgtgaaatttgataccaagtcttgttctttaagatgttccagatatatcattctgccctcatttttaatatgtcaagtttgcggtactgttatattagtagtgttattttttcaaaaagtacaaatgcaaatatagaatgttgtactttgaatagcatagaagaaatgagggagatgattaaacaaggtataggcctacctgcatatctttgcagcctcaccaaaatccagaaatctgcctttttatagtatgtcacttgtgtgtgctcctaacgtgattgacagattgttgtttcccctctttgaaggctcaagaggttactcggattattttaaagcatattaaagtgtatgtcgcaccaactcttactctcagatttaaatagaatcttctcaagcattaaagatggattactttgtattacttttattgcttttcaagtgtttttggaaacatttaggagtcctccttaaaactggatttcctagaatgggttttctttgggggaaattttaaggattagttgtagactttccaaagtctgaagtttaacaaccaacaggacctgattaaaacaaattacttagttaaaaaatgaaaacagggcagaagaggaggaaaccccatcgtatctctgtattccttataataaatcagacctgtgtgtttttaacaaaaacgagggtgtgcttttttcccccttcattctcagtttcttttgatcattgatctgggtgaccccacgctcagggtttttttcttcatttgacatggacagatttttgaagtatagctctcctttgggaaccccgggcagttccacttgactaacctgtgatctaatgagcagtgatgcagggttacagtggccattttgtgtgctttgacggaggatggctagacagaaagtgggagaaaggcg

SEQ ID NO: 115148 - DNA, 2311 bp, Homo sapiens
atacctgctttcatcttttgcaatgaatagaatactctcctacttagaaacaggctttttctccttgccactttattttttccttacctatgaattgcatgtgcctttgatgaaaacaatgaactggacatgtacaacggtacatgtaatagactgaatgcaacttagaagtggccactcttccagtgtacataggcttggaaatgaactaatccaaacctgagtaatttgtttatagtacctcctttcacttttgtttattggtatctacagtctctcattctttttctttaataatatctctttatatagaattttatattcagccatgactctattatttcaatagtcacattaccacttcgaggattgataccatgaaaaaaggttatctagtagttttgagtgaagatatgaggcacaccttcaataccaataagaaggtatactacaaaggtctaatgaagaaaaatatctcattttgaaggtagcacatagctttcaactgactgggcctgttatggtctttgctgtgtttgttatcacagtatctaatagtgaagtggtaattactttctttagtagaaattccaagatctaaattggtacacatataaatatttgacaacaaaaaaaaaatttacaagttttttactaggttacaaaggagaagagtcaagtagggtttaattttgttttatttaggcttatatcttaatatgttcaagtatctggattcagttgccctaaacacagtatacatagattgagttttagttcatgctacacctgacataagattatgggctataatgtttacatggtaactagctccataaaataactgggattgttttcataaatgagaagttaaaccaatggagccttatgggaagaaggttctacatatgaactgttaagtaatttagaagtcacatagaacaatataattttagcatgtagaatttgtaatatttattttttaatactggttatgactaattatttgtcaagccaaagcagttctttattgaaaggggccagagtggaaaatctgggtaacttgtgtacagtttagacaaggagaacaaagaaataatgcaatgaaaataagagcttgtcaggggaatccttagagaacagctggttgaagaattacagttgttaactgtgctatgaaagaaagatgctctctcatcaggcgttagcatatttcattgaagagaagactgaataatcattagagggatcctgaaaaataggccaaaaaagatcttgagatggaggtacaatgtatatgcacaaaacactattgttactactgttattattattattatgggaaagcaaatcactgtgtccagataaatgtcccgattttccaaaacatggcacaaattgtttagaaagaacactttctttcttgttatacataaagatttacattttactcagttttcatatagtttcatttaaagtggtatttattaggccagacatggtgactcacacctgtaatgccagcagtttaggaggccaaggcgggtggatcacatgaagccaggagtttgagacaagcctggccgacatggtgaaacccattctctactaaaatacaaaaattagccgggcgtggtggtgcacgcctgtaattccagctacttggaaggctgaggcatgagaattacttgaacccaggaggcagaggttgcagtgagccaagatctcatcactgcactccagtctaagtgacagagtgagactctgtctcaaaaaaaaaaacaaaacaaaaaataaaatagtattggtcaaatttattggagagttaagtgtaaatatttgaattatttaaatgtttaatatgtaaattatttaaatagacagccatgaatatggaaatacatgtttctgcatattttggataccaattttgcatattaactttgatgtttttctttaagtataagttgggacatttttctgttttcttaacactggctttttaatgacttatgttaataagcaaattaagtccattttttaagtgaaaaaatgagaatagattttaaggcaaagcatgaggtcatcaggtacttgagtaatgaatggcctgttactgttaatggaaatgtttttgagcactatagctatctttttttctttaccagagaagctccttgttttcttttcatattgttaaatcttttaaactaatacagttttaagctaatacagcacagttttctgctctagggaaatacaggcttctttaattattctgaatgttgtagtagcccttcaattatttaga

SEQ ID NO: 115149 - DNA, 1160 bp, Homo sapiens
ggctgagactaatgagaagggttaatctgttggattttatccagaactaaggatttgagacataatgcacaaatggtttactttttttcttaatggagcaagagatatatttgtttattccttcccctgaaaaaacagaaacaaaacttcctcttgattctgtaatgcagaagcattgtcactcattttgaatagtcttaatattttcttatataatctctacaaatatgtctgaggagcaaatacaggtcttcttaaaaggttctgaaaacatagccattgatttctacttcagtatctctgagttgtgtggagcttgaaattataatttttatatgttaaaaaagaatagggcataatatgggaagaaaatatgaaatcttagttcctattataaaaatgagaaatcatatctttgggaagttataaaaataactataactaattatataaattaaccccaataagaatatcttaaggaggagtctttagattattctttagagagaagacttcagcattaagcaaacttctttgcaaggtactgcaaatattggcatcacaagtcacagagatgaaggaaatattgaaacattttaacaggcgcatgtatgaaagtcaaatgtacccccagcctcataatcagtaaggcattagtgacatgtctgaagaagacattccctaatattattgcaaattaagtaataaaagacctcaagagaatgaaaagagaaaaggtgcctgaagccaatgaattacaattgacaacctaaaggcagttgaagaaccaattgctagagtgattgcaaagctattcataatgtgcagcagacagagcacaccagaaagctggaacaatgccttcagttcagcaatattgcttcaaaagaatggaaagaggggaacgggaagagccactgaccctgagaccaatttccaggcagctgcacaaactatatactgtaattaaaggttttgaccagtaatcacagcaaagccagactacagaagtctgggggaaccagcaatgttcataatgaggcagacatccttaacttaaagcatggaaaaaacaggtaagaaagctggtccatttctggcagtgactttgaaaagttctgctgcgttagcacaaatacgaaaatcacatatttttggcc

SEQ ID NO: 115150 - DNA, 1014 bp, Homo sapiens
atttgtcaatattccctaaataatacagtataacaactatatacgtagcatttacattattaggtattataagtaatctagagatgatttaaagtatatgggaggatgtgcataggttatatgataatactcctccatttgatatcagggatttatgcgtctcagattttggtatccatgggagattctggaacccatcctcaaaagataccaagggataactgtattttgtttgaaagagtgactacctccgaatcttaccatacatcctttcttactgccttcataccatcaactttatccagatttccttactctctctttactcaagccaatgcatctatttttatccttgaatataaaaatttttattttcctgaaacaccaaacctgacctgttaatattgcttacaaaccacatcttcctcgaatcctcaccactctaaccatgttaatacatagttttaaaaagattcaacttgttaattatcgtatttacaaatgtttgattttatgtttctacatttgtgtttgtctatttgtggactttttttaacaccatatcagggtactattctctttccaaaatccctcatagaaattggctggacatcttggccaaatgatattcttttaatacattttaaaataattgcttatatttatcttatagaacttatgttgtttgctagcatcaaaatctatttttttcctgtttagatttatcacatagagactggtacataatgaagctctaagggaacataatgacatggttttaaagtgatgaattcaatttattaaaaacaaatgaggccgaggcaggcaaatcacttgaggtcaggagttcgagaccagcgtgaccaacatagtgaaactccgtctctactaaaagcagaaaaattagctgggcatggtggcgcgcccctgtagtcccagctacttgggaggctgaggcaggagaattgcttgaactcgggaggtggagactgcagtgagccaagatcacacaac

SEQ ID NO: 115151 - DNA, 1561 bp, Homo sapiens
tgcccaattattttcttgccctttcaaaagcaagtgtagtcttgtacattacatattttttctttctgtaatatacctggtaatgacctgggtttaacttaccagaattttaagattttatgtcttgagagctgatagtgaaaacatgtatttttaaacaagcttaaaaaaacaacaacaacagcaaaactctaggaaaaagaacaccctttacatactgtctgaaagccaagcaattcttgcaacagatgtttgttgtattcactttggggaggtgaattccagaatttactcatatcaactatttttctctatagaaagcattcgagaaaaatttattattatgtcaagtggcccacttggtacattagggaaaattctgatctaatttaaatgataaagctataaaatgagagaaatcttaagggtaaataggttggtttctcatttgtattgaattgtaattgtaactaatttgttttacaactcccataggagagcatacttcagttctgaagttatttaatagatcaggagggttttatgagaagttaagttgatatagtagccaataaatgtaatcctattttccttctacacagttgctgattgtgattcttttacctcctggtttttaaaatcttattttcattttactggacattgtgtcttataaaagaacacgttttgttaacatgaaacagtctatattttctagcaatgtcatctgatttgatgtttgtctatatccttaatccaaaagtatttaactttttcagaaatagtatatcaaaagtacagtgttaagtatttgttgaatattttctattaaagcaaatactaattgagaaatatgaagactgtgaaacagagttttgaggcagaattataaggttgaatggctctatttgttccacggctcattaacacaggaaaatacagcttctaaattagggtgtcaacattaaagttaaaatttgtgatcaggccatttctcaatttttatgcaattttaattcagtttgttattatgacatgcatagaactttgtgttatgtttgaaaaacaagatataaatgcgagaaaagtatttgcaagtatttttgtaatgatataaacattactggttttttagaccatgttttattttggttataaatattcagatttttttgaacaatgcattcattactctgtgcatgaagagtttatttaattttcgctttttagtattagacatcttctggaagagggtgctagtgtgtttctatggtatttaactatcacatttaattataactacttatttataggtgattatttctaccttgtgtactttttttcctttctacaaaggatcagacagagttttgaaagactgaaattcttgggcaatctgtgtctctagataataaactatagtttaaattattttatatttatattgcttgataacagatcatttcttttttggtagctttatgaagtactgagtatcttctctgacttcatgtgacaaatcttttattaaaaaatgcaaagcagtgtttaaatcgtgtaa

SEQ ID NO: 115152 - DNA, 1290 bp, Homo sapiens
tcagctattcattctaaaaaatcttgtaatatgtatgtgtacactactacatgtagacagtataatgtgtgtatgtaatatatacataatacatatacacattgataaaacatagatataagtgccattttaacttcagataactttattcaagttatttgcaatatctgaaaaaagattttttctttctgcttttaaagttatgaacctgtgtatctgttttccttagacatcatataattgaaagtaatgtatctttaaacctaacatatgacttatggttaccctccataggaatgaaagatgatcacattgaataaaggaagcttttagcaattaattgcttctgagtattccttgtgtgtgttgactggctgtctttcctaggtaaagagcaaatatctttttccttctttttgtgattcatctttcagtaagactgatagttataaatgtagcgttgtcatagatatggtctgaaaatgattctaaacttgtgtatactggagcatatgtggctttgagtttcctttttatttgtatccattttaaatttacttttctcaaaacttttgcttgtaatggaatttgcataataccaatatggggactgctttaagtaaagcatttttccccataattaaataaacatataccatacaggtgcatgtctacactttagactgctttaatgggatacatgggctaattccattataagtcttgaagtttatggaagcacagtgacatggttatacttactttgggtctggcctaaaaagaaaaggatatatcctagatttttcccatttcttgatgacagagaagtttctctgtgtactgtattaaaatgccttgttgaaatgctctcaggaatgttttaagaattaaatcagtaccttattgttggcataaaaatggagttgtggaattgaatcttaaacattttgtaaacaataactttaaaatcgttgggagcaggcattggtattatagaagaggcagtagaagattgaaaagtgagcaaagtcatgtgttactagaaatgtatttagataacggtcgtctttttattctctctttcctaaaggtgttgcacatcctgtgccctattgctgataagcattcttactcatttgcacctgctaatttgtgtatgttttatggaatttaccaatgctaaaaagatggtattttaatctgcaaaatacttgtgaattttaggcaaaattctgatctgtcagaatcaaggaaggtgcattcaacttaccaaaaagcactaaactttga

SEQ ID NO: 115153 - DNA, 1859 bp, Homo sapiens
tcattaagaatggcttggattttgtgtcttccttcaaggccaaatctacctattggctctactgccttctttgttcccatccactgtgatttctgccttttctaaattcctgttttaatccataccacagagtttagcacttaatttttaaaaggtacattggtttccagtaggaattactgttgggaacatttttcagttgctgaaagctctttttaaaacgaaaatttgttttgtttttgacaggggctgataacatccggaaatactggagccgctactaccaaggatctcaaggggtaatatttgtattagacagtgcctcttcagaggatgatttagaagctgctagaaatgagctgcactcagctcttcagcatccacagttatgcactttaccctttttaatattggccaatcatcaagacaagccagcagctcgctcagtacaagaggtatgtctcattagcatgacaactctttgtcttccttgcttgtacttttgctgccacgttggaacctggaaaaatgcatgtaattaggaatgtgctggttatgctgctttcaacatgaaaccttagttttcataggaagcagaaagcctatatcaatctgttagcacttgtttacatacctaaccctacttggagagcacagagttttctagctatttagcaatggttaaaagatgtttctggttatatttttcatctattttgaggggctaaaggcctggttatttaatgttgttttaacctgtggacttagttcattctcttcttcagcttttctaggaacatatcgtgagtatttccatgcattactcgccttcaggtgtcatgttcttgttcctctgaagtgttcaatgttgactaggattaatggatcctattctgtaatctgctaggctgaaaattgatgtcttgcaaattccatgccatcaaatacattttaacatggaaccaatgtttatcttcctcatttaattttatttcttagcttgtatctctcctataaaagcatgagactaattctaggcaaatagagtctcagccaatagagcttgtgattcatggtactgcagtaatgagatatgtgaatagtttttaaaacttaaattatagtgaattataacgtaagtacagtgaaatcaaaactcctgatgtattcctttatacttgtaactttcaggatatgatttcccctctccttcagaaaattgcatgcttcctcaagtgattttggaatgagatgattaatatgaacaatcttgcctttcagcctgaaaaataaatgaggagccaaggacataacatgttctaactccagacctccctcacacttagtgtgtgacccacggcagatagcctattcttgtgcctggcttctcacctctaaaatgagaataatccaatttattatgataagttaataggattaatttggataatttactttgaagtttaaacacctaagtagaagaaccatataaatagagtttttattcaaattttagaaacacagtttaaaaaaaagaaaggcaaggacccattattcaacagacagagctcatgtctcactttagttgcctcattcagcattaagtacgtagcaccttttaaagaatagagtttgaaaaataccttatagataatattaagtaattaagtaaaaaacagcaataaaaatctattcagaaagtcattaatgtgaagatcttcagcattataatgatggtgtctcctaatgtgcttttaagaccttagtttgtaaatcttttaacttctcagcatcagtttttctgcctatagagtagatataatagtatgtaatgaagggtagtttatgattataaggtc

SEQ ID NO: 115154 - DNA, 1129 bp, Homo sapiens
ggcattagttggctatgtggaatttacaataaagcatgctgcattgagtcttacaatgaaaactgtgcactgcacatccttcatgttagtgaaatttataacaagctagtgtacagatacacatgcacactatttttgttgttttaaacacttaccaccgagtaacactgcctccagttttgtccctccagcttatggatggttctcaagcatatggatagtgtctggatgtagcctgtagcagatgctgttggtatcctacccagatctcctttcctgggccagtgcatccatctcccagctgctgtgggtattggctgctaatgactcacacctgtactcttctccagaggcctgcccttggctgacagtaattgccccaaccaaatatgtttgggagattatgagatcatgccccaaccccctcctgctccccagggatggctaatgactatacaagggtgtaatagctcagctcccttgcctttggactagacaacttctgtggttcaatccatgctttagagttccttatcgcatcaagctgaggctagatttctgaaacaatatctttgcctagcttcttcccccattctagcttacttctttcacttctagtttctcctgacagcactccctctaaatcgggtgtacaagaaatgatgtctcaggctctgtgtctagggaaccggacctaagatgttgcttatctcagtacccctgctgtttccttagttccaccaccacctaagtaatgaattccctatattaaataatctctggcttaaatttcctctttatttttgttttgttttcttagttggaccctgcttgatatgcatcaaccctgctcatatcccatgtcttcacatacttaacattactcaacatcaaatgtccttgatcctcttattaaatatatacctagttatttttgtatagtataatggtgaaatcacagattttaggacctgaaaattagtttcaaaggcttagtcaattatacttccctccttagattgttgtaagaattgtatgagcttttctttttaaaacacttagtacctggaggataggaagtgtttaataaatgggagctgtttggctactgatattattctttcaagaa

SEQ ID NO: 115155 - DNA, 1045 bp, Homo sapiens
ctgggtagacctcttagttttgagattgccctcccaactccagctcttctatcttgggacttgagtcagccaaggttagaataaagatagtttaaagtaagacttttattcccgctagaaactagctctaaatttatgcctaaatttcagtagatcttaaatgtctttttctcacattaaagacaatgagtatccatatgtgccatgtcagaaattaaagccatgttaaaaatttttataaaagaataataagctcataacatgttaatataaataacatttttaatgaaaatcaacaattttgaaaacaaaaaaatagtgagaaaattggcaaatctttttaatctggtttaatagaagagggccggatgctcatatctgcttctacagttaatctgttgttaatatgttgtttgggttgaagtatatgaagaaagtctagtctcacatagataactcaaaaagggaggcatgatttaataacctttttaagtaactgttgattgtcttctttgatactatactgaaattcttcaacaggtggttgtttcttaatcagttgtagtgtggaatctggaaaacttatcagggaactttttgtactcagttaattaacttgcattggtctttcttgtactttgaatgtatttttttatctatgcatggttttgtaacatcatgcattcgtcatttggaaaatattggttcactgagtagtgtagagcttccaaatgtttacagattactttatgaatatctgtctattaatatcaccaccaatctcatcactgaaaagctgtcaggctcacttaaaacttagcagaaataagttttctaaaattctagcttttgcttgaaaacaaattttaccattgacaacaaatactatcatttgttttccttgaaatgacaagcttgcacatctatttttgagaaaatgtctatcaaacagtcaaatctgaataatcatagtttgtcagttgaaatttcaagtaaaaatggagttgtgtgaagtagcttacaactcaaacagttgtacaagtgc

SEQ ID NO: 115156 - DNA, 1057 bp, Homo sapiens
aattagttgctaataactttactcaagccaccaccatcaaccaaaaagatagattatttgtatagcaaagaatgatttgcttggtaaattctacattctacttttgagaaatcagaataagtattctataaaagattaattctttaaaaactattgagtttccattatgggttagatgtggtcagagtatggtgatgaatcagacacgaaaatgcacaaaactcccatatggttcttccagtgtaatcaggaagatgaactatgcatttagattactatgctacagggtagaaagtgttacatggagaaccaagagaaacagaccagaagatttttagaaattattcccagctgcaagatcaggtaaagcttggtggagtaggcaacatttgatctggcccctgaagcgcatgtagtggtttgaatttacaagaactaaggggacaactcacacggtagtaactccaggcaaaggagataacaaaaccaaatgcataagggtggaaaccttaggtctggtccaggagagcaaaacgttttgctcatttgtggagtatctaaggagatcaacagaggaacatggtaggaatggcaaagtggagccagattatggagaactataaatgctaaatcaagtcatttgagaacttcaagttataggcacttaatgtttttgagcagagtagtgatataatttgagctagttttctggacaagtattagtatatttgtgatagtttgtgctagttttctaggtaagtatcttggttcatttgagactgggtaatttataagcaataggagttttttttggctcggtacggctaggaaatccaagttcaaggggtctcatctggcaagggtcttcttgctgcatcaaaacgtgcagaaggtatcacatggtgagagaacatgcaagagagaggagaaaatggagaaaactcctcaaatgaacccatttccaaaagaacagcattaatccatttttgaaagtgaagtccttgtgacttaatcacctcttaaaggttctacctcttaatttttgaaggggcattga

SEQ ID NO: 115157 - DNA, 1029 bp, Homo sapiens
tcagtcatttgtatataagaaaaaatattcagaacagcagcaagcctatgataaatgtgtttaaaacaaatttttaaaaaatggacgttgatcctatgtcagaattacaagcttaagcagattaacatacttttatatgtgctgccctataactgtttcgacctgtctagaataagaagagcatgaaaggagtgatatcttcttatcagtcaactatgaaaataagtcctaatctaatatcagaattgtaagaaaattcagcactgtggaaccttactggatacccaataaatgtctcttctcatgtagcctattctctgtcctcaggcaaatatagtctttaactatcctaatctaaataaaatttagacagtaggtgtaacatcattcaaattacactgtctctctcccttttctcctgagtgtgttcttcgtgggaaactgtatttggaagtgaagtgcttaacctcaggcaatgtttcaaagtcatttgtcttctttttggctagtgcattgatccctactcctttaatgctgtgtcactctcttttgtataaccttctctttccaagtgctgtatgacacattaacacttatattttaaagttaattaaaattaatttcattttgagagttccacttgcctcttgagacagtaagatgcattccagagcataagatagaaggttggcaatgactgatttagtgatatgattaagtatgaagaaacctgcttgatggtatatgtgatggagtgggctagtcttgttttaatatatagtaattgtgtaaagagggaagtctgatcactttaagacatgattttaatggttcattcatccaccttcactcatagaaactattcatttcgaattgtctgaaataggatgatcatgttactagcatcctctttaaaaatggcaatttcaaaacacaaaggggaagcttgcttctgagaatagaaaaaaagggactgtaccgctttagaaagaagctcagagagaagaaacagtatttcagataagaaat

SEQ ID NO: 115158 - DNA, 1001 bp, Homo sapiens
aaagattcaaggttagaaaggtcatttgggtcaaatcatcaagagccttgaatgacaggctaataagctctttggactaatgctttgcaaggtttttcacattatcaaacattgaaaatgataatattttaatggtatattaggataaacagaaactgcttactgctagaggtgatgacaagagatggggagagcatgccccaggtcccactggacaccccaagggctacagggatctcagcacttctgtaatccttccaaggcacatctaagttaggaagaagataagatttgtagtttcagatttcatctagacatttctctcaaattcaatttaaagctgttttgtgttctgcccattttctcccctccacacatacatacgcatccttccttagatgtgccaaataggttcctagtttccaaatcaactacctagagtgccattcatttaagtttccttcaaaccatggcttttaattgaaagaagagatgattatgtacctgtgtccctggttctttaattttctacctaagttttggctaccaaaaatcaattctatatttcccaggtatgtatcattgtatttgtttttccctacttgtttttgattttatgatacttttgaagaataattacatctcagtactaatacaactaattttgacatgaagttttctcacgatagcctatgatctcctaataagttaataatatatcatttctgataacactttcagggaattagtctgtggccctcaaataataataaattacattgttaacttttaaatctgaaagagctattgtagactaaacaaaattaatgattttctgtaaaaggattttccttgattaaagaattaagtttcaatagcaaaatatcataatttaatgatgccacatcgtcactgggtgttgcattaggaaagagagtgcttcccagaacactttttttaaatctctcttgacagttaaccaataaaattaagaatgtaaa

SEQ ID NO: 115159 - DNA, 1548 bp, Homo sapiens
attccttcagggagctcacaggctatagggaataatagacatgtaattataaaactgtaatggagtgtgataattgctatagtagagttacgtgtgaagtgctgtgaaaaccaagattggttgcaaatcatagaagacctagcccctttcatgttggcacaaatccacgaatttgggggtaagtcagttaaatcagctacaaagctaccgaactactgccgtctgatttctttctttctttcccaaggatactgtaagagacttgtcaaatactttcctgaaatgatcccatactatggtattccccaaatgtaccaacctagcaagtcagtccaaaaggagctgagaattatttagaaacatttattcttagtgaacccatggtggttcacaatgatcccagtttttaaatctggggcaatatttgcctatcaccaatcatctggtaaccttcccattctccagggttacataacattgctcagagcagttttgcagttacatctgagtttttctgctatcttgtatgtaatctgtctggatctggagacttgagttaacttaaagaagtttgatatactctctcctatctgcaaatttactttcctcttaactgttttcaaagttactctttttatgccctctctagttttttttcttatctgatcttaacatttttgcgagtataacttcattttagcctctaatctttccctttctgatagctttatcctcctttaactgtcttcctgttttggatgaccattcatggtctccgccttctcatcttcttccaattgttaggttgaaatcctttctacagtctagggtaaatgatcatttttggtagtgtagtctctagaataacatagtaaccatttcttctttgatggtcacaattaagtttggagacttagatttgtcattgttttcttatccttctttgctatgaaactgtcagctgaatcaggtatacatttgtcagaactgaggaccttatagcggccacatgtctaatggcatctggctctgatagtgtgtctgttaatagcgatatgcctgctaccaagactggacaaatcacgtatttggccatggataatacttgtgtggggtactgccagcacttgccactttctctctcctcggggtttgattgctgatctaccctcctccttatcaactcatttttatcagtacctctgtcagtattcctaactgaatccgacttgtgtggaacttcgactctttaatatggtttagacaatttctgatgattaatgataaaataatttaaccttcagtatctatgtccttggtaggcacttcccagatcttctatatgcctgtgttgtcctgtgtaatttggtatagatctggcacttagtatttatctgattttcttttaaaagtttatgtttgaattgagtttctaaatatttccttagattagatattaaaaacagaaaattcaggattaaaacatcgtaaggctcttgatacataatacaaaaccgcttattagaaaatttacatagatttacattc

SEQ ID NO: 115160 - DNA, 1072 bp, Homo sapiens
tctactgcagttctaaatcaaattttaaaacaacaaaacattttaatatctgtagctggaaggagaatgtttggagctgtgcaactggcaggcaagagtgtagtgactgaagaagagatgattcttgggccagttttggacacaaactgaactaaactaaaaaaaaaaaaaaaacccaggcagactgtcctgtctagcttcccagtaaagtcagaggggacagtcctggcagtactatggatttgtatgctgggatagatataaacagcaaaactctcagccctgtggctataaaaagaattattttttatgatgtgttcgttgtttaagagcaggctgtgagttttgtttaacatttaattccaatacagttcaaaaaccagaattctatcttgtgtgcttaagctctttcagatgtttttattgtgtaacattttctccagattcttcttttaatgtatgtttttttttccctcacaatctgttaaaagatcagtttgcgtgaatcttgacactgtgatgctatttcatggttttaatttgaatgcgagctgttgcagctggaagcatatgattaatgatacagacttgtttgtcacaaaaacagatgatattttacatttagtcaagatgcattgaaaaattgacttgcttgtattttactggctgtaagtcacattttaattcacttttgaattctccttataatttgaattaatcttaaacatgcagatatatctctcatgatgtagctggctattgaaggtatttgaaggatgattagaaaatcgcatattaaatatacattatccattagttaagtagtcatttttaaaattttttttgctgataaaattgtactaaatgagtcaatgaatctgggagtcagtatacaaagagagtgggaataaagcttataaattcattgttcttgatggcttatatatttttatatacttttacagtttacctgaataacaaggtgatgtttctgatctcccttgccttctgctgtcttgaaactctgccccacatgagacaaggcagtgttttccagattttctaccatcac

SEQ ID NO: 115161 - DNA, 1218 bp, Homo sapiens
ttctgcattctctatcctgttccattggtaatttttatttttatttttttagagatggggtctcactatgttgcctaggctggcctcgaactcctggcctcaagtgattctcccaccttggcctcccgaaatgttgggacaggcatgagccactgtacctggatcgagatcctcctattttaagatgtgtggtggtactcttctggaagaaaatcctaaatataataatagagatttatacattagtaactcttattaagtaatttgtagcattacaaaagaattagtggttttataaaaggtttcaaattttctgtaaacattgaagtctcaatacatattaagttatttgatttggctgcgtattttccagaccatttctaaggcatactttgactctaaaattctcttttgtaagtgattagtcactgcatgttctcctcatattatttcctcatcctactttcctttaaaaaaaaaaaaagctttctctcttaaaatccatgttacgggattcaaagcttctgaaatccaccatgcccaactataatatacaatttaaaattcacattaaatttcattgggaatattctttataggctgtgatgaaattaaaatcttacatactcctccatttatcatctggaacaatatctctgtgaacaaggaacaaaagaacaaagaaatgatggttacaagataaggaaatctagtaggtaagagcctgcacaattttgagataaagttctgaatttttacttttcttgtttttatatattgtatcatggtgtctaccccaggtttattagagaagctgaaatattaaccttgattggcagagtggctattatcgtttttatgtgtactaggctagggctgggccaccagtttaaagaggtgtcaactgaggagtggaagaaaaggttgtggcatgtcaggttataccctaaaagtgtaaagtcccatggcaatacaatgtgagccctaatgcagaaaatactctcagaggaacatgtcctctttgcatagcatcgctgggaatctcgtccagggagttcaatggggcaggtcaccagaggaggacacaaggggcaagtgcaggacggccatgtgcatcatttggcccatgtgctgaccatatgaaacctgctttgggactggaaaatgcctgacatggctaacctagaatatatcactttgctggttcctggcaccatc

SEQ ID NO: 115162 - DNA, 1158 bp, Homo sapiens
attgatacatgcaacaacatggatgaatctcaaaataattatgctgagtgaaagaagccaagcaaaataaaatagtgttctcctactgagataaatttgtattctatttatataaaattttagaaaatgcaaactcatatttagtgacagaaagaccagtgattgcctgggagtgggagaaggaaaatatggcaataagtgaaagagagagattaaaagggtcatgagaaaacttttgaggtgctggatatacttattatcttgattgtggtgatggtttcaccatgtatacatgtcaaaacttgtcaaattgtacatgttaaatatatgcagtttattgtgtgtcagttataccacactaaaactattaaaaatatttctataacttgcaaaattaaaagatactcttaattatctccagttaaaaatcgttgaaattgtgttttgtggagactttggcccttttcttggattgctttccaatgaaaatttattctagacagattaaggtaaaaaaagcttgaaaaaagatgaaagtgactgggaaaggactcggaaagaaaaccgtcagtttctaggtaatcgtatatagctgaattgttaagattaaatgtgtaagcacttcaaactctaagataaagaaattatcaaatcaattaacttaatgtgtagacttttaaaatctcagtgctaataagagaagacagattgatctgtctgtgtacagcagcactcagttaataaaaaaaaatgacagattcattatataaagagtgagagatttctcagtataacccagttgtggttcatgccgtagtgatactcaaaaccatagtgatataacattttcttcccaaccattttggttatatttataataattattcgtgttggtgattctgcatttggcaaagtgcagatcttatagaaaggagcaggttggggaaaaaacggtaatgacattaaggtgaaaaaatatattagaaagcatctgcttccaaaatatattagcataattcctatctagacagtttgtgttttgtgtatgggtaatgaaataccattttttgttgttcaagaatctttgcagtttcaaatcatcttcagctgatcttctataagtcttaccatatccagaccatatctttggttaaagtt

SEQ ID NO: 115163 - DNA, 1047 bp, Homo sapiens
tttagggtatagattatgatttaaagaagaaaaaaattgaagtttatgtgtcttaaaggcaattaagaataaacatgataataaaaataggatgatatattcataaatgaatttttaagaaagttttgaaagtttacctattcagctcatataataaattatcttagggaacggagtaagagttcaccgggatcaaatacaaattttgctttatctgtagtgcatgaatttttttccataactttttttttaaagcataaagattttttaagaaaggaaatgtactgtaaggacaaaaagcaaagaatatttgatacatttagcaaagttcaagaaagaaagaaataaaacaatcaaaaaagttgtgataaatagaaaacacgtatatctgtatcaataaccacaataaatgtaagtagattaaattcccttttctaatacggatagcataaaaatattacatattcagctatatatggtgacaaaagacacttctacaaaaaaagataggttaaggtaaaaatatatataggaaatgatacccttaaaaaaggccataaaaaagaaagtacttaaagtaatatgagatgaaatagaattcaagcaaagatcattaaatagactaaagaaaaagatttcatattgatatactaagataactaagtaatcatgaacctttaaatatttaactacataatcctgaactatataaagctaaaactaagagaaatgtaaagtcaacagatcgatccacaattagtagggaaatttagctctccttatttgagcagataacagatcaaataaataaaaatatataaaggatttaaatagccaattaacagacttgatctaattgataattgtatatttttataatcaaatagaaaatatatgttctttgaattatccatataatgtttacacatgtgaccatattttatgtgttttctggttaatatccagtaaaattagaaattaatagcaaatagacaaaaataatggcacagccaacaaaatttaaaagtactccagtcttgtgtcatg

SEQ ID NO: 115164 - DNA, 1125 bp, Homo sapiens
tctttgtatacttcggtgggagagtgatgttggccataatgattatggaagttctcagaaaaacataaaactagattcccataaatggaatggcaactcgacaactgttgaagaggtaatatgcttatagctatttatcacttaacagactagattgattctctgacacgttcaaagctgattaaaatagatctgagtagtgttcttttgaggaatcaaaaatttgttgcatttaatttcttgcggtccaaagtattgttgaaagattctactgaagatgcttgattattttaatcttgaaattccctggtatttatggcatcattgtgagcagcaataatgcgaagaatttatgtaaagttaattatcactgttggtacaagtgtgtgaagcccttaaatttaagcaacgtacatgattgaaaattggaagttgtttttttaaatgtcttttgttatatatgtctttatatttttcttccatagccaaaattctattttatgaaaaaaatggtaagaaaagaaacaataaattaaatctataacaaaaatagatttaaatcctcaacaaagaaaagaaagcaagacaaagctaaaggtacagacaatggaaacacgaaataaaagaggaattcgtcaggattattaatcaaagggctcatcagagttattaattggagctccacatttggagctgtgcctttatttttcttttctccttgtgttaagtagtggatagcagctgtgtttacccacaaactaaatccttgagtgtgggtgctagacccagagaggtagggcagtgcctcagtaatgtgctgactgccaggtgggttagaaagcccacccacacaggagacaagccacttgtctgtccctattaatcactggaaacagacaatggtaaacaaaagagctggcacacagagattctcaaacaaaagatgagcatataattatgacacaccgcaatatgaagtaaatcagtaccatgaaagaaagatgccaaatgaaaaatgagaagaaaaaatattcaaggacctagaggtaatagagtgatcagaagaagacattcagagagatgtattcatgaaaaagactcaagcacagaaattaagaatttaaa

SEQ ID NO: 115165 - DNA, 1201 bp, Homo sapiens
aatgttcttataataatttttctatgcaaagtttttaaaagactgtgttctattagggtattttaaattataattgtacttttaagaaaaataaatgtatggcatattaaccatgccatatgcttaaaaccttaaatacaatggttgctcagaaactattgataaattaacgtctagaaattagtttaatttaatttaattcaaaaaagaaatacaagcagctggcagaacattcaaatgaaacaaaataatctttctcctatttaaaatttccagatgcatggtttataaaaaaatgcttttttgctttgtggcttctgctgattattccttggtgacaataatattacttatggatatttaaaaatcaaagaacacattgtaaatgcatggtttgagagttatatgggttttaaatatggctgttactaagtattttatttttaggttggacacaaagcttttattgaacaccttccaggtataagaaactattggttggttaataagacatttattacatatgatgtttacttggatgaaacaaacagtaactgtatgtggacagttttaaaaaaagtgaacaccaaggaattcgtaaggttggctctgtgccatcaaaattcagtacaatgaaagatcaagttaggggactagaggtacataaggtgggaataggtctgttctcaagcacggtttaattttgccgaaagagctgttccctgacagttgctgaaatggaaattacaatggagaggataccataggatttggtggttatgttttagttggtacctatttcgtaatgaggttaagagatgcaggtaaaaggcagagcctcagggatcagagcagatacattcgttccaggctagtgatacataagtttttggcatgtgttagtattgaagagcaaatttctagcctatgcatagattcttttactttctcaactttaatagctctgtttccagttgacacagtgtctgaaggaagaggggactttctgagtagaatccaattgtgtatcctgtgtcacatgctcgggggcaagcacttaagggagttgacttcttgacagctcattcactaagtcatttcctcaaatattttttgaggctaggtactaggttatgtctcaaccaggaacacatgaaaagctaggctaacctgtataaagtgtagctttcctaggagttaa

SEQ ID NO: 115166 - DNA, 1374 bp, Homo sapiens
acacacttgcatatgtcacagttgaatttattgtcttgaatggtaatagttaagtcataaatatatagttaatcatagaactgtatactctgaatattttcttataatataaaacttgtattacatgtattataaaatgattgcctatgcataagtggataattatgattgtacttttaagaaaaatagatacatgacatattaaccatgtcctttaaagaagacactaacataaatactatgtaattctaatatgaaatggttataatttaagtaccttaatttctagggttgctgagttatatgtgagaaagaattataagacattaactttaagaattaaagttagatgcagaggtcctcatagatttaatattttctttgaaatttctctatactttcaaatgtctttcttatatctgataaaagttgcagagtgacattacatattaaattaaagaataaggcaatattttgaagtaaaggggatagtgttatatattgccgtaatacacaactatgttttttgcttgtttgtttgtttgtttttgaaatggagtctcggcgtgtcaccaggctggagtgcagtggcccgatctcagcttactgcaacctctgcctcccaggttcaagtgattctcctgcctcagcctcccgagtagctgggattacaggcgtgtgccaccacacccagctaatttttgtatttttagtagaaacggggtttcaccatgttgcccaggatggtcttgatctcttgacctcgtgatctgcccgccttggcttcccaaagtgttgggattacaggtgtgagccactgtgcccagccacaacaactatgttttgataatggcagaagataatattcagttatcagtttaccttggaaattatgtgtttctagtataaatatcagctacaaaaagtaaataaatcttaaccagcctaaaaagagacaatttgagcatcctaagtgttttaatttaaaagttgctaattctttttttatgtttttgttttctaattttaggttttagtattaaagcagtgccattccagaatgccatcttgaatgtaaaagaacttggaggtataacatttcaaatcatttctatgtctgcccttaacttttatgaatttggtaataatgtattatatgtaattcaaacataatgataacttattttagtaggtggttcatttttatcttgataatatatttcctagaaatatttccttctcttcgtatgttttaaaaattgttgaagagttctaagtaacataaactttgggggttttttgaatgaatcaaagaattacactattattggcaatttatacagctcattggttttacttgttcaaaaaattctt

SEQ ID NO: 115167 - DNA, 1079 bp, Homo sapiens
ctctactaaaaatacaaaacattagctgggcgtggtggtgggtgcctgtagtcccggctactcaggaggctgaggcaggagaatggcgtgaacccgggagatggaggttgcagtgagccgagaccacgccactgtaccccagcctgggtgacagagcgagactccatctcaaaaaaaataaaataataaaataacattgctaggatactttgcttagtgtgaacttttgaagacgttttagtagtcaacttatgaagactttgcaagaatttaaagacaataacagtgacataatctgcctgttgggttaataaatttcaaaagttgtattttgcacataggtgcagcaatttctggaaggatattacttccctttgagagcctgcgtattgtcagcttttaagaatcaaagcagattaaacattggtgatgtgctccataaccatttccttttcaaagttgaggcctgtgcctgtcttacttctctagaaaatctacacttgagttgtcctgagcataaccactaatagactgcttaatatttgcagagagcttttcattttcaggatttcaccatcattgctttttaatccatataacacccgtgtgaggtaggtagatacattcaggcatccaagtctcctgcaggtgaatttctgtgccagcaggaatattatgattggcactgactttccttaatttcccagaggccagacacctggagaggctttcctgcaggctcaggtacatgccagtgtttcagccacatgggactgcctcctctttcctcctgctcatttactaggattcagtgacttcatgcaccattaaccataatgctgtgctgactgtgtcaatctgcattaagcccacaaaggaaggggtatgttttagaagattgttagagggcccaatgaacattttccatcctttctgtgcagcagacttcagctgttgacatcttcgtcactccaacaaaagtacttttcattcaatggtaacttttacatctccaactacatacttagattaataagtgagcacccagaatcaagtttgtaattatattcaggcaggca

SEQ ID NO: 115168 - DNA, 1046 bp, Homo sapiens
tacattatgactgttatgatatcccttttttttggaaagcatttttcttagaaagcagttgttcatataaatcaaaagttatgaaaatgttcacagacctagtaattatgccactggcaatttattttaagtaagtaacttaagggaaactatatgcataaagcaatttcttgcaacattttgtattgcaactaaaactttaaggtagtttaaatgccatacaacaagggagtttgttaattacattatggtaacttgatcaaaatgattatagattagaagaatatatacagtcttctatttaaaaattaaaaattagatttacatttattttttgaatttaaaccatggaaaactatgcatttgaattaaaaaactagagaaaaactataagaataacagtgtactttattgatgtgattgaattatgggtaaaacctttattcttttaaattatttctctataatgtcttgaaaatataaagccaattaaaaatgcaatatttattgaagagttttgaacattcgaaaagagaatctaccttcagagttggtttcttaaaatgaaaacatatgagaaggatgtgttcgtttaatttcagcaaggcgagaatgtctgccttttcttcagaaagagaattcaaactttattggtttattaacttcagcaatttttcacctctgacataatttttaaaagatacttaaattgtcaaaactcaaagagccaagaaatcctccagagagcaggacctgttggtgaggagagaaaatttgagtaatttgcaccttagtctagaaataaaagtgaactctatccagactgaattcctttactgtatatgtatgaggaatttgttgataagaggggttgttaaactgtagattacataaatgttcacttttttttttgaagcagaggaatggaatctaaaggcttaggagaatatattgatggtacatggagaataacctagagaaaactgaacactttgaattgaaaaaggttgaaaacatcttctagggatatataccatatttgaaaa

SEQ ID NO: 115169 - DNA, 1069 bp, Homo sapiens
atagtgcagagacatcagagtattttaagcaaggaaactacatgatcagatgtccatttgagaagaatcaagctggccatgatgtggaggctaaattgtgagtagcgcagttggaggcggaggcagaagattactgtgatggtgcaactgagatgatgaaggccttggctgaggcagttacagggggaagaagaggaaggaataggtaggatatatatttgagagctagaattgacaaagcctagtgtagttgggtttggagggtgagagtgagaaagccatggctgtctcaattcctggcttacgtgatggttggatgatggaattattaactaggatttcctacaaaaagtagaaaggatattgttgatcaagaaccttacttcagttcacgtcagcttttgccggcaagtaagttttaaaaaagtgcaggttttgagagcttttcagattttagaattgagataagaaactgtggagctgttaaagggttagagacattgcttgattttaggatgagggaaaggataaggggattgtaatgagtagagaccccagagaagattagcagagctcatgtgtagcctctttgcaggaagctgtttctgactaccttcttttctccttggacagaactgagtactccctcctctccccactgggcgttgtccgtatttctcccagttagtgcctgtagcactgctttatgtatgtgcccatctccccatcttgggttagaatctcttaagggcagctagagcatcatatgtggtattgtatacccagagtctgtcacaaggtttaggcatggatacagatgtctgttaataagcaaatgaaagtaaattgaatctatatagtcttctgttagccttataacagcccttatatgacaggtaggaatctttttccatattctgtttctaaattacctgaagatcaaaggtatggtgacatggctattgttacatagctagagataggatgccagttcaggtgttcaagtgaagtttagtggtatccaaggtttaggatttctggtggaagtaggtactttattggttgttta

SEQ ID NO: 115170 - DNA, 1044 bp, Homo sapiens
ttttttttccccttttgatctaggatccagtccaagatatattgcattttattattatgtctttttagtcttctttaacatggaacagttcctcagtctttctttgacttttaagacattgatattttggaggagaacaggccagttgccttatggaatactccttagattggctttatctggtttcctcatgcttagattcagattgtgtggttttggcaggcaagctgtgggatgatgtcatgctttttgcagtgcacctgccatagcaggaagggaggcatgaagtagaaaaacatttcataactaagaatgttaactttgatcacttggctagagtggtgtctccaggtttcactgttctaaagttaccgttttcttccttataggtaatactttattcaattacctcttaatacttactcagtcattttaaatgtgactatggtttatttccatactgtcatttaaaggaacatttttttccccttcttttggcagtgttttagagcactttgctgcaagggaccaccacctgcacgaccagaatatgacctggtttgcataggcctcacaggttctggcaaaaccagtctgttgtccaaactctgcagtgaaagccccgataacgtcgtgtcgaccacaggtgggtactgtgctggggttctgtcccttcttctttctcatcccaagatgtcctagtttcctgtgcaatttatcccctcccttctacttatagtttaatgctttaatcagtttattttaattttaaacactatctctttttcaaaaaagatttgaaatgaatttaatagcattaaattgctgtatcctatatccctctagcaggtcatttcagtggcactgaataaatgaagcttgggaaaatattaatacaaatgaatcctgaaatctggaactctgatatatgacaaaatggattcatcttgggcccatagagtactttccttccttgaagtgtcactccagcctatgtttcttggccacacactccctgaatagtaaactgatgtagtctgaatc

SEQ ID NO: 115171 - DNA, 1037 bp, Homo sapiens
aaaatcgcaatgagcagttatttacctgtatggcgcctttcttagtagcatgatgtattgcacccaggcctcataacatcctcctgaagaaaggaagcggcagagagtgttaaaatgttactggttaatcgtggggaaactgaagcatggataggtttatgaggcttgaacagagttacacaatgccttagtgtttggcctgggaatgaggcctgagtttgccgcttgctgtcaggactgccgacagcattgtgtttcgcattgtacaacagtgaaaggggcttactcttaacaatgcaagagctgctgtaggagacacacacaatgaactttggtacagtatagtctagaggccaaaatgagtaattttaagtaaattgactataggatccaaagcttcattaagttttaaaacaaaaaacaaatgaaaactctttacagtttttaggaactgactcagaaaacatgaccattccttccccattggaagtagcatactgttgaaagttttatcttgttgactcaaaatctgacactattcctgttacccataggatgatttattcagtcagttcaaatacatgttgatttctaagagtctgtgatttatgtcaaagattttgccttgtaataactatcaatctagccattaagttccaaagaaccttatttccacagcctgtggttttgtggggaggcttttgttttattcagttttggtttgggttcttatagaacagctggaactatagagcctggacttagagaaagagcttggggagacggagggggagatgtcatgttggatgtccttatgacattcggttatatgattgaaaccatgggactggagatgatatcactggtgagaatataaaaagggaagagagaccaggctcagtggctcacgtgtgtaatctcagcactttgggcagccggggtgagtggatcacctgagctcaggagatggagaccagcctgagcaacatggtgaaaccccatctctacaaagatacaaaaattagctgggtgtggtg

SEQ ID NO: 115172 - DNA, 1061 bp, Homo sapiens
agtgagggtcacagaagttgtcttgaaagaaatgatcattgagctgaattttgaagggtaactaagagccagccagaggaaaatagtgaggaaggatgtgtaggcagagggtcagcccctttactgacatggagccggaaagagaatggatcagaaactgcatggaggtgcataggattgccttgagggccatgtatttggtgggaaaaataataattaatattattatcaattaagttttgtgtgtcaaaccatgttttagctgttatagacgttatttcctgtggtccccataacaactattggatgccagaaatgaaggcaaaggtcagatcataaagctccttgtctgcccagataaggagtctgtactttatcctgacagctgtgggtagctatagaaagattttaaatcacgggaaaaacatggtattctggagactgaattggagtaggataagacctgaactaatgacaccagttaggagaaaagatagtgtggttatccaaaggactgtggtgatgtcctgaacaaagaaaggcactgggatccaggaggaacagggaaatagtagaggcaaagttggacagattcataggaattggtgactagtagaatatatgggactgagctccatctttatggagcctaaaagattgttaagtgaagaatagaataggatttccacttttagggactacaagaaaaacaattttggtttgttttcctttttttttttttttttttgttataagcctttctagcttcagttccaaaagcacagtgaatggaaagaatctactttattgagatctttcctcctagggatttttgtggtgatatttaaatccatttgaaggtctacttgtggaacctagtctctctctctctctttttttttttttttttttttttttttttttaaagacagtgttactgttgcctaggctggagtgcagtggcacagtcatagctcactgcagccttgaactcctgggctcaagcaatcctcctgcctcaccctccccaggacctgggactacaggcgcacaccatcaca

SEQ ID NO: 115173 - DNA, 1362 bp, Homo sapiens
ttgctgttctttagccttctcatcaattctgtgaattatcagtatccttccaatgaattgcttttctgttatttgcaatctgaaccctgttttgtacaaaaggaaaatgaggacatccctttttaagaaacacttgggatgttcaagaatcttattttcctggtagtttaagaactcctttgatagagtgagtgctttgtttgacaaaaaaaaaaaaaaaaagtcgatgctactgagactttattctagtaaagctctagttaaatgtataaggcccatggagcctctctaatatcttcatgaatctgtatatggtacttgtataatctatgtaatttgggctataaattcaagaaacataatttaaggcatttgtgcctgtactaatttcagggaataatataaagcaaatactaaaaggattagtaatataaattaagtccacatgctacatttaatcttgaaggaaaattttttttggtatttaattttcaataagtgatttgtgggtgctgaaagagatcagctgacatctgataggtgaccccacatagatctgcctttatctgtgtgttcagcttttgctcgtgaagtttgacagtagtcagaaagtgcctctttaataaagcacacctttaaataactctcacagattcattccagcttttaaagtgagaagatggcttgaactcccactgctgccagctcagctgtggatctgaaatatccagctgtgccctctctgcctctctcatcaccaataacagactttgcagtcagaatctgtctggcacgtgtgttgatgtgtgaggcgagatagcattttgctcaccgtattggcttctccgcgctagaccatagtaaacatttgtctttgtcagcagttaaagcagtgtgatttgaggatgtacagggattacggacacttctgctctgttatgcttttgtctaggtctacatagaaatttatattcaaaaagagtcgatttaactgttagaatagaccagtaattcttgaaagtgtgtttttaggggttttcttcacctttaggggaagaaaataatccaacgattgtcccactatatgtcatactacgagcttttaattgttgttattattgcaaaccaaatggactgcctctgtgtcattagccaccattgggatttggcatatcatatcagatctttgaccaaattggtgttaaaataagcctaaaccctgaattatctttaattatctactatgagaagaatcctgatgtgtggtcataaaaataagttttctttgggaaaacactattgtaactgaaaaatctaatattagcactcatgatgataataacacctattgattattgagta

SEQ ID NO: 115174 - DNA, 1071 bp, Homo sapiens
tatggactaactttttacactattgacattttcttttgttgtaccaaatgttttagttttgataaagttcaatttgcctattgtttcttttttcatctgtgtctgtggtatcatgtccaacaaattattgccaaattcaatgtcatgaagcatttgccctgtgtttttttctaagaaaaaactttctatgtttctatgttttttatacttttaggtcttacatttaaagcttttattcatttggagttaacttttgtatatggcattaggtaagggtacaactttattcttttgtgtgtgcatatccagttttcctagcaccatctgttgaaaagactgttctttcccactgaatgatcttttcacccttgcccaaaatcatttgaccacatatgcaaaggtttattttggggatctctattctatttcattggtctatatgtctgtgtttatgctaataacatgttcttttgattaccggacgtttgttttgaaatctgtatgtgtaagtctggagctccagctttgttctttgttttcaagattgttttgtcatttgtgattctatatgaattttaggatgggcttttttatttccataaaaaaattatttagattttgataggattgcattgaatccatttgggtagtgttgacagattaacattattgtcttttgtccatgaacatgggatgtgtttccatttatttgtatcttctttaatttctttcagcaatgttttgtggcttttattgtacaagcttttcacctccttggttaagttagttcttaagtgtcttattcttttacgtgctattataaatggaattattttcataatttccttttcaggttgttaattattagtgtacagacatgcaactgatttttgcacattgactttgccagtgacatgaacctgtatgtagaaaaccctaaagattgcacaaaaaaaatggttagcttgagacgtaaaccttaggcaaagagaagtttgtgatttgtaagaaatttaaaattaataggattaaaaagagagctgtgggccttgttatgtatttgctttggaa

SEQ ID NO: 115175 - DNA, 1231 bp, Homo sapiens
gtaccggttcactgcctgggggttgaggacccctggattagagtattacagaaatatttaagaggtgaaatcaatacaagtaagagacttgtatcaattttggacattgtgagagacacaggattgaggataagctttggatgatggattggatgatgctgcaatttactgaaataggaaatatagaaagaaggaacaagtttcttttgtgggtggtaggattgatactgaaattggatttttattagtttgagagtacttaagggagatctagatagagatgtttaacaggaagtttaaaaactctagtttggctctccagagcaggacgttgaagcagatatgggattcagaagccatcaaaatagtagaagccatgggaatggaaggaatgtcctacgtgaaacatgtcaaatgaaaagtgtcactggacctacatacatactcttgatttctgtcttcaccaccccagtaagatggtgcttgtgaagatcaccaatatcctccatatttccagatacaatggttatctgtgtgttctgatctaactactcagaagcattcatcttagttgcttacctcctccctcttgaaacacttaagttttcttactttcatgacacttacgttttctgttttttctctcaacagactgactggtttctcctcttgtgtcttcttgtaaagattagaaaactttaaaactctgtctagacccgccccccaccccaactctttgtcattagcatgaccttagtgttataattctagaggaagacaaaacacaggaggagtcacataaaagtataagatttgccaaatttaataggatgtgatttaaaaggatgcatgttccttccattcaagaaaaatgcggctagaatatagaattccatcaacctctgtccaatgataaaaggttaggaaataattcaataaaacaattgtaaaaaatcttgccgtcatgggacttatgttctagtgaggggagactggcaataaacaaataaatagtaaattactgagtaagtaagaagacagtaagttctgtgggaaaacatgtaaggtagttagaacatgttgtggtgggaaaggttgcaatttttttggcttttttttttttacttatactttaagttttagggtacatgtgcagtttttaagagtaatcagggcaggtcttactgaaaggtgatatgtgagcaaagacccaaacaacataaaggagtga

SEQ ID NO: 115176 - DNA, 1158 bp, Homo sapiens
caacttattcattacaggtattactttagacatgagaaaaaatagagaaaaattaagtgtgtgtcctcatatgtgcttataagtggactagagataaaagaaaaaaggtctcctgaaatcagaggttgggccaactgtcagattagtggaaggagcaaattatttccttctctagtttgtgaaatgactgtggggccttcagttgttgtagtagctatttaaaccatcaccatgttttgtaaccttttaaaattctcctgagctttttgcatgtttcttaatgaataaaggataaatacagtaaagtctgggttgatttttttctgtattttcattgatgatgtctgaatataggatctatcttgagccttgctgcccaggtatatattgaccacaggtggcttaatttggcttgtacatagtgaagtacatagtacattagcaacattaactaagtattttgagagtacagaatgtagtgtaagccttaagtggggagaagtagttatggaccttgggccttgagaaataagaatgatattgcctgttggacaaaaggaatgtagatttactttctgagtaaataaacatcctgaatgtctcgagatatctccttgtgacttccatctactagtagaggaggactgagacaccctactctttgtggcatacctcactacgcaggcctttgggatttgaaggagcatgactagaagtcctcttgggaagttggtaaagctaaaggtaaaattctcccttggtacaagttagatcaaacatggttcattttgtgcctgtgctgtatcaggtatctgaagtagattctttccaagcttaacctttcagacagtttttaatctataaatattagtgtttaaaagtcaaaaccctgtgaggtcattctaccatttctgttacctccctcctctcctcacgttaccacaaagctatatgtttctttttttgccaggtctaagatttttattagggtgagattagatttttcatattaggtggctggaaagtacagccagctgaaaactatcagccatttagactacatgcttcatttgaattgtgtttctggatgcaagtcaagtgtgacaactgagtttcataactttctctagcttgattcaaaaatgttttagggccaaa

SEQ ID NO: 115177 - DNA, 1035 bp, Homo sapiens
tttattcatgaaaggtgatatttcagataataatttgactttaggaaaccttgtaaataggtacaaagaaaacaaaagtacaacaccctcccctccaaatactttaaggataattgcatatgaaatgaccttttatataactgaaaagagctaggtctttattattcattttttggcatcccacttgtattagttttctattgctagtatattaccacaaactaagtagcttaaaacaacaccattttattactttgcagttctggtggtcagaagttcaaaatgggtctcaccaggatgaaactaagatgtcagccaggctgcattcctttagaggagattcccttttcttgccttttccagcttctaggggtcgcctgaattccttggctattggccccttttcattttcaaagccagcagtgattagtcagtctttcttacaatgccatctccctgattctgactcttctgacttcctcctttctgcttaaggacaattgtgattacattgagcctacctggattaattcagaataatatttgtaaggtcggctgattagtaaccttgatgccccctggccatgtaacgtaacagtcacaggttccaggggttaggatatggatatcttttggaggagccattattctgcctaccataatactgtatcacacaaatacatataatttttctgccttgattattctacaatatgagtggttgtttcttaattatacttgcctaagaaataagttaaataataaacttcttaaagggacaggagtcattattgagctaaagagagagctcattcatatgacttttaaaatgtcaaatttcgaatttatttgtgccatatactctagttggtacccatgtttttgtgctgtgagggaattccttcttgctttgaatttcctgccagttacatagcttgctctcttgatttttatccctatataattttaaatttctgacttgaggttttctaagaggccctagttactaaagttaggaggtcaaggagatggtcc

SEQ ID NO: 115178 - DNA, 1450 bp, Homo sapiens
agagggttttcctaactcttcatctaaataagatcacttacctcttagatttctttccctctcagctttttgaagtataacggtatacaatctggtaaacttttaagaggcaccctgttctttcccttcatagtgcttctcattgacagtatttaaacatgcatttctgactctgtttactattgactttccttctagactataacttcaatgagggctgtgggcatatcttccttgttcactataaatatctacctcttggcactggtgggcactcagtcaatatgggttgaatgaatgaagagtacaaactcagaaggttgatcctactggcacccttttcaagcttcgagaagtcctaattatggtatttgaggtgctgggattagttttttacccccttgcaactctacataaactatgtaactactagcattaaacagacatagactttgggccagatcaatataatctatttattactgccactgtttggtttgttttgtttttcctgtccagttctcttaatctggtatcattaatctagattagccaaagaaaaaatacagattctgggggtggaggagaaagggccaaaccagaagaagaataagggggaaggaggacaatttagtctgttccactagatactttttaagtattaaacagtgttcatgtctttcttctccattcaccagaaaattatgaatttgaggaaaaggacaaggaagttagagagttggtcggtcatcaggtaactttagttactgtttctggagcagtctttgttcttactgtgcctttgaccaggagttcctagaggacaggaacatggctttcacatatttagtcctccacagcagaatttaagttacttaacagttaattatggtggtgctcaaataagatttgttgaatgattaatcatgaacacgatatcaggtttcagtttctggttgggattctagcataatagtttaactaacaaagccctcagcttctgtaaggttatactctaaaggcaaagaactgctcttcggtaagtgtcagatgggccagccagtaaggagaggcaatgattctgggacgttgttattttgccaagggtggtccctaaacttttgttctgtttggaacaaactagctggaatacctttttattccctgatgggttttccctaacaggcagtgcaatgcagtggtttatattgttttgaaagcagattagactcgtgttcaaatcccagatcttgttagcagtgtcatcttgggcaagcgatctctgagcagatgcctttaccgtcatgggggcctgatgtaaagtgtatacctcccaggggagttatgaggattaaaaacaataatcctcccaaagtgcttggaaagtacttcatccaaagtgagcgctcttcatgccattgcagttgttgggatttttgaggagtgtgca

SEQ ID NO: 115179 - DNA, 2068 bp, Homo sapiens
agcttctcttacaactagatgtggctgtgttgctcggttctgactagtgatcttatgggggagggggtctgcttgaggttctgtggggaaagtttttgctttcctgtgaaaagggacagatgtggccttttcccttttctaccttccttttcccttttcctcttcttaaacagaaatgtgacatctggagctgatgtgcccttcttactaccttacaaaaaaggccagcttctttttaattaagtctcatttgtttaaaccagggattgacattttggttaaaccattggttggcaaattatgacccattggctgattgcctatttttgtaagtaaagtgttactgaaacacagccacgtattgactgtggctgccttcatgctatgacagagttgagtaattgtgacggagactatatggcctgcaggtcttaaatatttactctctggccctttaggtttggtgatgccgtttaaagcacctaacatgaattttctgttacttgtagccagacacattcctaatggaatcaaccaataaccaagatccttaaacaaattagtgacttggcatttcttcctactcaaattactcttttctggttaagtaggtgtgctccagataagcatattcctcattttggactttatctactcctctttatttccttcctgaactctctgattatcatattctttttaaaagtaagataagagtataaaagtatttcatttggccggtcacggtggctcgtgcctgtaatcccagcactttgggagactgaggcggtcggatcacctgaggtcaggagttcaagaccagcctgcccaacatggcaaaaccctgtctctactaaaaatacaaaaaattagccaggtatggtggcgggcacctgtattcccagctactcgcgaggctgaggcaggagaatcgcttgaacctgggaggcagaggttgccgtgagctgagattgcaccactgcactccagcctgggtgacaaaagtgaaactctgtctcaaaaaaaaaaaaaaaaaaaagtgtttcatttaagcgctgcctaaaactaatgtcagctctttgatattccaatcttttaactgcccaaggaattattttctaatgctcagataaaattgtcagggctttcactcggtgagtagggtctattcatggatcttaaaacctgaaccgatagaacagctctacagctccttgtattctgctcccaaccttcctgtcccctccaaacttgttgccctttgtggtctggtggaagcaggagaaaaccctgcaatagcccccactctgtgacattttggaatactttgtgcataccaaacaaaccactaacttgatttgggaagataaactgaaaatacatttctagttcagtaatagctataattggacagtctgtcttttgaacaataaaaataatcctagtttcgttttgtgtaaagatataacatcttatgtgtgactgcaaaaataagcaaaaactacttattaaaatatgtgtattttcattttgtttgctgacagtgtcaggtagtaattgtgctggttttgcagactctgtaatgtgttattgcagaaaaagcactagattgggttctatgagactgaattaaccatgagttgtttgtcaactgaattaacttctctgtgccacagttttgcatctcaaggaaaagagattgaactatgtggcatataaggtctctttcaattctaatatatttgtatttgtaaatattcttcagggtggctagaacctacttgaggattagtcaattcaaataatagcaacagcagcaacaactgcaacaaaacttcctttggaaaatcaacatactttagtcagaatggccctttaatttttaaggcccagatgcctcaaaggatttgtcatgtacagttatcatttgttgtcagaggactattctgggggatagaatgttatgggtgaatttgggttctgtgatggccatttgcaatgctttagcttgataatcaaatataatatatttcacaatacatttatcattttgttgaaataacgtaat

SEQ ID NO: 115180 - DNA, 1194 bp, Homo sapiens
gttttgtccatcttcaaatctttgaatattgggttaatggtactaagttaaaataattttctgcactaatttcttggagtgttagagctttcacttagtttgtggtatttttttggataaattatgacccatttattgaagatttttattatctctgctatatggatataaaactggaagacttctcaaaaaaatatgggaacatttttgctaaacaaaattttcctccagaacgttctctccctctcccttcctgcctctcttcttgtcttccttctttattcctgttttcctcaaactgctaaaagagttattcatttggattccttttgaaaagtctgtttcttaaggaacctcaatggtcctgactgtgttttgattaatttccagtgcattgttaaaagggcggttatttgagagagcatctcaaaagtaaatctacttcctgccaccttatcttttgcaatgcttatttggggttgtggcagtggagggggtgactcgagcatcctcagttagtcgtctagctagaacagttaccattttggacttgagaactattttaagtttgttgtaagaaacagtataatttttacaagacacatttatagtgttttaaaaaagttaactacccttcttacacgtgtgttttcttagaaattggaagggttgaatggaatgccagtgttttagcaatgtgtgaaaagttatttcaataaaatcctttttcttctttggtttaaaactttattctgcctgggaatcctccacatttgtgatttgggcattactatttttaggaggaaattttaactggatacattatgctatgtttgcttgatcagacaacatatttaaaggagatacaggatgttagtgtgtcaagggaccttagagacatctaatttaacaactttatttttccagttggagaaacagaggcatgggtaggttaagtgttttggctaaggtcataaaactgggctggcaggactgctattcagatttctcactctgcatctcccccccattaaatcactacttttaggtagctaacagtagattcactcttatttgttccccacccctaccaccaaacatgcttaatctttctcaatctccatttgactaattagttcacagctaagaaagcatattttctttgagcagattatgccaatagagaaaacagaa

SEQ ID NO: 115181 - DNA, 1018 bp, Homo sapiens
ctgctctggctggtgtctcccatttgcccttgttggaaagaaaaacacgtatgtgggtgactatggccagattttgccctttcatgttgttactctggagtaacgtgatctgctgccccaacgcggtgggaataaccttttgacaggcagtatgtccattctcagtggaaatgttttcccaagtctggccaggctgcctttgatcatacctccttccaatgtggggtcacagctactatgctatgcaagagtcacaggttcctgcaaggaaagtgagagacatgagggtttaaaataaataaataaatatgacccaaaccttcttaagttctcaatcattgaaatgaagtcagaagaatggaaatggccacaggaagtgttcaggacgtttcgtgttaaacatggtgtgcgtctttttgtgtaagtgggtcaagcaatgcatttcacacattttcgtgtaatgcggcttagtagtgagggtgcatctcatcctggacacgctgaggcatgtcggaaaatgtgttttcctattgtatgttggtgcaaatgacaaatggtgaagaggctgggagctgatgaaaatgctgagatggccacagaggacaatatgtagggaaaaaagctttgcggaggtgaaaagctccagcatttttcaaaggaagttctttcatctgtctgagaatgggcatttggggaaactcctgctaacccctttggtatgtcaggattgagaactgctgcctgttctagtacagggcagaatctttgcagaatttttactggaaagatatctcttatctactccagtggctgtagcaaagttatatcagttagtgaataaagtattctctattaaatgtgctggagctgaaggcttcttattaacctgcagcagcccctgcatctctgggtagtggtccttctatcaagcccccttccttccttctctccttttttccccccttccatctcttcctcctttccttcctttcttttttgctcttgccatacagtaatc

SEQ ID NO: 115182 - DNA, 1882 bp, Homo sapiens
cagtgaccccaaataaagtgattcctgggtggtaatatggatgctttatgattgacatacacataaatacatccaatcttgcttatgaaattttgtgatctgcttttgtcattagaggatatagtgaatctaattctgcatcggggatacgggatacagtgtattactgcattgaaggagatttgtctgtaggagcatgagcattctgtagcaataggcatagccgtcttctcggctggatgttagttactaggaagtattcattgtgtgggtcactatattttaacaactcaaaattttttaaaaaaaccatgctctttttgaatagaaagagagaaaatattaagtctttaaaagtcagaggtaaaaccgtggccaatctgaatgttacttctttctggttacttgaacagtgtctctctgaagtcttccttgggtcagacacaaataaatgggaggttgctcttggaaacactccctaggcactggtaaaagttgtcggtagatggcagtactgttctactacaacattttttaatccctgcaaatactgcctaacatttcattcccagtcttaattttgaaaatgcttgattagttacattaagcaatgtttgggtgattttttttcccccttttaaacttaacagaattatagccacagcctgaaagaaagccattactggtagacaacaaattcttagtcgtaatttagtccaacatagagaatgacataccgatttttaattatatttgtaaaatggctatataaatatataaaatggttaacaataatgattataatttctcacttaaactttgcatcagtgttttttcctctaattctaccgagggtaacatctgatcgttacggtgaatcatctgagatgtacatttctatgaacatgtttatttctttttacccctacaggtctacatgtatgccttgcaaatggaatacttttgaactctgctaagatatcttggcatatacaactaacttgtagatgaagaaagctaatatctctacagtttttatttggaaagtcagggaataacgctatccttagggaagggtggtttaccttcttatattagttttttgcaggtcccttaggaacatgcattacagaaaaataggctgctcttctgtttgtctttgtgattcagattataataattaactctctaggctaaatataactaacgatctgtgatcatcatttaaaatggaatctttcacagtaaatttgcaattggtatatttcctgaacttctcttattttaagatatttttagggaagatttcatataggatgggaggtgaaattggtagtgttttctccctttttaaaaaaaaaaaaaaagaaaagcattgtcttactaaaattccattggaaaagataaatatattttgttttacaaaatactttgggaggataaatcttccttttaaatcgaactgaattttaagaaaactgtggcttaactgtttatctcgttttcctatttctttacctaatttctatctagaattgtaaaatgattgattagagacttaatctggcttttgtttttaccttaaactatttaaaaaactaaaatgtaatgttaatgttttttgttctctattgtctttaaaggcattagcaggtagaatagaaagagataaaacatctgggtagtctaagtagatgggttctgtttcagttatcattttatgcttaacttgtacgggtctaaggtatatacattctcttaactactgtataaactagaaatttgcagcataagccacaacctgtgctagctgaagcacttagttacagcatgtaattcccaacagatttttctgttatatttttttactcaccctccatgg

SEQ ID NO: 115183 - DNA, 1050 bp, Homo sapiens
gcaaacaaaacagaggtgggggaggggagtggagataaataaatcacgttcatatgctaggtcaatttttaagccaattttgatctttatggtaaagtattttccacatctgccaaccacaagtgtctacatatggtaacaggtaactttctttagtactatataatctgtgagacataaataactaggcattgtaattgtatggcagttaccctacagttgaaagagttacatgattattagtaacccataaaataaggtggtagtgttttttttaaataatctgttataggaatttcttgtttccatacttttcttaaagactgtaaataatcttgttatgctctgacattcagcaagtcattgcaaagaaatatgtttattccttcaagataccactagattatccatttcaagaaatgaatattaaatatggaaggacacattttgtccttttcattttagttctagattttgccatatggttgcccatggcttttaaagaacagttagtatcaggaatgaactttttagccacaacatttctgtgatttttggaagtgtgatttttggaaattcttaaaaaccacattttgaaatattggtagttactgttgtcattctgtttcttttctttttccccctttctttctccgtctctcttttttgtgaccagtgcctcttctcacagataaaccagtatgatacagactttttgtgtttaaaaacaaaacctagacttacaaaaaaagttcccaaataacttgtatttaattagtatgtaatttatttaattagttccctgtctctttctttgcagtgattgtcttgatttctagttctagttttaaaacaaggaaagttttaggcctttcttgattcaactcatgttgtccatagcacacctcactgtccctaccaaagaaaggcattgaatttgagatttgatgcattttagtcttttttttcttccaccctgatcttctatatatggctgctttgcaaaacagttttgtgcaagcagacatgacttaactccattccctacat

SEQ ID NO: 115184 - DNA, 1071 bp, Homo sapiens
atatttccactccagcttggctcatttttactttccatcctctagtatttaaaatttgcttttagaatttattttgtttatgcttatttggcacaggaagagtatttcccaagacgcttaaatttctcttgccttttcattgttcaaaaatgttccaaacgaaaaactgtgtatgtgtgcgcacacactgtgcatgcacacatgtgcatgagggttttgtgtgtgtgtgtgtgtgtgtgtgtgtgtgtgtgtgtgtgtgtgtgcatgtttcttgccaaataacctaaaaattacttctctggcccccatgacttttttttggtcctgttgtaagcttgacagagattttatttatccttattaaatgtggcttgtttatatctagttatttgtgtgaagtttatgcttaagaagagtgggattcgttttggatatattatctcagagccaactggactcttattagcgcttgtttgaaaatggatgtgtgtgtacatgtacagatgtatgtatgaagtgtgtgtgtgtgtatacacaccccatcttcttgagtggtttctcaaattgtaggatttgaaagaaataaaggaaagaaaggaaaaagaaaaatcccttaagtaagaggacaaaggaatgctctcataactgggctggaattggagtttgtgtttcatttaaaatgacaaatcagcaaatccctcttcaactatgttacatcaaggtgaattttcccttcattctgggctttggacacaatttgcctggacatcttcccaggaaagcccctgtgtaaaacccctattaaagcaaagtcatcataaaatcatttcatttccataatgcttgtcttctgacctgtgtgaaatgtaccacaactcttgaggtacgtattttgagtcctaacatacaagaaagttgttagttgttcttaactagcaagaaaattaaaagtgaacacaaaattctcgtatatgcccaaactgtgatacagattgaagataaaaggtggagattctttccttccatatggtgaagcaatttggggaaagagaaattagactttcggcagaa

SEQ ID NO: 115185 - DNA, 1049 bp, Homo sapiens
gagggaatttaagaattcacctatgtaactattagtgggagaggagtttgaatcctgtttgactccagtgcctttattttcccattagattcacacaggacttgggttgaaatcacctttgtgtttctcagttcccacctgagtgcttgtgtacattaactgcacatatttgagaagtcaatttgtgatactgcctgttcctatggcttcagtctttttgctttattttttttaaaacattggcttttaaaagaccacaaaaagtagtatgtgctgttgataaaaattcaaacaataaaagtttgttataaagtaaaaaaatgaatattctctcccttcccttcccaccactcccactctcaaggggtggtgacaactatcatttttacactgatgatgtccaggttttcagtttcagtccctagatccctcttgagtttcacaatccagtatctgaatgttgagcccagatgctgatttatagttatttatatttttccgtataattttctggactcccatagttgagtcattgaaagtctgttggatagtggatgtgaaatcaattaatcagtcaactgattaatctctaattccgcctattgcacgtgtctgtcctgctggcctcgtatacttggattcttcaagattaaatccttctccttcttccctccatcagttccatttcctcatttcctgtgccttatctcagttgtgatgccatctgccttgtcatccttgtctcatcccccttcttcacattgccatgcagtcagatggtatctcctttcagttgcgtgcagggtcaccacaatgcgttcccactgccgcctttggagttcagcccacatatcctctggcttggacggttaccccggcctccttgtgattgccttcgctcctcctcactccactctgctgagtcttaactttctaaaacctaactttcattgtgtccctgcgttgtatggccacaagcacacaacatcctaatatgatgtaagctctggcatgtctgtttgtggatgatgccctgaatttttattctc

SEQ ID NO: 115186 - DNA, 1050 bp, Homo sapiens
aatcggccagagccagttgagaccatgtcccagagggagcccctatggtgtggagcaatgaccacaattaaaatgtgtttcagtttccaagctcttagcttgagatatgctaacctagactccttcttccgaataacaataatcttaagattataatttaattggaagaagctaggacaacaacaggtgcacatagatacttagcacaataattgctcataatttggcaggaggagcctgggttagtgtatctcaagctaagatcttggtgacttgtctctaaaactgtttgttagtaatgttttccttttttaaactctattttatttcattttataccagatcttcgtaatactccactacagcaaattctgatttgtgtgcttgctttcatatctctcgtgtctgattctgatgcaggtacccgaaggatttctacagtgtgtccttcaccccaccagccaccagggggcaggcacattcagtcaatactttgactattaccatctcaaggtgcatgttgtaactgctagagaagaaaacaaaaattaaaaagaaagacaaactttgagatcttattataacttgatgtcgttagctgacccaacaggcttttgctactgtccaagcattgttttctaggaaggctatagttggatgatctagtgtaaaggaaatgtcaccatggttgaagtcttgccaatagctcagagaatgtttaatgaattgagacgactcagtcaagcagtgagtagtaagaaaatctgtgtgactagtgacaaccaaagtggaaagaggggcccttgtgttcctagagtgtcccagatgccccccagaaacatggattagaataaaccccagaaatctctcacagacaccttaacatgcttctcccgacaggaaacatgttattttcagggatgctatgtttggtgcttttaaagtaatactatgatatccttttaaaaatgctcagcttctttaaaggagattgaggaataaggaaaacagatctcttaagtaaagaattcttagaatccttaacatgag

SEQ ID NO: 115187 - DNA, 1061 bp, Homo sapiens
gtatcattatatagtattaagcatcattaataattcagaagtttggagactttgttaaaatgactgtttatttattgtcagattactgatgggatgtgagtaatttcagaactcatttagtaccatatctaactagtaccaattgagtactttttatctgaaatgcgtgggatcagaagtgttttggcttttggatttttgcagatactttaaccgtttgagcatccccaattcaaaaatctgaaatcccaaaaccttcaatgaacactttctttgagtgtcatgttgacgctcacaaaattttggattttggagcatttcagatttcggagctttgtggatttcggagctttgtggatttcggattagggatcctcaacttgtattttgagaggatttcaaatcatgagaagggtccttattgcgaaggccagtctttcacatgttcacccagttttttgagtgcctggcacaatgctaggcattgaggatttgatggtgaaccagaaacttcctagtctagatggcagggagtgggaatggtgttggtaaactcctaaacgaacacttgcaatacagtatgttaggcaacacaatcttttaggtgttgtgaaaaggacataagtaggtttctgtgcaagcgtggatcaacgatacttgatgtaccttacagtgggacttttgatcctttttaattctgcaagtgtccccactctacctgcatgtatactcagacatgtgcttgtggaaaatattttttaatttgaagtaaattaaaattttgatgatttaatgacaccttttgagccaactgatgacttgaatattacaaagcaaaaaaaaaaaaattattggcgatgtgttttttttttttttatttttgagatggagtctcgctctgtcgcccaggctagagtgcagtggcgcgatctcggctcactgcaagctccgcctcccgggttcatgccattctcctgcctcagcctcccgagtagctgggactacaggtgcccgccaccacacccggctaattttttgtatttttagtagagatggggttt

SEQ ID NO: 115188 - DNA, 1031 bp, Homo sapiens
ctcacccttacatcttggacaaggtggcaacagtcactgcaaaattttgtgtgaaatctctagatcttaaatgtctgtgacaaatgttaagaaattgtgtgtcaagcaaaatactttagaggccaatgggccacatgtttttgatatcaagagattacacacaaaatttgttttctagcttcttttgaaaaatcagaattgggaagatgtattcatgagtgactgctgccccctttggttgggactcgttccttcaggttcattacatggtcatcaataaccatttccttggtccctgcttttgtcttgtctggactctaagcatttgaatttttagtattataagaaaacttaatactttactatcagtcaccacatacatgtgtttctatctgtactacgacttattaaaagccttttatcaatagcctccattttggagggggggatttcaactggtgcctagactagcaaggatttgtttataacacagtctgtgcttatgaggagaatacaaagggcggataatttcagcttgtcagcttgaatatgttatatttatacaaataacaggcttttgagttttcctagattacatctatttacagaaggctgtaatcaaggtttagcagcatattttcaggaattctttggtgcatattttctcaaaagatactaccaggacagtttcatgacactaataatagttttatagaaatgatttgtcatgttgtttttaatggcctgccacctccttttaaaatctttttgaatctgtctattcctaagcaggtaataatattctattattgttgatacttggagatgtaatcttcaaataattaaatgattcaaaaattgttgtagcaatgtttacaggaggatgtttttcatactgggacaggcaatcacatttttatgttggtaagattgtctacatctagggattggtattcagatcttgatttatattctctatattgaaaaggtatgagcaaagagattttttttcctttgtgcattttgcaatt

SEQ ID NO: 115189 - DNA, 1061 bp, Homo sapiens
tagattttctttttcgtaattcctgctaagattcagtggttactaattacaaatccataattactaatttcttgtgattattataaaacattcttaaagatttctttgagagattattttaaagaagtaggataaaggaatagaacattatcatgaagttaaatttataaagatgtcaggagggaagattgaagttaatgcaggcagccccaaacataattatacccagacagaagaatattcctctcccgctgaattgattctggttacataaagaaaatttacttgggatcattattagagtattttcttcattttagaaatagcacacattgaaaattaatattgatattaatattaaaattatacttttaattttaaaattttcaaatttaaaaatgctgaaaacaccagtagtgctattaatttttaataaatgctgatgattaaccttctgatgttttttttttttatggctacctttttctttgtttacgtaatgtgtggaattagggaaatcattaatggtgataatgatggggagggacagtgctggagagaggcagatagtgtccaccttggactcaatttccagagcctggtagaatggcctttctatcaaattgcatttctgatttgaaagcccattactttatatttataacaggaagttatggtattgctgccagtctagatgattctttagcttgacctttattgtgtttgattttgtgatttcacctttttttcccgttttagaaaaacttttgggtgtatacaggagagaattccttcccgtgttttagggagtggtattaaaatacattcattttgttcagtagttctgttccatacttcctacagataaagaccctttctgtgtgattgtgagacttttgaggttgagcgtggtttctctaatggtatttgacatgaaaaacttcataaaattcatgaagctacttaatacacaggtctgtgaattacattagtttgtcagttatttttacacactcatttactaatatgaatagtacaggtagtgggtgtttctcttttgt

SEQ ID NO: 115190 - DNA, 1034 bp, Homo sapiens
ccgtctctggctgggtgcctgggatggtggtgggcatgaggtgctgtgaagtgggatagagaatttgggaggaggaacatgtttgggggaggttagttttggacatgttgagtttgaggcatccatgggatgtccatgtggctttgtacaacacatagtttctgtgagagtctgaagcttgggggataggtcggggctacagagcaagagctttgagagtgtcttctgaaatgtagggagtgggcaagttgtcggagggatcgtgtagatgagaatagcttcatgttagtgaaaagaaaacccagaataagggcgcatagaggagtttgtagacccttatttgtgaagtttaccttaagggaaatattttaatttgacagagaaaaagaacaggaggaagaagggaaggcagttttgtttcaaaaaaaaaaaaagtgagtgaagatctttatagactttctaggacacacctaatatttctgggatattgttatgatttaagggattaaggctcagaaatctatcaatgacacttcccctgggtggatatacaatgaagaactgacaaaagggtgcagtgttgataactctttgaactattttaattaccctgtgaattggatacaatattatcagaaaggggcttaccatagaattatgatggacttcagaagtccacatcctaggccaggcacagtggctcgtgcccgtaatctcagcactttggaaggccgaggtgggtggatcacttgaggtcaggagttcaagaccagcttggccaacatggtgaaccctcggctctactataaatacaaaaattagctgggcatggtggcagatgtctgtaatcccagctacttgggaggctgaggcaggagaatcacgtgaactcaagaggcggaggttgcagtgagccaagatcgcgccagtgcactctagcctggacagcagagcaaaactccatctcaaaaaaaaaagaagtccccatcctgatttcacagagcaagagtgcttaggacccagggagcattttt

SEQ ID NO: 115191 - DNA, 1043 bp, Homo sapiens
tggggggagatacaatttagttcatagcaggttactagaagccctccatttttgatggtgtattaagaatctggtctttaccatcagctttcttccctttattgttcttaatttttttttaatcaaatatgccctcatgtttcagagacccacttccaaagctaggaatttttgtcttcgtgctgtaaaaaagctccatcatctttttctccttcacattcaccagctctccccattcatggaagttcctctgctgttgttaggtttttattatttcattttattttatttatttttttctgtgatttgaggttttcatttttataactgcccaacctgacaagcatttgtccataaattagtatgttatattgagtaaggatgttctatacacatcaaaaatacgttgctaatgtgatatttgtttctctcatagactcacctgttccatttttcagattttgaaggggaatttttagctgaatttaaaaaatatgaaaggactcttaatgttatctcacaatgtgcctttgtttctaaacgtgttcgggttttttttttttttttctcttcctttcctcccattctttgtgttttggagtttgaaaacagggctttgcagaggaaatgggacagtgacatttgttttttgttttgaagttgttgagtttagcagagtatgcgttcatagggtgtgaattgcaggatgtagttctggggtcctccctaccagccgaccccacatcaaggttattctgggaagccttatccaaagccgactataaaatatggggctgaacattgtcaaaaggctaaacaggaaacagacataaataactattcaatcttaattcagtcctagctactttctcacacatattttataatgtgttttaaaaaacaatttccttaaaaaaaaaaaacaaaactttaactccttaatttctaggttacttttaataggaaattattcatcttcatgactatccagtggcatcatccctttggcagagggcaaattacattcaataatatccaagata

SEQ ID NO: 115192 - DNA, 1057 bp, Homo sapiens
tgctcccactcctgccatgtgacaggcctgctccctgctagccttctgccatgattgtaagcttcctgagacctcaccagaaacagatgccagtgccatgcttcctgtacagcctgcagaactgtgagccaattaaacctcttttcttataaattacccaaactcagatatttctttatagcaatgcaaaaatggtctgacacaccctatgaccagtcattgaatatattctccacaggacccttgagatgcagtcccaggcacagccactctaactcggtttttctcctggcaggctgccaattgctgtgtgacagaaactgctatagccctgttggctggctttgatactgattaattacttacaagctctcctggctcctctgtcgtgccttaggaattctgtgtattcctcagacaactagggattgatttccttcttttctcctacagctgttaaagttttttttttttttttttttgctcttaaccacaaccacacttctcctttcttactctcagatatgacctcatgaactccttcacttagaaactagagatgggaattcttgcacttttactctccttcaagtgtttctgtatattgttacctatctctctccttccttattcccaaggttaattggttacctctactcttcccgttcccttctgaacttttttctctgttatcttcacttcctcttatatcttcttctgtctttccttcttcgttgactcaagtatcttctattctgaaaaataccttctctgctctatttccctgccattgcacatttgactcttccttctctttactgatggactttctaaaagagatgtacatagaaagttctacctccactttttttagccaactgcaactgggtcattagttggactctactacctcagctcaactaattttatatgcatccacttcttttcagcccgcatcctgtctgccaagttatgatactactgatcatttttcctttggcttccataatacgctatcctaatttttcttctaatttttgggttgctcttcttctgt

SEQ ID NO: 115193 - DNA, 1088 bp, Homo sapiens
ctttccttaatttaattctgcttgtggaaaaacatactcaacaaacaagagtgggaaaattaaatgaaaatacctagatgtttgtcaaaagcctacagacgtatctctttctttgcactaaagttcaaagcatgcttaagagttgtttggccaccttagaattttgcagtgtgtgttttatcataaaaagtgtgagccagtaattaaagctttacatcattgtttacttatcttcttccttcttacctgaattaggggaggggctttcaagtgaatcactttctaagcctctgtgcaaattagcagtgttgtgtttccttcagcttttccaagccatgcttaataattaggaagataggctgattcaatttaatatagcatctgattgaaagcatttgaagttagattactaaatatagtaaaactatatttagttaaataaagttagcctgtcactgttaggaggtggaccttgctttttataacttctttcagagagtgaattgtgtttcaggtagactaaaatggtgaccctagtgaccttcactgtgcctacttgtaagtctagatctctccagagctgggttgttctgggatcagaagatgtgggatttccagttagtttcacagccaacatggttctccctccaggctgcccccaggacctgtggactctgctccatcttcaatggccctttgtcaccagctcttggtgttttttttggtcccgtccctactacccatgtccctgtacttctccctctctccaccatcatgtctctcatcaagaccaccaaaatcacagaccttcgtctcttagcgaccttcatttctactcctcagaacttactgaaccttgttcttcccacttcagagactgcacaatcaggtattttcttctccaactttaactaaacttgcttctcatcatcatgctgattttgaaaatctgatctctttcctgttctccaattctgtcagcctcacccaaacctgctgcttttatttccctgcttagccagaagccctgtgatatggtttgggtgtttgtccccccaagtctcatgttgaagtgtggttcctcgtgt

SEQ ID NO: 115194 - DNA, 1047 bp, Homo sapiens
caggcgtgatagaaaaacattcagatcacaacgggactggagtgaggatttgaaagcacagcacggagctgtgaaagactggaaaccaatttagagttgctagtgtccaaagcagaaaggagagcacagttgctctaatgcaaaaagcaaccttcactaatatgatttgcaaatgataagttcctattaaactttaggtaaacaattttgtgataacatttatcccctgcccctctcccctgttgattttttctggatgaggaaagcaaggctgtgccagccacgtaactcgtgtaaggacacacaacagtgcttatgtctccatcttcaggtcaaaccactttatgaagggcctactacatgccaggcaccaggctaggtgctagggaattgaaaggacccttttcataaaaccatcatgagggtctttgtgatttagagctcttctactaaaagaaactatgcatttactcctgtcaacttctttatgatttatgtattaagattagtcataaaagaaaatacagactacagactgttgctctggttggtcctcaaattcatttagtggtgacagagcccctagaagttttagcattcttcctgtgacacctcaaaatgttaaaaaataagcttcgaatagctaatgtataattttgtaataagtcagactccttatataatagaggcttgtgtagacaagctatatagcaagtacccaaggttacaaaatgtgagtgcatcatgaaattgacaacaatcttcttaactattcctccgtgttagttgacaaaggatcttcattatctgattttgggtagtagaatgactctgttcagggcacagagaatcagtgatccacggaaacagagtttgaagatccttattttaatctgcaaaagattgtcttaattttgaaagaaaatttatgcagaatagagtccagtttttctggctctatttcatcacccccaagctcctatcttgcaatgctcccatgtcttaagaaacttgttagtgatcttcaaagattgccaaaatttgtgg

SEQ ID NO: 115195 - DNA, 1070 bp, Homo sapiens
gctcatactgttgaagcctattcagagaagcatggagtttactcattatccaggctatattccaagttctgagattgggatacttgggggattggtggtgtcaattaatgatcgagtataggaatgtaagtgctgatatgactttggacacatttgtcacttgtcctaatctgcttctgtaaaacaagagggctggactgtagcgtggaagatgtctgtgattctgtgttcagaagaatgccccttgagtcattgtcagagagtttcatcctgtttagagcactctgccctcttgagataggaaaaatatgcattatataaagaattttttcaaatcagggttgaaaccagtaggacttttatttctttgttaagtggtaaatcagcctaactagaaccctgtggtctcttgggatttatttctacttggagcattgtggtctttgagttgggttaatatgaatggagcttctaggacttgttcaactcttgaattagttcctgaggtaccaaaagtgacagaccagactctgaacagcatagacatatcaaaagaaaacgatttggaattatggaattcattttaatgaatctgtaatgtcaaatagagtggtgacttagtacctatgtaattgttatgataatggttgaaggaatcacactttcatcccatctaccctggttcttccttttctgctagtacagagaagctggtttgcatttaagctcagagtggctctgagtaggagtaggacaaggaaagaaagaagagtgcagagtgcaggatgtgcattccagagtggcaccattaaagatgcgcatgctgtatacctcacgctaggatggccaagggaacattaacgtgctttaataaatgtgctttcctctgagactatgggcttagacaatggtttgcatcactcttgaattctaacacattcagggtttatttgggggaaattatttcaggttgacgaatgaattctagcatttcctgcattcctgtttgtctgtattcacagaatcagttgtaccactaaaagtagtggaaattctaagtgttttgggta

SEQ ID NO: 115196 - DNA, 1023 bp, Homo sapiens
aattaaagtgcctgttcattccactgaatttcattatctggtttcctgtctaaacctttaatacgaaagaaagacaaatggaaattttttgtggggaaaaaataagtgaatttagaaattaaataaaacttttaaaagtttggaacatgaaaattatttattttaatgagatcatatgaggagtacaagaaggggctctcagctctgcttggcaaaaggatcagtatactttgccattattttacttaatagagataggagacaataattattagctacaagaagaagaaataacaaaactagcaacctctagacataaaatatgaagtagaaatatagttattaacaggaatgaaaataggtaactggagtttgatccattttttagggaagaggcagtttttcagtaataggttctttgagagtctcaaaatcacttccataaaggcagacagttttgtggatcacaaaggcacgttctgattcaggccctgctgtttaattgaatgacctggggtaaaatattttataatctgggccttctcttctgaaaaacattgagtttgaatgaaattctcactattctgctcccaattctgcttcttaagagtccagtcttggctataaagcatcattgaaaccagaggtttacatggtggcttggatcttggggatgaaaatgttgttgagagacaggaatatatattttaatctaggattgtgtgtgggagggtgatgttttatatacagaaaggttaggaaaatagacttcttaaatgagagaggttgagataccagatccttccgagaaatggcccttaacttacatgtgagtatttatttcaaatgttcatatttttccattgatttaatgatttttagaaaaggtcttatattgaaaacatacattatcccagataaacttagtctattaactaaataattggatgattaatttaacttagcacattatcctctggaacacattaatgtgaaacttcaatttgatgagaaccaaggtta

SEQ ID NO: 115197 - DNA, 1022 bp, Homo sapiens
aagtggtcagaatatggatgtattttggagactgaatcaatagaattttctcatggagtggatgtgcggaagaatgaagagaggagtcaaggattcatatgggggttttttagggaggagaaaggatatgattttcatcaagtgaaatggaggatgtattgagcagctttcagagggaagacctaaaatcctcaggaggcttgtgcagtaatctaggcaaaagatgattaggtccctaatggtacagggaatgaaaaggtggagacagagtcaagaaactttgtagatattcagcaatcaggtattctgtgatatactgaaggagttggtagaggtaaaaatggagaggttggagtttaacatgacaacaatttggtggtcagaagaaatgagtggatggtaatgcttttaactgagacaggggacacatagaaggagtaatttggggagcaaagaagatgatcttgcaactagatgtgtgagttggaggtgccatgttggaaatacatttttgcagcctaaaagcagtattagaaatgggggttgtatggatggggttgctctctgcttggttcactgctctatccctgttgctcagaatattgcctcactcaaagtaagcattcaatgatcatttctcagatggatggatgcaattttggaagtcatccaaatggagagggttgctgttttacccttttggcctcattggttcattagatggcttgctccagtttcctgtttcctttcttcgtggaaccatagggttatagacaataatgggctgggaagcatacatacatgcatcttccttattattttacactctgtgattaaaatgctccctttccccttcacccttatctttttaaattatgtgattcccttttgtttttctctctgcactgtaggggtagaaaaatctttaaacaaaagttgcttcattgtgtcttacttttatctaatctttttttatttgttaacagtgacagtggttaactgggagattcgaactgccattt

SEQ ID NO: 115198 - DNA, 1034 bp, Homo sapiens
ggaacaaaattatgtttcaaactgtaaggttggacatgctggctcctgcttgtaatctcagaactttgggaagccaaggcaggaggatcgctttaaggccaggagtttgagaccagcctggggaacataacaaaacctagtcttcaaaaaaaaaaaaaaaaaaaaaaaaaaagccaggagtggtggcacacacctataggcctagctattcaggaagctgagacagaaggatctcttgagcccaggagtttgaggctgcaccaagttatgattacaccactgcattccagccggagcaacagagaaaggccctgtgtcttaaaaaaaccaatttaaataaataaataaataaataaataaataaataaataaatgttaagcacagccaatagattaatattacataggcagaggagaatctgcttgaccctggtgatgatttggtctttgctttgtagaacataaacttatttaaacagtgacttaatgtattatataaggtgaatctgaatgagaggttttatgcttattgtatactgtggaggaccagtctgcatcctctctattcttttgggtttagctaatgttctggcacgtagtaagtacttcctggctctctgttgactaagttagcatattagagttctccagagagaataaaaaggatatatatatggtcagtagattccatatccatgaattcaactaaccaccattgaaaatatttgaaaacaaatttgcattcgtacccaacatgtatagatatttttccttgtcattccctaaacagtatttcccaaacaatgtaactatttacatagcatttgtattgtatcagatactctaagttatctagagatgatttaaagtatgtaggaggatgtgcataggttatatgcaaatacgataccattttatatctagatttgagaatctgtggattttgatacctgaaggaggtcctggaaccaattccccttggatactgagggacaactgtacaactgtttagatctataagaggggatttatta

SEQ ID NO: 115199 - DNA, 1009 bp, Homo sapiens
cctgggctcctttttctcagtgactggcaccacagcccgttcagctgccaagccaggaactagactcaatctacagcactcccctgcctcacgatcctagcagtcctcaagtttgatctcttctaccctagttgcctcacctctctgtcattacctggattccaatgccagcattccttgcttagaaagacctaacggcctcctttgaactctagagcctttcatcagccaaagtgcatctattgcactatcttagaattgcctggtcatttttctgtaactcacatctcactgtaagcacagtgaggacgtgacgatgttagtctctctgttcccctcccccagcatctggtggctcttcaccatcatcatggtcatgatcaccactgacatttaccgagcacttattaagtgttgagcagtgtctgtgctaaggcttttatagatgaactcattgaactcggtataatcttttgaagaaggtactgtaatattactatcctcattttactgagaggagaccaggacatggcatggttagatgtcttttccatctggtagagataggattttgaggcagaatttgatacattcttagccaccacacactgccgttatccagacagtaggtattcaatatgaatttattgaatttaatctggaataatttctcaacttttttttgtcttttagtccttgacatttttgaagaggccaggccagttattttgcagaatttctttcagtttagatttgtctaattgtttcttcgtgattaggttaagattaaacattttggacaggaatattccataggtgacactgtatccttctcagtgcatctcagcaggagcacagggtgccagtttatcccatcattggtgttgcttttttaagttcataattaacctaaatttcagaggctggtaatttctggctttaccccaaattcatggactgtaccctatttagagcctactatatctcttatttttcactacacaatcta

SEQ ID NO: 115200 - DNA, 1865 bp, Homo sapiens
acgtggtttcaccatgttagctaggatggtctcaatctcctgacctcgtgatccgcccgcctcggcctcccaaagtgctgggattacaggcatgagccaccatgcccggcctgcagaaattattgaacgcgttttactagcagagaaagcattcatccttcaaaacaatagcagtaaaaatggcattcaatttcatcttgagatgaagagtcatttgctagtgggtagaaatcatccttttatctagttacaagatttgcttgtacctacttatattcaatttctgtgacttctttttcttttttgcggggggagggaggcagggagagctacctttgtgattacagtaaaaaggcaaaacaattgtatgttactattggtattactactgataatattagtaacaatattattaataagattatatattattaaaattgcttattttcatttagctctttaggtctggacaaatcctaccctaattcaattgggttattacaatatacagtgctacatgtaaggacactgtatttcctatggatgctgtaacaaattatcacaaactttgtggcttaaaacaacatagattctcttgtaattctggaggtcagaagcctgaagtgggtttcactggcctaaaatcaaggtgttggcagagctgtgttctttctggacgttctgggtaggaatccattttttgcccctttgtgcttctagcagctatctgtattcctcagctcatggccccttctggcaatggcatacttctagcttttgcttccattatcacatctcctctatgactctgacactcatgtctccctctttataaggacgcttgtgatgaagttgggcctacatgaataatccagaagaatctccccatctcatgatccttaatcatatctgcaaagttccttttgccatgtaagataacatattcacagtttcctgggattaggaaatgaacgtgttgggttgtgatggtaattgactctatgggagacattattctgcctaccataagcaccttagtacgatcttaggccttagtacaatctgtcctcttctagagaaaaaagaaaaccagtgtagcctagtcctaatgctgggtgtagaatgttgtcatcatatataaaaccaaggttaaaaatttgtcagatagatcggaagtcttgcactctgcaaatactggttctagcaacaaattaaagagcagatttaatatatgaccatttggagaagagtggtattaactgtacctgtttattatgccccttggagattccaacataagcatttattgtcaactgtgtgggatgctgagatgtctgcagtcattataaaggaatgcaaaactctaaaacaaagtgagacacaccttaattacataaattctgcataatcacacattttaatgatttgagtggaaatgaattaaggtgttggcttggctgtttttataaagaccaaaataatagtagcttaagcagaataagtttctcatataaaaatccaagctggccaggcatgatggtgtgtgccagtagtctcagctactcaggaggctgagcccaggagttcaagtccagcctgggcaacatagcaagaatctgtctctctttgggaggccgaggtgggcggatcacgaggtcaggagatcgagaccatcctggctaacatggtgaaaccccatctctacaaaaatacaaaaaaaaaaaaaaaattagccaggcgtggtggcgggtgcctgtagtcccagctactcgggaggctgaggcaggagaatagcgtgaaccggggaggcagagcttgcagtaagccgagattgcacccctgcactccagtctgggtgacagagt

SEQ ID NO: 115201 - DNA, 1602 bp, Homo sapiens
ttgggcgctggctcgcagcccagtagaaacacaatttctgcacgaatgccatggtagacctgaagctgtggcagcaagaggccggcagttagttgtgcttctccagaaagggagctctgactggcatatttccatggctgctgcagtaagccagcacaataaggtatttccatctagaacttgggaatattggaactgctgatatcagaaattgtatgtattcctctttgaatacctagcactgagcctgggcctgagacctaacaggtgttcagtctctgtccctgcttatttaatgaagaaaggctggtcatggattcattccaaggcagataaaaatcggccctaaaaggagagagtgtgatgatcttaattgtgtcccacacaaaactcatgtgttgaagccctgactccgaatgtgatgatgtttggggatggggcctttgggagataattaggtttagatgaggtcatgagggtggggccctcctgatgggattagcactcttataagaagagacaccgaagggcttgctttctctctctctctgtctgccatgtgaggacataagaaggtggacatctttaagccaggaagagatccctcaacagaaactgaccatgccggcaccctgatctgggacttccaggctctagacctgtgagaaaataaatttctgttgtttaagccacccagtctaaggtattttgttttggcagattaacacagggaggagaaaaaaaaaattcttgtaaattgcagataacataaaccagaaaaaaaaaaacaaaaacaaactcttattagctcctgttgcaaagaaatgctgagttatgagtaaaacaaaaagtagaagaggaaacctaaaaagattatgggttagcttttgggatgagaaatagtgttagattgttgagctgagttgttttttttggtgcttttaatgttactgccaaatagcagtgagttaaaatacttagaagttaaggagcaaaaagccttatattttacatattaggaatccatatctgaagtgagcaagaccaaattggaacatatataggacagaaagcttcctaggttaagtgtgtgatatacaggtaaatgtatgcctccattaaaaggtttaataaagatcattactcagagacaacaaagggtatccagtgcatgccgtccacctttcccactgaggtttggagtagacagacctttctccagaccctgaaaagcagtgatgcttatttaaagggccttaactcaggaagatgtggcaggaaacttaaggtataggtagaaaaacttagacattatcagtggtggagatatgaaggcttccaaagcccagaacaaattgagacagagggaagcagataaaaaacaaacaaacaaacaaaacaatctttaaaaccaagcatctggtccaaggagataactccacttcctatgagtacagcacaggagatagtgttattctaatgtaatgtagggatgtatcacaaagaagtaatttagtttctgaaacaaaaggagtcctgttatatggatctgttttggatcttaagcaacattcatttggttctgttcaggaggaaggaggg

SEQ ID NO: 115202 - DNA, 1065 bp, Homo sapiens
gaggtcaggagtttgagaccagcctggccaatgtggtgaaaccctgtctctaccaaaaatacaagaattagctgggcgtggtggcgggcgcctgtaatcccagctacttgggaggctgaggcaggagaatcgcttgaacccaggaagtggaggttgcagtgagccgagatcgtaccactgcactccagcttgggtgacaagagcgaaactcggtctcaaaaacaaaaaaaagttatagtaatattctgggttttaacttgaatggtgagcgcacagtgtttttttatgttattctttaaactacatatttactttatatactttttgtatgtaaatatttcacaatacaacaacaacaaaaatgaatattttaagatgtttgaggttttttttttttttccaccagcctgtgtcagttgacccaaatgccttgagctcatttcttaacttgggattttggagatgtatctatgtagatgagcatgaaggacttttctaatcagattaagtgataaaatgtcttgacattttccctttagaggcctagggtggggatttggagactctagatggaaatatagtgatacttacttttaaagaccaaattattttctaagtaaggacttaaaaatatttacatgaagtaatcttgtttactcatctgcttcgtacagaagaacatatgtatgtgtgtacaaaatgcttaaggaatttgtttaaaatgaatgatgtaaaaattctgaataaaagataggagtgcagcttgtaagttccttgagggcagggagtctatcttgtgtttgtctttatagcctttacaataccttgcacaacgtctggtacttggcaaatgctccatagctgtatgcccaattatattaagttatagtgagaataattttctgttttgcctttatttgaatgtaagaaaaagcagattttctttatttcttctatcaccttttgctttagctgtctcagatgagtatttgtccccggttagatgaacaggttacttgaaagctaaacatgttttttagttattttaagtgaagttaattcctg

SEQ ID NO: 115203 - DNA, 2277 bp, Homo sapiens
aacaaacgttgctctgtactggttaggattaggttaggctgtgagagacacacaacaatttttaaacaagttagagggctgggtgtgatggctcatgcctataatcccagcattttgggaggccgagggaggtggattacttgagctcaggagttcgagaccagcctgggaaacatggcaaaaccctgtctctacaaagaaattaaaatatttgctgggcatggtggcatgctcctgtaatcccagctacttgggaggctcaggtgggaggatcacttgagcccaggatattgaggatacagtaattccagattgcaccactgtactccagcctgggcaaccaagtgagaccctgtctcagaaaacaaaaagttacaggttgatttctatttcatgtacaaagtctggaagaggagggaatggcaactctgctgtcatttgcatctttgggttctcttatctgtatggtctacttcatgtgtccactgttctcattgtgccgtcacaacccaagattgtcactggagctacattaagtctccgttacagcctggaaaagaagtaggaaaggcagaagagcaaaaaagggctcttctcagagtcagttccctttaagcacctttcagttacatctcattttggagaacttagtcacaggacaacacttaaccccaagaaaggctggtaaatcttttattccaggtggcataaaataagagttatctttcagttggggaagataacttttccagcttactcagagagttgttcagtcattcactattatgttacaaaggtacaacttggggtaatttccaaaggtagatgggaagaatgatcttggacaaggcaatgagcgttcttagtcttgggctctgaggatgccagggcatggcccctggtttgttttcagtagtgtatttcattcaaaataaacccaataatgttacagtcatgatagtaataacttaataatagatgtgatcatgatccccagtatgaaattatcagccatttgttttgaacaatagcaccgttgatatttgaaagtttagattgagtttaagtacttcactcaacagagtgtcctaagagtttgattttccattgctgtaatttttatttttaatgtccacgcatatagcctttggctttccaatcttttatttaccaaattccttcaatcatacagaattcagtttcttgtggatattgtctaaaggggcaagagcctttggcagaatgggtctgatgcgacttcttggtcttcctcaaggactgcatctctggaagccttttggctaccacagaaagccagggatcctatgtctttgcctccttgccacaatggataaaaccgtgattgctgagatttatgacattataaactttagggagaagctttaacttgtcaacaataaaccataataacagtgttcgactgtataaagttagggttattttgactacatgctaatttaatgtgctaaaaatatttctccagctaaagaaaggaaaagaaaccagtagtcatgtttggtatgcatggttttgtgagtgggcatgtgttttaggaatctgaatttgatttgggagttagaagttgtgaattctaagttgagtactgccattgatattctgagaccaaggatctcagtcttctgtcaaaatttagcccattcataactttcagcatttaactatgagcatttcccttttatagagatttttttctatccattataaggattatagacttttatgatctaataagaattgaactgaaaaagaatgcttaaaaagctacttatagcagccaaatatttattattaaaatgggatattagagcaagatttgaaagaagtaaaattaaaccattacaataagttacactccttaaatgatgctcttgtattagaggacaaagtatctgccttacagtcccaagataaagccacatgccccagactttattatccctgtctttgagctagcctagaaaacagacggaagaaattcagccacttcctcataaaacagatgttggaatacagcagattttctttaaagagggaaacaagagcaaggggaatgaagacagttctttggtacaaacatttcttattctcttattcttattttaatcttatagagaatgtctgaatgcatccagatctcatttgctgtttgtagaattgggatttacacggtaagcaatgtatatttttgtggtaccacatgttgtgaaaaataagtgaagaccctagtgttggaaa

SEQ ID NO: 115204 - DNA, 1190 bp, Homo sapiens
atactgcttgcaggactctgaagaactggcttggctgttttaactttttaattttcatcaagcagaattatagaggagaagataatataactgtcatcttgctttgtatcaggatgagggattgcacaggacatcaaaattagaactgtcaattatgttaagtataaaaaatagctctctaaaagaatattgtgtttattagccctctgatggaactcaaattataccttgataccattttttggactgtatagtaaataacgtttattttctgccatcttgttgaagttttgttttctcctttattttcatgcttacctttgaaatttcttagggaaaacaacaataaactgtaagtaatcacattaatttcaaatttagtattctttttctgtcttaggcattctttttctatagacctctcttaaacagattgtaaccaatctgtcttgtttttgacatcttttttgctgttttattagatgaggcagcaaagaagatgagattcatctttgaaataatattctttagttcttcctcagggaagtctagatgtagatttatgaatattactgtagaggctaccgggtcagagtttatctgagatagaaactcattcttttattggaaatagttaactacttatccttcattccaagttatgccttatgtctcatgggtttacagttaaaatagtttcttgcaaatatagcatctatatagggaaataatataattatttaaaatttattaccagttcatatactgtgatcaaaggaagtttggttatgtttttaaatatatgtatccgactcctagtaattagagggaagaggccattgttgagaatattattgttagaatgaatttacaagctggggcaatagacatgccacctggcctgaggtcggatgttcaaggataaggcagtatttgtaaggattagagattagagagaatgaggtaatatggttagtcagaaaaaaagttacacaaaataaattgagggttttcagggtaataattttagcaatcccaacaacaatacttgtacattttgagaatatgaaaaggagtggaaagtaggtttttagtaactaaagagtaaatatttctccctccttaaaagataaagctcataaaaagagttaattctctcatgataggtgctagagccctttcatatggca

SEQ ID NO: 115205 - DNA, 1035 bp, Homo sapiens
acttattgaagttcagggtggatgagttttctaaagtaacttattgaatggttcaaacccaggtttgtctaacctcaaagcttacctttcttttccctccacagttagaaaaacaagaagaaaagttgagattgtctaattaataggcaaatagaaatttttttgaacctttaagtggttgttagaccacgttctcctgtagtcagccttttcctggcagtacaataatttttgtaagttaatatagaagtactgattcagtaaaaggggttggccatttgaatattttgaggactttaaatatagatttgacagtgtaggtatcatgcccaaagaagtggcttaaaaagataaattcaaggaaagaacccctaaacaatgatttctaaggttttagtagaaggacagtgctgaaaagttgtgttcatttaattatattaaaaacgaatgggacgtagggaatggaagatgaattcatactctggataattgaataaatataattttccttatgattctaattaattttgcttccaagtgcctaatggacaatgcatggcaaagtagatgcctatcattataatagcattaaaaatattaaatattattgaatattaaaatattgagtgatgctggacacggtggctcatgcctgtaatcccagcactttgagaggccaaggagggcggatcatgagatcaggagatcgagaccatcctggccaacatggtgaaaccccgtctctactaaaaataggaaaattagctggacgtggtggcactcacctgtaatcccaagctactcaggaggctgaggcaggagaatcgcttgaacccaggaggtgggcagaggttgcagcgagccgagatcgtgccactgccctccagcctcatgacagagtgagactctacctcaaaaaaaaaaaaaaaaaggttgagtgatagttgatataatcttatataatgtagactaaaacttcttcagtttaaacatgtcgcattgccaatctggacaatattgtgaggcctggctaaa

SEQ ID NO: 115206 - DNA, 2652 bp, Homo sapiens
cagaactttattggcaaaaccaggcagtggactggattttcccacagattggaatttgccagccgctgggttagtagaataggatttacctacctcctcaaagaagagaggcagtattgcatgatacttttcgttggcattggagttttggcttttggacttggggagaacctttaaagaagagcaagacagtttgggaggccgaggcaggcggatcacatgaggtcaggagttcaagaccagcctggccaacatggtgaaactaaaatacaaaaattagctgggtgtgggtggcacgtgcctgtagtcccagctgcttgggaggctgaggcagaattgcttgaacccaggaggcggaggttgcagtgagctgagatcgtgccactgcattccagcctggcgacagagtgagacttcgtctcaaaacaataaaaaaaaaaaggatgatatgatgagtggctttagttgtttgaagggcataaagtcttctatgaatctgagcaggtcatgatcataggaaggccaggtattggttcaggtaaagaagaattctcttaagatttgttcatcttccttgagtaggaaatgacagaacagaagctgggtccctgcctgttagggacatcacagaaaggggttcatgcactgagtgagaggttggaatagatgcaaagttcctttcaactttttccttgcttctaggttgatcctaatgtatcagccaatctctcttcactttactatgagttatttaagaaaacattgtggtataggggaggaactaacatgtttcttttcatttaggcagtggagttttttccaactaattttatgcagaactattaaacaagtgatattttactatatttgactttttacaagcctatatttatgatatttacttacacgtttattattattatatattaatcagtgaggacaatgaagctgttctgatgaacacaaaaactgcctttagacatggttgagaactgaaggcttatcaaatagtttatttggttctgcattttgttctctttttggtgtagcattgaggaaaaacaggattccaacagaatcatagttgcaaatgttacagattggaaagtagctcactgtgcaatgttgagctgatcttcagtgagaaggcagaacataggttttatcatgaaacttgatctttccccccaccccaagttactctggcagcatgagttatgtgtgggtggtgtgtgttaaaattttatatacagtacatttgaacatgttgtttctcatttcagtctctaattaaaattcaatttctacttaaaagtatttcttgaatatccaactgtctctttgcaacaccgtgtgaggttgcagagttggaaaaggactggcttagaattagacctgggcagtagtctaccttctgccacttgctagcctcgggctagtatccttttgtttttttaatatgagaaacaggcctggaaatacccacgttgctctaattgtgagcgctgagtgagacgacagtataaaaatacctagcgcatagtagaaccttagtaaatgcctttttttccttctcttgtgacttgtaagataaggccatccttttaaattgaattgtgcgtggttctactcaatttctataggtatagttactagacattattcactatcttaatgaaacgcttgaataggaactctgccctcagaaatgcaaactgttcatctgaaaggagtgggcttacgagggtctatagctcacctggttcatgggttgtgattctgccttctggtttgagagtgaagggaggactttggagagatccgcttgctgataacaggtggagggcaggagtttcagtggcttgcttatccacacgacatgtcagaaacataggcaatgactatactgcctttagttgttagatttttatatcaacctccacatatctgttccctttagtccttagcactaaaacccattcataaagaagggccagtgtgcacatctttggagaagcaagaacatcaacagcaagggagggaggggagggctcctgccacttggcagccaggctttagggatggggtaaggagaaaatctacaagacttaggaaaaagtggtatcccttgaaaaagaaaagggaaatagggtgagtccctggggacaaaagtaggtagatactaccacctgagttgggcacagggatccctgggacttacagaaaaccccaagtagttccctgagcatatagattggggctatttgtcttcagcaagtatgagacagtggtatagctgctcataggaatctcagaggttggggtatcagatgctgaagagtggctcaaagaaattggctgtgaacccaagccccaggggagcccagttaagattccgtagggtctggcagttgtggctgggagttgggtttctgttaagattactcttaaactattaaatagttttaagcaggaggtgatagcaccagatttacatgttgaaaacttgctctggctgttgaatggaagatggattatacagggatcagatgggaactagtggggcctgttcaggagactcatccacattccagtagtagatgtgggcggcttggctttggattcactaggtgtgagaaaatatcttccctt

SEQ ID NO: 115207 - DNA, 1677 bp, Homo sapiens
tgatagtattaaatacctacctcgcagaattgagttaatgtgtgtataaagcatttaaaagagagcctaattctgtaagtactacaaaagtgtatataaaacaaggacttatggtactgttgtcaccaaaaagattttgctccatttcgattcattttccccctaccagccttccaaaaatctccctgcctctgcctaatacgcatagtgtagggtaactgggttaaagacacttcaactgcttgctggtgttttaagtggcagctatttctgattcacagggtgaaaggtcctggcagggaagagggtggcccacatctctcctcaggccagttatgcttacagctgttacctaagttcggccacacgagccgactcagtagatgagttttctgaggtgctactctggaattctgtgattgtttggagccttcagttcctatttcattggagtcaaacaatttgaaagtcaagtttctgcttttgagaagcagagcatgtgatttattggccagctcttttatcccttcttcctgtatgaatgtttcctgagaggcagggtatggtagaggaaggagcattgggacgatttattgggtaatgttgccgttcttggtcatttcgaatgtttcctgaatgaggctggttctcttttcaagtcactgggctaaagtagaaaacctctttggattattggatttctctctttgtttcattttgtatagaaatgtatattttatattgttcaccagtaatgtttttttcagtgtaacatactttttcctataattttttgggatttctatgtgtgttttaaaggttgggtcatttagatgtgatcacgcgattgctcctaggtttcctttgcatttcctgactctttcagggtccctactgacctggccttgggctgtgggtagcatcactttttgagcctggagtgcagcccctatttattatttctgtggatgtaggctgcaatttttgtgcatcctgagattcctgtgctagtgatgttttagtttcattatgtcattatttggggagaatacctaactatactggggatctttgttaatacccataggtgactattttccatttcatgtcttctgagttcttcctgttttatcataaataattatgtgtacttaatattcacgtgaaatagtttcataaaatggactcagtaaaaatttcgattccatgttgagaaagatcttgcattgctaattctaaaattcttcacatcagattctttgtaagagaacacaagtataatgaaacaagttgcttaaaaagttgaaaagctgtgcaagatgtgatgcatattttaatactttctacaaaggttgtcttgaataaaccatcgtaaaagtgagtgattattaaaccatgaaggagatgaagaatcaagagttatagtaagctcattgatgattcagtcttttcctcatctgtcttaaagcagttcttttctatttccccaaatccagagtgcttaagagttcatctgagggaaagattatttatcccaattgctttatataactgcagtgagtgatattaagacaataagcagtagcaacagtaacaaatacatatgcttctaacactatgagtagtattttcctgtgcattcaaaattaacaaggacttttgttttattaaatgata

SEQ ID NO: 115208 - DNA, 1984 bp, Homo sapiens
gagcagtgctagaaatgaagctgcagagcccagctagggtcatggaaactctgaaagtttgcctgcaatgacatggtcagatctgtctgcagtgcagagaaggattggaaagggagggaagactggagcaagactagttaggaagatgtcctgatccagaaatgagatgatggtgttcacaaccaggaaggggcaggagggatgcataaatgtagatggatttaacaacatttaagaattgccagaattttgtaattggatgtggaagatgacaacagaatagatctcagggataattcttaggtttttggtttgagcattgttttggttatctgagtaatgaaccaccttaaaacaatagtttaacacaataacaatgtattttactcgtgaatcggggtttgactgggttcaactaggcagttattgttcaggatccctcatgaagttgtaatcagatggagggtggggtcacctcaaggcttcatacacatgcctggcatctgagctgggtacattgcaacagctgggtgctggacaagggtggccccctggggcatctctcttcatgtggtctttctatgtgatggcctcaagatagctggacttctcatattgaggccgaaggcttacagagcaaacgtaccaagagaaactggcagaaactgcctggtcttttctacccaatcctcaacagtgattcagtgtcacttttactgtgttcttttcatcaaggcagtaaaaaaggcattgctaggttcaagggcagaagggagatatctcttggtgggaggaaggttgaagaatttttgggcatgttttaaaaccactgtaggtattgaggtgggtaatggggtcatgcactatgatctgtaaccctgaagaaatagcaggtttggtgggaaagggagaagtttgactttagagtgactgagtttgaactgcttgtgcagtaattcaacttgagatttcacataggtaaatggaaactcagaggtgaggtttggagatgtagttaaaactaatacctagggccaggtgcggtggctcacgcctataatcccagcactttgagaggccgaggtgtatgtatcccgagatcaggagatccagaccatctggccaacatgatgaaaccccatctctactaaaatacaaaaaattagccaggcgtagtggtgcacacctatagtcccagctacttgggaagctgaggcaggagaatcacttgaacccaggaggtggagattgcagtgagccgagattgcgccactgcattccagcctggcgacagagcgagactccatctcaaaaaaaaaaaaaaaaaaaaaaaagctaatagctaacatttattgttacatactgtatactatactatattattaatattttgcaggaggcacagtgctcagtattttttatatgctatacatttactattatcgttttagagattagaaaactgaagcttagagaaattaaatgttgtgcctaagacatggtggagccagaatttgaacctaggtctggctaatgtttgagctcacatttgcaaccacttagatggtagctgaagccatagccatgcatgagggttcagttgtgtgggaaaggaaaatacttgaggatgcctacggcctcagccactgctggcgtgtagtatacatgcagcttttatgggatcaccaaaagtaaaggaaccaaagaggaacttggcagccagtcatggtggcttgtgcctgtaatctcagcacttttggaggccaaggcgggaggatcacttggggccaggtgtttgagactagactgggcaacatagtgagacccctgtctctacaaaaaaataagatagccaagcatggtggcatgcaccggtggccccaattacctgggaggctgaggcaggaggatcacctgagcctgggatgttgagtctgcaatgagccgtgattgtgccactgcactccagcctgggtgacagaac

SEQ ID NO: 115209 - DNA, 1939 bp, Homo sapiens
taagcagcctgttgcttatggacttcagctgggcaaaatctcctgatggtattaactttataaaaggatttatttctaaggtagactaaagagaaggaaagcttgttagggaaggtctcataactattgtaggtgacaagaagtgggaatttcctctgatacttcccacaaattaaattattgaggggcttttgttttggatcctgcagccccctgtgttatgttgtggctctcccctgtcatctccccaaatgtcccaatgtcccaggtgtttggatgagtctaagaagcccagttctggttgaccctcattttccgagtgtctgtaaagtaccaagtcacatctacttttagcagggctggcttcccagccatgcaaccgctgggttcagaagagccccatgcctggtttactgctctttggtccccatcctggaaaaaaaaaaaaaaaaaaaaaaaaaaaaatcttaattttagaacaggtgctttgcgttttcattttgcactgggccgcacaatttataaggccagttcagatttctagcgctaaatacatggctggcatctgagtctgtaacctgcatcattgctggttccctgaccgtcttaatcaccattttatcactggaatctagtctagtgtctggtaaatacaggactgtgtaccatttacagtgctgagtgttttccttggatcacctaatttaatcctcccaacagtgctgttaaccacaaagacatagcaacttagaaaagaggaaacttgagactctgaaaggttgagtgttgcccagaattgcataaccagtggagggtcagggtcaggatcagtgtatgagcttgtctgattctaagcccatggccatgagcattcttcggtgctgcttaactattataattaataattgttgagaggatgagtgagagagactgtgtgaaccatagataacaattctggaaattgaggggtcacttgattgtttctgtcacctggttgcctgtgagaggccctctgggaactcagtgacagtgcagctcccactgggaaagttgtgtgggtttgtgtttgaggcgggagtctgctcactgattttgctttcattgattacccactctctccttcagtgtgcataaaggtaggtgttctgccctttggctcatagagccaagcactcctacatgattttgatagtagctcaccatctgaaaagttgcatttgcaagccaatctcatttatcaagttcctctgtacctagatttgctgggaactgttttaacctctggactgctgctttcagagttgaggacttatcccactaattatgtccatgtctctccaagagggattcccttgggttcttttttcaacaggagagctgctgctctggcctctctctctctttctcttggggaagggaatgacaatctggaggcactccaggaccactgattgaggcattggaggtctatacccgttcctaatcagtatagacatggagtcaggagctaaacagaaatataattctttcagagttttatttctaattatgaattattttaagcattcagaaaagtacagaaaataatataacagacttctgtgtacctgccttcctgattgaacattttgccattttgacttcaaaattctggtgatctttaaatgaaactaaagactcctgttccctgcacgcttcctcctccacccttctcagtggtgaccactatcccgaggttagtgagtaacagtctcatgcatgtttttggctttttatcatatatgcatgtgggtgtaaaccatatatagtatcattgtgtgtgctttaagaattttaccaaaattgtaacataatgctctatctttctaaatttgcttttttccctaaaaaaaaatgttgagtgaataagacattagtctgccctcaaggtacttatgct

SEQ ID NO: 115210 - DNA, 1048 bp, Homo sapiens
tattgtgactaactttaaagtgataatgtaggtcactttttagtctaaatgtcgagtggattaggcagtcatattaaatattcctttcttaataatttataagataaaaattatctgagcacaataaacagatctaccatatatggagttcatatagcaaaaatgttttgagcaaatccgtaccattaggtaggaacttttctacaaaggtgttaagtctggttcccaaacttctgtggctccagtctaacagtatgagccctaggagaggacacatagggaccttgattcatgccctccaggggcttgcattctgaaagatgccaaagccacatgcttgttggcatgtgggcagtgctcaggtcgggggtgagaggagataagtatatgagttataatcaggagggcaaaatcagttaacatttattgaacacttactctgtgccagtgttctaagtgctttgcatgtgtaatagcattaaactgaggctcagggaggttgtgtaatttcctcaagttcacacagctagcaagtagttgaactgcgcttgtggccccagggccctccctcttcattgccttccacctacaagtagttcccttgtgctaggcagaggctcaggcagcttggtgttaaggcagttgggatgcactcaaaatttttagtatattgcttcttaagtaaacaggtacagaaaagtggtccttgaccactactatgttaaagaaagcagtggccatgagcaggcaggctgatgcgcccttgtccccaaggactctggcaggtgattgttacagagaaggctggctaggaagagaactatgttgtgtgctgggaactcctgccttacagtctccataccctggtcatagccactgaggtgatcttcagcatctagtgttccaccaggtgaccacatatagattttcaggcaacctccttactcagccccctagtgtcacttttgggggcacattcctacctgccccaagccccagttttgttttgtttcgtttttcttccctcccttcccctcctttcccctcc

SEQ ID NO: 115211 - DNA, 1077 bp, Homo sapiens
caagacaggcggatcacttgaggtcaggagtttgagaccagcctggctgacatggagaaaccccatctccacttaaaatagaaaaattagctgggtgtcgtggcgcatgcctgtaatctcagctacttgggaggctgaggcaggagaatcgcttgaacccaggaggcagaggttgcagtgagatcgcacaactgcactccagcctgggcgacagagtgagactccgtctcaagacaaaaaaaaaaaaaaaaagttaacgtattgtgattatgttgctgatgttacttttatacctcctgtagaatgactgttactgcttagtggtattgaaataccttttaaactagtctcaatttatggaaatactgggagttgtaatcaacaagcaggaagtcacaagactcttttaagaatcttttaaaagctacgaaaataaaacccatttgaataatttatctattcaacaaatatttatggagcccttactttctgcatggccctgaaagtcatgcgggatgaaccctcagctgtaatatcctccttgactgcaggactggcagtcgtgtggctctagaggaacctgtggcaggacaggttaagtaaggcacataggggagggggtagcttctgatgtgcttctttgctttctagtacatttctctcattttgtgtgttttattgtgaactaaaatataaacttagacttgaaaatgtgacaagtaaaaatggttgattagtcttggatgctaattgtcaattaatattcattgcatttgtttatagtagcctccaccctcccatccacggttttacttttcaaggtttcagttaaccatggtccaccgaggtctcaaaataagtgagtaaagtacaataagatattttaagagagagagagaccacattcatataacttttattactgtatattgttatcattgttcacttttattattagttattattaatcacttactatgcctaatttacacattaaactttatcataggtgtgtgtgtataggaaaaaatatagtgtgctctgtgctatgttagttagttctatgatagctcagta

SEQ ID NO: 115212 - DNA, 1034 bp, Homo sapiens
tttccatgcactgacaagaatgatggtgtgtgtcatttctttttaatcagtatttgactttcttgtgttgttcctgttggaaactggaagagagagctgtgtgtgtgtatgtatctattgttcattgttctttgggctggatgtcgtcacttaacctttttatttggaggagagtggaaaggaagaagggagagaaaggtggaggtgctattttgtcttaacaggattaatccttttaataagattgagatattaaaacagatgaagaagctctactgatcttcgggtcgctgttgatttcttaaaacaaatgttctcagaagtgacagtcaaggtgagggacagggatagtactttaatatttaagacagggttttattgatttcagtcgagagaaagaatagaaatttgctaatcctaatcaattagatgtatcacctggtgcggtgcctgacttggtttctggcatgtattaatagttagggcccgatattttatttgttgaatcagatgaatatgaaatggaaaggaaaattctgctttttttcaccagtttttaaactgagacaagataaaatctgtttggattaggtgttttgttcaggggaatgcagaatgtatcctttactcttaacttgaagatgatcaagatataatccttttagccagggtggcaatttaaacataaaaatctctgttttccagttgatgagtgaatcttcctagaagggcacacaacttttcccctttccatgatggggtttaaaggccatgtttacatctgccaagtctctgggtaaacatttagctgctgtcccaacaggcagtaccagcatcttactctttcttctcataggtagaactagtaacacaatgtgcagagctttttggataaggtaggagaaaatagtcaggttaaaatgaaagagaaaaacacatttctcgagttttcctgggaggttggacaagatcaacttctagattcctttcagttcaaaattttctgtcttgactcatgtgatgattgatctgga

SEQ ID NO: 115213 - DNA, 3015 bp, Homo sapiens
tcctactgggggttggcggggacaccaaggctctccagcccgggaacacggagttcggctccgttgtacccaactggaaagctgtggaaacacaaaactcgggcggcgacagcaccagccgattttccgctctcttggctctttcttccgcttgcaccgcccccaccccggctcctccgctcagcacacaggaacccacatcccccaccactcccgcgtttctctcctgccaccagctggggcctgccttttataggcgccgcagccaatgagcacgcttctttccttctgcccgcccgcctggccaatcgccgcgccccttgtgtaatctccggctagtcggctgctttcggctattttcgctgttgctggctttttcaggagctgctcgctcgcagccagagacgctgctttttttttccgggttcggagccgttccggatgctttaggctgccggatgtctgatctccgaataactgaggcgtttctgtacatggattatctggtaggtgcagggcaggggtggcatgtcgcctctcggatctcggcgtgcccgatggccccctgccttgaggagcagcctttttgctttctttctttgggataggatgcctctggggttctttctcccgcagccggctggtaagcctttccctggactcggaggggcagcctccagggcgggtgggtggtggagctgacaggtaaaggtgcggcctgggccagcacggctgcagggcgagggtcgcgctggggctgcttgagagatggggcggccgcggcggcgcgtcccctgcccgcgatcggcttcctggcttccctctgcgctctccgcagaggactttctttccgggggagcaggagttttcctctctccctggagcagaactccaggtgctattaaagagccataaccagaatggctcactaagtgcccagcagccctggtcatttgattgttattaaatctctaaagctatgacctcggtcgtggcggggttttaaaagcacattaccataaagcagacgggtctaaactacctcgcaggctggcacgaacaggactgagtagggacaggtatagccccaccattccggtcttgggtgcgtgccgcggttccactgtgcacggattggaacccggctgtttaggccaggcttgtgctgagaagtttaggtgggaaaagtgtcagcacagtgctgggaccgaacatcattttaaaaatggacttctatgtgtctttgtggaattatgcgagcaccatgttttgttccagaaattatatttccccagagttgcttgtttgcgtttaaggggatcctcatttacagagacttgtgttcgatcctatacgattattgtgtttaccatgttgggcagaaccgctattgccatgcagagttgaagtagacggttagaaacattgaccctcctgtcatcttgttggacacatgcactcggttttcgactgcagattggcctggcagagatttgccagtgccttctaggaattacacttaaggctgtactgagaaagtctgtgcatgctttgatggccaagaaacgccggaccggctttgtgctgttatctgtgtatttgggcttattttagtgtacataaagaaaatgtttctcctaatgcttcagagcttgatggtcttgtgggaaaggatggtgactgcagttaatgcatagccttgtgaatggagctggatctaaaattctgaattcaagttctgttttgttgttcatttgttgatggcagtaacttcctttatctttgtgataaagggatattattcacccagtactgtagctggttacggggattatctgattatgaacattcttcacaatacaaggtgccctgtaagttaagagagctgccagaagattattttctaagttaaataactgatttaatttgtaatttatcttataaaatacaatacatggtttttgtcttgcagtctgcctaaattaaagcgaaagtttgttgggataattaccaagtaggaaagggtgacattgcctgtactactaaaagctaattttgaatacttaaatagttcttaaaaaagaaaatcaggtggttctgacattttattattttctttatttaccggatgtgttttaaatttataaattgcatcacaaagctgtctttgaggtgccaaacctatcaaaatgcttagtgaaaacaaaattgataactctggttaattactcaggctaacctctagataggcatagtctaaaggtgagtggatgaatgtttgtgggcccaaggttaccttaaaagcagattaatttatttgccaatttactaacagctttgtgtcaaaatcaacaggtcacaaatttgacttggcctttttgttttacctgggctcaagtttaccctaaaagcagattaatttctttgccaatttactaacagctttgtgtcaaaatcagcaggcctcaaatttgacttggctttttaaaaagctttacttgccatacatcttagttttacttttatatttaaaaaaaatcattattttgccactttatccatctaaaattcacaagtgcagtgaccaaccccataaaagccagtggctactctttggaggtgagaaaagaaatcttaaaggaaacagtttagtttttgtgagtgtgccaagtgtcccctgtgaaaagatttcagaaaattctttagcattaaactggatggaaacaaacagaaaaaccatctcaaaacaaaaaactagccctcccgaggtagcctttttgtgttcaccttttgcttgtcgactttcagagaaaatgatgtgccacacattatttttctcttcctgtctttcggattgacttgcttgcttatgcatactctgtgtggcgtttattaaaagccctatttctgaggaatagaaatcaatttatttgcatctggtatcttattttatttttaaaaaattcctgagttcttttacttaccttgcagggaaaaaaaatgctcctttcattc

SEQ ID NO: 115214 - DNA, 1018 bp, Homo sapiens
ttctctaagattagaagctatcgtacctttgcatgtttgactccaaaacccaaaatcctaagaggaaaaaatcccaacccactacctatcaataacgaaatgtgttaacatggcctacctgataggtgctgttcggtggaaattctaaggtggaccctttatacaaatcaggctctatcaagtttggtaaataaacaaaccatgttatgcacctctgataaaatcaagtttctaaacctgcaaaataaagtgtgatggaaagaaatattaccctgccccctggtgactctgccagaacacatcctcccttggagactcagcctctaacatgtgatccatcttacttgtacagcacacaaacaaaccagagaatgaaatttcagaaaaatctctttgaaacctcttctccattcacagaaacagtcctgaacctactcctctcgagctccatctgtgttcccagggagccagcctgctgagatgcctctgtcctccaggataacccttatcactgcaaggaggcttctcaaggctctgttagcattttttacttctaacccacagattgcacatcagcaatacaaatgtgcccatagtgagcctacaaatggtgtaaggctctgaagagcacagagtgacactttattggtaataaaatcccaagctaactggagagaaagcatgaaagcttctcaatctgctagagaagggggaaaaacaaatcaaataaggtaaatttttcctgtaccccactccactcacatttttttaaagcttgatttttgcaaagagaaaggctcttaaattctacaattaaaaatcatgaaagagacaaagggaaagagtgagacaaagaaacagagacacagagagacaaagagagaagagatgtccaacagagatgtagttggagaagtcagtgggtctgtaactccgagttctatgacttccttggacccaaatcagaggatgtccatcaaatgcattactgatgcaggatttttctcgaccgctttgt

SEQ ID NO: 115215 - DNA, 1020 bp, Homo sapiens
tattacaggatctctttgtaaagaagttacaaatcatggttgcttttttgataaatgtttctagtaatgagtggtagtatcttcaatttattcaaggagagttttgttgaatgattttctttgacattcattgaatatccactccctgccagatgatactgagagataaactaatgccacacggtcttgaaagaagtcagtaattttttttttaaatggtgttatcaataagtaataaggcccattccaaggccttacacatactagaaggcttctgatacacactaggccttattgtcatcacttccttctcattctttccacatagcttctttcgtggcaattttcccccaggagggatttccctgcagtggacctcctccccagtggtaccttcagccatcagaacacctcgctttagatctgtgggtcccaaatttcatcaaatccaatgaccatttctatggtaggtactttgctatatacacctttgactacctggaaatgaaataattataactactttctttgtatgtatctattagatttccattggtgtattacattaattttttaaaattttgtgcaaggagattttctttataaatttcagtatgtatagtagaataaaacctcactagattaagatacaatgaagttatggcactttaatatgtttgtagactcaccttgaatgctgcagctacaaatgcagattgaaaattgtgtttttctctaattgtaaccagcttggtaaaattcaaacaaaacaatgtatgatagtccctcaatttatatggcagttgcattcctggaaatttcagtgagtattaaagtcatacacaaattctttccttctttttctttctttctttcctttttttctttcgctctttcttttctttctctctctttcttcctcccttccttctcttctgccttcccttcttccttctttcctttccttttcttcttttcctcctccctccctccttcccttcctccatttctccttccttc

SEQ ID NO: 115216 - DNA, 1049 bp, Homo sapiens
gattcaggatgaattctgtgaaggaacaacacctaaacccaagaaggcagctgttgcagcatccagtttagcttcagaacgtcaacaattagtcatgcaaataaatgttctagttttaaaaaatagaaataatcctggctaacatggtgaaaccccgtctctactaaaaaatacaaaaaattagccaggcgtggtggtgggtgcctgtagtcccagctactcaggaggctgaggcaggagaatggcgtgaacctgggaggcagagcttgcagtgagccaagattgtgccactgccctccagcctgggtgaaagagtgagactccgtctcaaaaaataataataataataactaaataaacaaataaaaataataaaaataaaaaaataaataaaaaacaagatgcaaagtggagttaatagaaaacagttctaggagattactgttaagactcagactatgcactgatgttcagtccttagtaattggtggcaacctggtggagagggaagaccacaggctgtggagttggacctgggtttgaagattggctttgcatgcctagcaggatgtaagcttggcccactgacttcacttctgagccttgttctccatgtctgtcaagtgcaggggaagggttagtgaaatctatcttatatttttatggacactaatgagattgggaatgaaaacgagatgcccataagcatcagtgcatcataggtacttggccagtggttctcaaagtgtggttctcagaccagctgtatcaagattgcctgggaatttataaaggaatggagattctccaggcccagcaatcagcatactaaagcttgagaactgtgttagactttctgggatctaacgaagaaggcaggacagattttgttagatgtattacacaaggggcaggcacctgtgcacaaaaagaccccacaaaaacacagaaaaaaaacacagaagaggtgctttttgttttgctctctgtgtgataagctaatctgataagtgagaagtcctgttctttctataactgggtaggtaagt

SEQ ID NO: 115217 - DNA, 1033 bp, Homo sapiens
acgttgtctcaatgagtaaagagatttatttgtgatgatgactgggatgttagggatttcggctaattattgttagttttattggagaaagactttgttaattggtgaatggctatgtgagccttttctttctgtctgattctctcccctctgctgtggtgtttgcaattgaggaacagctactaagaggtggcagctgcagagaaaagtccagagccatacagatgaggctgggaactctgactagcactgagtatttgaaagagagcttggcgaaagtctgttactacatgtagcagatacctgtgactgcatatagggagtgaaggagacagccaaaagtgcacttgaggataacaaatggccagcccctacatgatcactcatgaaaatccaacagaacccagaagtctcacttagctttaaaaaatccattatttttttcagacagaagcacttagggaagcaaaatggcttatttcagcatgagaaagcaatgtaacagtacagctaagctttgagggtctcctgatcaaaaatttgtgagactaatagcttacacaggaaagagatgatagcccttttgaatgccttctgagcgctcttacgagatgcgcaatctaattgtggtgtaaataccagctattgatggtgggttttgttcatcgggtttgtgctaccacagtaccagaggtctgtatctattagtgctagtaatgtatggatgaccagggctggtgcagacatctctgcagcaataataaaaggtaagaagatgcagacaaagctgaatttattgtgtttgagaagatatagaattcaatttccctgataaccaagcttaattgcacagaattatgagagctcattaatgaaacccaatatagacagtttatattagtaatggcattacattgattatctaatttcagagtaaggaattaaagggggccaaattagggattattctgcttttacgtaacacctgtagtcaggaaaaataaatagctcccgttattaaactaaagctttt

SEQ ID NO: 115218 - DNA, 1060 bp, Homo sapiens
gttggatttcagaaatatcaacacacttggcagacattctgagaaaacaatattgttgccccaaagaagtgtttactcataataatgatttgaggtaaattacattttcacctacacaaattatctatgatccatttcttattccttctagcatttttttctcaaattcaaaaaaggaggattggagaaaaaaaataagttttgaatttgttcactgtacctcacagctcacttctggccatatcacagtcttaagcattttcatctgcttttttgtgagtcccctttacttaactcatcacaactggttttaattacttggttaatggaccatattgcatcctagactataaggtaataaatatattttgttcaagacaaaaaaatgaaatgacattcaaatgtatctaaaatggaagtaactagttctagatggcatttgctccagtaggttttgcttttcctgattcactgtttgcacctccacgtccccacccaccccatgtaagagtaggggactatgcctagaagtaccgtgatagtgcagttggcacacacgtttcatgggaacttctggaaataaaatgggtggcaggggtggaatatgagtttaaaatacacactcagaactgattatttcaaaccacctcttaccatctgaaaattggttttgtgtgtgtattttaaacatacattcccccttattttatttctagaagttttcacgaaatgcctgtgccaaccgcctggcattttcctccattttcatggcacttccaggcatagtcctttaatctttttttttttttttttttttagatggagtcttgctctgtcacccaggctggagtgcagtggcatgaccttggctcactgcaaccttcacctcccgggttcaagccattctccaacctcagcctcctgagtagctgggattacaggtgcccaccaccacaccccgctaatttttgtattttaagtagagacgagattttgccatgttagccagactggtctcaaactcctgacctcaagtgacccacccgccttggcctcccaa

SEQ ID NO: 115219 - DNA, 1070 bp, Homo sapiens
atgcttcagtaactggggagcttctcttgtgcctggatactacttttctttattaaaaactgatatgacccagataaagggaattttattctgagtgtttatctctaaacttcttttttattatttgtctcttgcaataatctgagcacttttaagagatgaatgttttatcctagtattcagtgctttttccagacctgacacatagtaggtattcaattaatgtatgctgccaaaatatatttcagtgttagaggccaccaaacagatatcttttcattctctcccctctgccgcctacataaggagccaatgaagcacgttttaaaaaagatagcacatttgtaattgcttcaaagttaaacctatatacttttttggttaattttattagctgtagttgctcttgttttccatactataagaagattatctcaattagtgttaattgtctccttccacgtggtccttcctccatctgacttaggggaattttcttggtgtttttccatctcattcagacataatggtgtggatggtgggtggtttggggttacatattggagctatgtaaggggtacaattccgatgacggttctgtggccctaatcccctgctccccacccccactttttttgaagagggtgtcaaatatggattaattacttatctttgtgaccagaaaaaaaaaaaaaagcctaagttaactgaaggaaaaaaaatggaaatttactaataagtgtcccatggaacttgtggattaaatagcagtcagatatcgtcacatctctctccctccctctctctcccccactctctcctgctcgctctctctctctttctctctttcctcagtgtatgcttcattcttctctttatatagattgttttcctcttctccattcccatgcatgcccaagtatggccactgagttagctgggtcctctgtgaggcagacattgagatggagctgggagcacatgaggtttgttgagatgtaatccctgtgaaagagaagaggaagaggaaggtaactggacagggaaagtcttcacaccatgatgcatac

SEQ ID NO: 115220 - DNA, 1055 bp, Homo sapiens
ggctgtatgatctaggatctgttatagagtgaccaaccatctgcttagccctacactaaaacccctcagtcctgggccaactaggctggttgatcactctacttaacaagttacctggggaaataatatattgacactaacgtagagaggatgagtgactggaatcagtagcatcctactatgttgctgttgctttttagtgaataatcattggaagagaatgcaaatgcaaaaaaaaaaacaaataggggttataaccgattattagcaagattctgatgaactgagggaccacagaaactaagtatgtgagtaaaacagactttgaagatgagtgtgagagactgagttggtcattagagccatcggctgtaaagtttgtgtgcagcctgaaccactgtgtgctgcactcaggagaaaataggatgccttctgcactgaggagtttggcttggataaaaaccattgtactgacaatgtagtctactccagagtaactgacaaaacagggggagacattgaggacataacaacatggctcttccttctcctgagaagcattgtcaaagctgagtagttgcaccagtttgagttacagcattggggaattcccccagaagctgagtgggagctctacccggggctcagtctgtggctgtcacttgtcttcttgcacagagcttacttatgagggaagtaaggggctataatccttggaaaacacaggcttcactacccttttcattcgaccattaaaaggaccattcctctttggatgtggagaaataggaacacttttacactgttggtgggactgtaaaccagttcaaccattgtggaagacactgtggcaattcctcaaggatctagaactagaaataccatttgaccaagcgatcccattactgggtatatacccaaaggattataaatcatgctgctacaaagacacatgcacatgtatgtttattgcagcactattcacaatagcaaagacttggaaccaacccaaatgtccatcaatgatagactgcattaagaaaatgtggcaccta

SEQ ID NO: 115221 - DNA, 1041 bp, Homo sapiens
aagaaatctcagataattcacttcggagtagaaacctccttcagccgcgctcactacggcgcccggcttcgcggcaccggccactagagggcagtggccgccgcaaagccgacgcgggcggtgggctcggcggctcggccatcgcttgctctcgcctggcaaggggctctcggccgtggattagcgcagctggagacgtgggaggccgcgggccccgcccccgaccggcggcggctgcggcggcccagcgcggcagtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcg

SEQ ID NO: 115222 - DNA, 1033 bp, Homo sapiens
tctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttagagtttgaatagttgagtaatgagctgctcaaatctgtaatcttgagacgagggtagaattagaaggggacctaaaccatgttaggtatctgtttgaacactgcactgtcacttagtggtgagtttcaaaaagtgaggaaataatggagaagaacggatgtctgtaaatagaaatctgctttcacccttccaca

SEQ ID NO: 115223 - DNA, 1044 bp, Homo sapiens
gttaaattgatttgtcgatttgggctgtgtgaagcagggaggcaggactagataagtaaataggcagtcctgttttctgtactcttaaatatacagactctacttcatcgctctctaaatgttccagatggagccttttttcaataaaagccccaggacctcaggaatggtataccagtagtgggcctgtcagtcttgctgggtagaatttcaccattgtgcttccttttaccactagtagagttggcctgatgtccttcagacattaattaaagatagctggagtcccagcagggcacacaaggtaaggctgggccacacggagacccttccctgtctgctccccattctcctgtagctaaaaatagccctgaaagggtggtgccaggaatacagagaaaagctctaagaagttggggctgtttgcaaattcatccttatttttgaaacctctgggctagaaattgaggctgttcattctttttgttttcactccatctttagttgaacccatttctcctctcccctgcatttacccccagctgttctctaaaaagacctcatgtctctaaaaagagaacaggtctggggcttaccctttgccccagtttgtgttttcttagtgaaaataaggtgaccgttggtgctttcgaaatacacgactcagttccttggttaaaatataaatgtgactgcccaaggacagtcttgggcacgaaactgggtgtgggcaccgctcataccacaccgtcaggggtttctcagacttcttttttgagccacatagccttcagagtcatgccgaccacagtgggaccgaagggaggcagaggacctgcactcccaccctcctcccagtaactcagggagcctatgaggtttccttgttcagcaatgttgtcctgtctggccatcttaggacttctaagcataatgccagaacccaaacaagtgagaagttctgtgattcacttacaaacacttcccttgaactatttaatatgttccttctctttgggctgaataaaaaactattattgtatt

SEQ ID NO: 115224 - DNA, 1059 bp, Homo sapiens
tttaaatatcaagttagatttaatttgccatatatttttgaagctctgtatcattaactaaaggattataaagtggcagagtaatgctgagctctgtttgacaagattatatccggaaggcagacgtgtatcatgtctcatatttatacaacacagactagaatctggccgctctgccggtgtctgcaggagggctgggtaggcctctggtcttaagtgagttatttgactagctacagagacaggtcagccagcctcggcagttccttgtgccaggattctgagagcctggtggatgggccagtctgccccaggagttgcaccaaggggtgggactgagctgggtctgctgaggaagctgtgccagtgaaggggcagcatgccaagccaagaagccgtgggtgcagagcctcatcgcagtgggagctggcctgtcgggaccagcatgggctctggagggccagtgtgtgggcatggaggagttttggacaagctattttaacctgcgtaacgctcacttatctttggccaagtgggggcacttcctcacgaggtcagcatgagaattaaatgttatagttcatagtagctagtcactaaatgtttatttttgaaaaatagatgggtgaatttaaaaggagatgacaaccaggcatggtggcacatggctttaataccagctacttgagaggctgagggaggagaatcacttgagcccaagagttcaaatccagccagagcaacacagtgagaccttgtctctttaaaaaaaaaaaaaaaattaagggcgctctcctttgaaggacaattccagtaatcttatcatccctcctggcaacctattgccaccagaattgtaggcaaaagtacaaaagctcaaggagtcttcagtctagcaattaaatatctgctttaatcagttcgccctgtattgcacaccggaagtaatggcaactgggataaatgtagatgttgtttggagtcaatcgtttgttgttgttcacattgaagagtgtatgtaaactgtctcctcctggctcccctctaacccaaatcacg

SEQ ID NO: 115225 - DNA, 1710 bp, Homo sapiens
gctatattttggaggtagaatcaacaggttttcctgagagatgggattgtgaaggatgtgacatgcaagagaaaggggagtcatcaagggtgactgtaattttggcctgtttggcctggcctacaataagaattgtcagaacaggggtggggagcagcaatcaggaattgagttttctccttttaggtagatcaggctcatgcattctgctccatgtctccccaccccaacacaagcactttctagcttcaggtctagtccccttccttggagtatcccccttggattgtagtccttttgtgaataattgtctgtgcggtgctcagttattagtgtgtgggttatgtttttatgttcctgtgttgtatagctgttaactactgttttatacatgcatagcaagtacttaatgaatgcttgctgaattaatgaagtaggcactcagtagctacttggttgatcttgaaatagatttataagatgtttttgtttttccatttatatgatgatggataacagtctaaagtgtacaggaaataaagatagaatctagatgtattttatggatgaagtcattaacatgtgagtgatttaaaagtcttagagttttgtgtttatgaaatgactttacataattcattggggaggggaggggaagtttgaaaatgcttaaagtgccagagaattaatattgtatacctcatgatttcactttatattgattcttggtgtttaaacttacgcatgcatacacgcacatacacacacacacacacacacacacacattttcctcattagtaagttttagttataacatgtttactggggtctcgtttgcttaattcagagcacaagatccagagaatacattcaccttgttgcttgacttggatacacacggagcactgagctcatgtgtagagcagtaggtacttgccctcatggaaggcccactcagttccttgagagaggtagaatgtgtgcacagaggactgaaataaaaggtagatttaacttagtactgcgaataagacagtgcatgggagtccaggtgatagagaggaattgtcagtttgtgttagaggcttgagtgggcagcatttgaattccccctttgaaacatggtcacagtgtgacttttggaggagtgtaggtggaaagcgcactcctgatcttgaaatgctttaggataggtttgataagcatacagtaattgataagcaaggtacccggtgctcaggtcagtgaagggaactgaagtgaggagctgtcactgtaccgtatgacacacagtcgtggacatgcaccatgatgtgaagtaggacagaaggaggagtaattatgggcagtggataggaaggttcagaggtggcttctgccagtctcagtctaagaagagttttgaaaacaagtggaagtttgccaagccggcagagtcggggaagggcagtctgggccgaaccatatgggatccgtcttggctgcctctcagaaccagccgctgaggggatacagcagaaaatggggccccaccctggatgtgaatcggaatgtctgtgctgcctagacattggtgttctttgaaaagctcctcacatgcttttgatgtgctgctgggtttacagctgctgttggaggtgatagcggaaacacggaagatcaaatggggtgccgacatggccaggcctgcacttaagatggacaggtc

SEQ ID NO: 115226 - DNA, 1009 bp, Homo sapiens
caagacatttttaactaaatgctgatagatgttagtgtggataatctgtaaattttcacgttttatgatttgtatttcacatatattttaaaacttgatacaattttagatgctttgttctgtctttagttggttatttatgatttcatacaaggatgtccggatgtggtcagagtaaagactcacagccaccggacacctgggccctgccagtgcgaggcagcgggaaaaccacaggagtgaggcgtgtccttacatttaaaacagctgagttaggaattatctccacagcctcgtgatcgtgaagggatgtgaagcagcactcaggataacgaagagtgcttgtgctgctcaccagtcggtaccaccgtggcatacatggcaattgggacaatggagtttacaatttcagacaaaaactggaaaattacttgaaaacgagaaatgcattatttgcagatattctgctaactccagcatgaaccacagtgcactcagatagggtcccataagtgccctggctctgcgtgtgtgctctatcttgccttgccttggcttctctcgtaaagagcaggggccactttactctcttcctggccccatctagagggacttctgtttagatttattttagcagcttctatttagatttattttggcttgggtctccctttatctttctagaaaaaaagaaaataaggttttacctttcattaaaggtactttcccaagttcactctttggtacagatatgcttgttgtatgtcacgtgtcgaaagtgttggcagcttgcaaacatatctattgttgctttttttttttctttttttttttttgtagagaccagtatgcgtgcacatgcctcaggtaattaaagaactgggcactgcagacctgaggcccctatttgtgttctctgaatttgaaccattatatgggttttacttttacaaagttagttttttaaaagtttcattgtatggtcagcattatcaaggatagtatgtct

SEQ ID NO: 115227 - DNA, 1054 bp, Homo sapiens
cccccattctttcatttccgtcttctgttttgaaagcagagtggtggcaatatgatgtttatgaggggagggggctggcaagggggcatgttcctcctaaattagccacttaaaaagcagagctttcaatgctattgcctgttttcatattgattccatcatgaaaaatgtgtagtccttgtgttatttagattctgggcaacatttttagttttcatttacactcctcgggtttggttaaaaaacaatgcagtacagccatgagaatgctttaaaaatgctgtcatactttgttacagctctgcagctggttgtattgtacctctgcagttgtttcttaggcagctacaaattacttaatttctaaagctatcctagaagtagcaagtctatgatgatctaactctgctccagtagtttccgcttccaacatgctagagctgaaaattttgctctctgcctttcttgtgatatttaaaattttgaatatgaagataattgtgaagcctgaaaatatgtacacataattcccagtttgagcagtgtcagatcaactgtaagaacccaatcatttgtaacaaaacccagattctacttctaataataatactatttcactcacatctagccaacacttgtaatattgtttctattggaaaaatatgtttccactttcttttctagtgaactcagagcttaggagctcagtgggcagaggcgggtagagggaagcttcctgggaaccccagaaagtggttctgcgtgttagtccccaagtgttaaacactcatgctctctgtctgtggatcacttgagctgtttaaaagatgtcatatttttttttctgtttacttctagtcagaactagtcaattgacttccataattagcttaccgttttcatagggaggaaagcactgatacctttactgtttgttaaaaggtgtacagaaaaaactaattggaaagttgtgagatgaattttttaaaaaacaaattactttcttgggaaaagatgtatatattttaaaactttgcaaagtattttataagag

SEQ ID NO: 115228 - DNA, 1050 bp, Homo sapiens
gtttgggcaactatttataatgcccaagattctgtttaatatgtagttatgttcttgggatatgtggatatataggtttttaattaattgttatttttaactacaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcagggga

SEQ ID NO: 115229 - DNA, 1132 bp, Homo sapiens
tgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaa

SEQ ID NO: 115230 - DNA, 1052 bp, Homo sapiens
gaacttaagaatgacatttaaaagtttttacacaaactttacatacttgacagactaaaacatttttcaagtccttaattatgagaacagcagcaaaatttaagacaattaaaaatcggcatttaagaatctgctgtattattgtgaataaatgcaaaacaactgtatcagtgaagcctgggaaaatctcaattactataatattcgtgcactggctttacatttcacttttgaatgcgttccctcatcctgggtgcaaactgggtaccttcagatacaacagcttggacggggaacaagattacgacacatggctgtagaaccagtctcgctgcgttacagttacagcatataaacaactctgtctaataaaaacagtaaaaccaggctcaagtgcacaccctgtgttacaaacacatcacatatcaggattataaatcatagaaataaagacaaataatggcatgaagggcatgatagtttatttttaaaaattgtaccacactgatcatgatgaccagcatacacatgataatggcttttctcttgggtttaacattgcagtagttttgcatactgcaatgtttcaataggaccaagaacgttagagaataaagatcttagatgaaaatgaacactaataattctagtgtcctcccccatagaattaatgtaaatcccgtatgaatcagtggcattataatgttatgtggttatgaagaatgaaatttctcttagaagtaggcagcatgaatttatacttacataagtataacttatacttccttgtactttcatctttagtttttataatttaagctatgtccaccctggctaaagtacaatcatacaatatacctcagataatttccatgctaccattgcacaagtttagtgattttactattaaaaaaaaaaaaatccaaccaccatcaaaataaagaggcaaataaaagtaatttttaaatcatttgaaaagcatggtgcttatttgtccaatacagactcaaacttaaatgctatagttataatttccagacttccgcaaaatt

SEQ ID NO: 115231 - DNA, 1039 bp, Homo sapiens
agtgaagtctaatttcttttgaccaagatcacacaaactaaatgatggagctgagattcaaattgggatctggctcaagcctattatttttaaactagattacactgaatgtgatttctctgcttttcagaaatccctaacatcttcccaagtctccactcctggaatgatagagattccatcattctttgggcactgggcacaaaagtacaaagggaacttcccagaatctgctgtttgcacccatttctgctgggaaaggtgagagtctgtgctgctatgtctggtctctcaacagaaggtctgactgcagtcttacgtagactgggaagcatgccagatgttaccttccagtattgttatgaagagtgagagaaagggtccaaaactgactgtttccccttctctccaactttcacctccatgcagtgccaatagaagcacattccagttgccataacaatggccttggcagaaccacaagtcaaaaatttgaactccagttggtcagagtcagggttactcatgagtaccacttggccacaggtgggactcaggtgagagcaacagaatttgctgagtaataagctctggagagtttgaagagtggtggggtagacttctaggcagcgtatagagggatgctgctgtgctagggctccatgggcaggaaaccagaaaaacccagcagtggaagccaggcctctgaggtgggggaagttaatctgggattggctcatggctatagcctttccagggatcacaagtcctccctacttggccctgatcccaggatgtctcaatcctaacatccctgtgtcagagcttctcaaactgcctgcctgtcttaaaggccatttcagcttcattgagtgacttgtaccagaagcatgccaaaggcaagaccaattgtccatgtgaagccacctgccaagggagcttaaaaacaaggtgtgtggtattttgttgctgtgtgtcccatcagcctaccctggaattgatctctaagtctgaagtggccagatgcatcagaccttat

SEQ ID NO: 115232 - DNA, 2766 bp, Homo sapiens
agttctctctcaggaaaagcctatgatttcctcaagacttgtggcacagacagaaactttagggaaactgacccagaccagatggcagaaagcagatccctggggacagcacagtggtgaagagcccagtgtggatggcagagtttctgccatcaaggtcatttggccaccagccaccactaatagtcagcttttgggcacccacacagcccagagagagcagttaccctctgatggtcatcatacccttggctgccgtggtcttcgtgctgaaagtggctgcagtggccatgtgtgtctggttgttgagccagaaggtagaaaaggcaaaaccccttatcaagccccagaccaatccggaacacacaaccccaagtcataggccacaaaggagcataaagttcccactgtcacagtgacaccccttctgcaaagctccagcagccccccagtctgtcttttcagggccctgcagtgtgaacaaatgtcttctccagtggccgagccagtggacaaatgtgctgcttgggagacatggatgaacctggtcaaactctgccgacaaaccaacccaacactgaagcacaaccagtaccgggtgtagattgagggctcgcatttcttactgaccacctaccatgtgtcaggcactgggataggcattgggatataaagcaaataaatgctggttggatcaactgagaaaagtcaggccctgctagtgattcaatgttcaatcctagctccatggttagatgttgcggggtggttgattgtgacttgtacaacactcatgggctttctgcaatgggctctgtgtgtcatcttctggacctgactttctcagtatacatcagttggtcaatatttaaaccctttactaaggtagtacagaacatgttagccccactgagaatgctagtattaacctggggcatagagttaaaggaggaaagctttgaatattttacactgagaattccctctgagtgagtcagcaggaagtacaagaactatttcagcatgtagaagaggtaatttatcacatcaatgagtatgtttacgtaatgtttttctgtaatgtcttttcctcattggagtctctaggtttgatttcctagtgcaggaaatgcctcagtgctctaggtagtgttgggacagtctggccccttttgaaattatctactgaatacattgtgtttcatcaggaggctttgtctattttgatttataaaatcaagcctagaagaaactatcatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgacaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggatgaagaaaatgtggcacatatacaccatggaatactgtgcagccataaaaaatgatgagttcatgtcgtttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggaggggggaggggggagggatagcattgggagatatacctaatgctagatgatgagttagtgggtgcagcgcaccagcatggcacatgtatacatatgtaactaacctgcacaatgtgcacatgtaccctaaaacttaaagtataattaaaaaaaaaaaatcaagcctagaatagaaatattatttgaagccctacgggacagaaaagtttgttgaatgtttttacgatgcctcaatttggcttaactttacaatgaattaaaataatggtccaggcccagtggctcatgcctgtaatctcagcactttgggaggccaaggcgggcagatcgcttgagcccaggagtttgagaccagcctggacaacatagtgaaactctatctctacaaaataagcaagcaaacaaacaaacaaaaaaattaaccaggcatggcggcatgtgcctatagtccccagctgctctggaggctgaggtgggtggatcgcctgagcctgggaagtttgggctgaagtgagctgtgatatacgagattctgtctcacaaagaaaataaataaataatgtaataatgacaaatttgtatttgcattgtctaattgagcctactattggccaagtgaagcttcagtttctgtaattttaaaatgaagatattagtacttgtattaggaatgctttgggctgcaaacctgcaagacat

SEQ ID NO: 115233 - DNA, 1057 bp, Homo sapiens
aaaatggaagatctggacagtcctccagatgaaatcagatatatgatcatccgtaatcctaataatggctttttggcaatggcttaccttctggacacagctgttcaccattttacacaagctgacattgataactctcaggtgtggttcatacaggatggaagcccttcttctggaatgttctactttagtgtgacagatggtgcacaccacaccctctataaactcttccacctggatgtcattcccatctccatcagcattgtgaaccttactgacctacttctcccacaaggccagacaaccatccccatcaccaatgctcacctgtcagccatgaccaatgggaggaacccccaaatcacttacatgataacatggcccctccaacatgggcacctgctgattgaaaaccaggtggtcaccaactttggacaggaagatttggattcaggaagactcttttatcacatgacaaatctcactgccacacaggaccagctacagttctcactgtttacatcagaaagcaacctgacaggacaaacactgaacatcagagtgcagcctttactgcgggttatgccaaacctgaaaattgccgacagagtggctcatcagctgagaagaagggacctagatgctaccgtgttgcaggaagtcagggaccccgaacagagggaccggctgaagccatggcagaagaacataaattgtgaagatttcatggacatttattagttccccaaattaatacttttataatttcttacacctgtctttactgcaatctctgaacataaattgtgaagatttcatggacacttatcacttccccaatcaatacccttgcaatttcctatgcctgtctttactttaatctcctaatcccatcatcttcttaagctgaggaggatgtatgtcacctcaggacccagtgatgattgcgttaactgcacagattgtttgtagagcatgtgtgtttgaacaacatgaaatctgggcaccttgaaaaaagaacaggataacagcaatgttcagggaacaagggagataa

SEQ ID NO: 115234 - DNA, 1020 bp, Homo sapiens
taacctactaagttgggagagtgttttaggcagttgatggttgagtgagctttcacacctttaactgaaagcgctaaatgttcccagccctctaccgcccttcactgggggaggcaaaaccaccatatcgtttgcaaataaaactcacgcttggccaagcacggcagctcaggcttgtaattccaatactttgggaggctgagacaggaggattgcttgaagccaggcgtttgagaccagcctagccaacgcagtaagacctctctccacttccgccccccagtctccatgaaacattttttaaaaacccaattagctgggtgtggtggggcatgtctgtagtcccagctactcgggaggcagaggcgggaggattgtttgagcccgggtgttctaggttacagtaagctatgatcatgccactgtgctccagcccgggcgatatatgggtggatacagcttctgaaagaaacctccactctctattatacttaagatcatactttggcaaaataattgtgaggaaaatacttgttatggcatagtccaaaaatactttcttatcccagaataaatttactatttttctaaaccataccatgtcagcctacccaagataagcaagcaacatctttgtccttcaccataaattatatctgcctaaatgggaaaagctaaaccacaaaaacttttgctcaaaatcttgtgtcctgaagaattaagcatgtgagtacacagagaaggtaaatcatcggattttaaaattaaataaaaacttttaacaaatttagaaaaattattgttcatttcaaagaatgtataaacaaaataaaaattaaattctataaggcactgatttcttccaagtacagcatgaagctaattgaatgattttaattccagtgcttgttgaaataatttagactcattaaaaagcaaagtgttccagtttgagatttatggtgcctggcccttttgcttttccataaagccagtaattgcatttcagccattgtactg

SEQ ID NO: 115235 - DNA, 1039 bp, Homo sapiens
aagttgatgttgctgtaacatttttattgtattttataaaattatttgtccatggtgaattaggtaacactgatcctttaccacagagcatttgaacgttcccaagcctctctggctctaacttgagtgtccccaagtctctctggcctttggttactaatgaggtcacagcacacaaagccatgtgtcactggttcttccccccatggcattcacatgtgcccttccctccccacaatgtccatgcatttgtcagggtccccaggagatgtctcacgtttgttcaagagccaccgtctgcccctagatatcagcagatgggcactccattgagcacctacagctgccatcaggccaggacccctctacccatcctccaaggggagagtgctatctcctgtgttctcggcactacacagtttgctttccctttcatgtactgggagctgagcctggggccacatagccaggcattgccttctttctctagggatcagacacctaggcctgggctgggggtaataagcctgtttcatctggggccctagtagcaaattatgtccacagatagatgcctcagggatcactagaatcttatagcccagtttcaagttagagctagccagtgccccctattacaaccaagttataaccaagtgttttccagagagttttcagggatctatacagattattttgttaactggcagcttttctgtgctttatactcatatacatgttttaatcttcacttaggttctgtgaagcccctttcatctcatgacctgaaagctgtgaccaatgatgtggacagtgcgggaaacagaactataacttttccagtggtaagttcccctagactcaggaggttggtgagactgaactctgacagcagcacagaggaagtttctgtttttacccaatatctggtgagtcctgacgtctgtgctgctgagccgggctgagcatctctgcgaggcgggcctctcatttgtctgcatcctgttaaaccaagcaggtgtgaccctttgcccaggca

SEQ ID NO: 115236 - DNA, 2210 bp, Homo sapiens
aactctcattttacttactcaaattgtcaaatttaagtaagtaatgtgctcaaatataagcttctctgagagccttttcctgaacaccactaaaatagcatcccttctctgccactttccatccctttcccagaatacctgaccttatagtatagattgaattggatatttgtttgttgtctgtctttccctatagattataagggcagaatctttgttttgttcattgttgtatccttagcacctagcagtgcttaataaaacatagtaggtgcttaataaaaatttgttgaaagaatgaaataatattgaacacctattatgtatccagttatatgttccagatgttaggaatacattagtaaacaaaacaaagagatatttgttcaatgaatgaatgtgtgaatgaatgaattaattaatataactttaattttaagagatcctgactttgaaaggccttgtcttcttcctcctgttcatcaataaatcaataggccaaatgactgctgtaaatctgctgaaggtgacccagccactctgcaagggtttgttctcccctgtcagaggagaagcaggccattccagtctgcagcaggaatgggagggagcatgagctaggagggctggatgagaaagttaaaaaagctctgttttcagttatttcaaattatcttctttgaaaatacagcaaagaaaataaaggtaaaatatcctctaaatccaaatgaagtaatttcctgactaccttcacagttaatgcaaaggatccccaaagaatcggaaaataatttactatgcgaatgctctcacctagtagttccaaacctgtagcctggattcgtggaggttagcttcattgccacaaggtcctaaatctacctacatatgtaccaaagcatagtttctagactgaatggtattttccacatacatgtttctgtttttcaaatgtgtgaagatgtgctgattaaatacaatacagttcatctgaagaggcactgaattgataggaagtttctgccaattatgtattgttagtattatataagtattgttaggtgagggcctagaaagtttttcatttttatgaaaggattatcatattttcaaaatggagatgactgctctagagacttgcacaaaagaagttttggttttctaaaactgtgaaatccacaatagaaaggaatcattgactcactaccacctgtcaggcaccacaggagatgcagttctgccatccatgtcttttcatcatctgaagtcctctgggccataggaaggaatgactccattttcgagataaactgaggcaggcggatcatgaggtcaggagatcgagaccatcctggccaacatggtaaaaccccatctgtactaaaatacaaaaaaaaaaaaaaaaaaaaattagccaggcgtggtggcggtcgcctatagtcccagctactcaggaggctgaggcaggggaatcgcttgaacccgggaggcaaaggttgcagtgagccgagattgcgccactgcactctagcctagtgagagagcaagactctgtctcaaaaaaaaaaaaaaaaaaaaaagaaaagctgaggctcagaaagattaagtttgtcagaccttaaagctgggctttctccactagctgccacccattgaagggcaaagtaggtagaagaactgaagttactattttcaatgaagggttgaaacaaaaattagcttgctggattgatttatttgtccactaccaggtcaatatttgcttttggtgagtagagaaaataatttctcctagaaaagtagcaaagagagttaaaggcaagctaaacgtgagagccaatccattacattttctaaatggatatggaggcaactaataaccctcaaagtggctgcagcccagctgcagatgaggctgttgctgaaaccagctggttctcccctggtgcatctgtccatcatcagccacaaacaaagacttgggcttaagtagtctctcttagcctttcatatttgcaaagtgctccaccattaattgaattcattattccacataacaacctaagtaggttgataaaaccaagatgtgggaggctaagtgatttacataaggtcacccttctggaaggtctatcaggaaaaatctgagattgtacagtagaaaatgcacaggtcaaccctgctgtttgtgtttccctctttatctttat

SEQ ID NO: 115237 - DNA, 1055 bp, Homo sapiens
tatactttctgagtttcctgtctcaagttctgtttagttattagatgatgccatccatcatctaattggagtaagttatttcacaaactgctctttctactgagggaaatggttctctttaactggagagatcatctattaagtcatttaggactgaatttttaaacaagttatgaaaaagcgtagaagatgataaagttcttatgcatgggtatgtgcacatggtgtttctgtgggtaagaaaaatacatataaatacaaatacagatataaatgtgaaatttgagttagtgacaaaactacttgtctttagtgttagtgaagtatcctgtggctgcatgattagagaaactcaaaacagccaaattccatcaaatgtgattcagtgtccatataaacattttaaacccatgttcaaaactgaactcctgatcttactccccaaatctactctacattcagctttccttatctcaactgatggtaaccctgtcctcgtttctgaggcccaaaccatagagtcattctcaccgcctttccttctttcacacctcgccaaattgaaatagccagaagctcggctggttttgtcttcaacagacacccagaatttggccacttcccaccacctctgcaacttctggggccactctcttctgtcatccttctctggaattattgtagtcacctcctaactggtctctctgcctctaccttgtacctcccagagtctattcctgatacagaagccaaaggattctgtgaaaacatgagtctgaccaggtcactcctcacctaaaactctgcaatgatccatcattgcactcaaggaagaaccagagtttttacagtagcgttcaagaccccgaacaatatgacaaccttcattatgtttcaactcatctccttttactcttcatcttgcttattctgctccttccaactgaccgatttcctagtctcccaacagatgaggcctgcctttgggctgtttcctctgcctgtatggtcctcccctagatatttacatattcactggctccctcttcacctcc

SEQ ID NO: 115238 - DNA, 1876 bp, Homo sapiens
ccgccaaagtgggagcccaggcagaggaggcgccaagagcgagcgagggctgtgaggactgccagcacgctgtcacctctcaatgggaccttggagggtgtctagtccacctcccaacagatgctagaagcccttccacagtattcctatagaaaggttatctagccagtgcttaaacatcttcagtgatagggaacttactacttgctgagatgagcccttccaatgtaaatacgctccaatttttagatagttatttaggctgagctgaaatctgccatttaaaaactttttctcctaggcgctggctctagtaccccagatttattctgtaccagaggtacctctggtacagaataaaacatatgcctcctagattcattcatagtatgattctcctagaatcatactattctggtacagaataaatcatacccatcctttcatgaaagctttttaagtatttgaaagaaaagatgatcagatttccttgaattttatctttcttaggttaaacatccctagctttccagcttttgcttctatgccatgggtttcctgcacgatcctggttgcccagttctagatgagtgccacattgtcactggccctgtcagcaatatcggggtaatgcccaggtatttaacacaagtatgctttaatcattggtggatttttttattcattcattttctcattcaaccaacagatgcttacatggtacgttttccatatcataccctatgatgaacataagctctcgaaagttaaaatagtccaggccctgcaatcagggagctgggtacaattgccaatttggcatccaatcagcataaaataaccaaggacaactccgggctgctgtcacgtttctttactttgggttagaatggtcttattgttagactttactttcttatcatgaatgaaagaatgatttccactactttctttttaaatgttgaaaagtaacttgcaggtccccatcatttcctttataagaccctaggaacatacactctccaggttggaaaccattaacaaccacctaccattttagagtgtctttgtctagtcagctaggaacacatgtttgatgcttcatttgcttctaagaatttcaactcatccattgatttgaatcaatttactaaacatcttgttcgagttactgtgtgcagttaccatggtcagtaaaacatatttctcgccctcaagaaatactgctgagcaatcagaggcaccaggtttaatataaggtgcactcttcttgcctctcacgtggcattttcacagtggtatggtgggaataaagattctaactgaaaagcatgaggaaaccttcacagaggaaataatgtttcagctagactttgaggagagagtgaaagagcagggagataacagaggaggaaacagagaaaagcagggcaagcaaagggaacagcatggccaagggcattctagagggatggggagttgtccaggaggtggaggagtggcagagtgtacttggagctaatctgtggaggagtcctcccctttgaccacaggagatgtaacctgaattacacgtcaagggggctagacttaaccaggggatttggggagccctggggagaatcagagaatgctgagggttggaaaagaccttagacatcagtgcttctcagcgggggtcccagggaaggtgacactttagtgacctcatgcaggtggggtcccagggaaggtgatgctttagtgacctcatgcaggtgtctttcagtcatggcttctccctcaaaggctggacaaaccatctaagaccatttcaaacctgctctgctgtgagttgaattgaatacctctctaaaaatagtttgtaaattgtagc

SEQ ID NO: 115239 - DNA, 2615 bp, Homo sapiens
caacagagggtgtggaagtagctgagagggaactacattttaagttattgatcccatctaagaaaggaaaattggtacttggcaataaagttctaaaaacaaactcaattttcagccaaaaaaatattacagactctaagataagttatgaacctcaggagaggccaagggaagactcacaggatacttttaggtttttggttgttgcaaaatacatagactcaaaagattatactttcagaatcaactttaaagcagataagacatactttattttaactaacagaggattatttgtaaaagaaggagaaggaaaattaattacaaaatcagaactatttgttcaaattttggacaatcagatcttccaatataaaatctccaagggccctcaacatgggaagctgaaactgcttaacttgtctgattctctggaaagtaatgacaatatcactatgttcacaaatcaagagagagtgagtgaacaggtgatctatgttcatgatgactctgagactgagtctgatgagttcttttttgtggccttcaccaaaggaccaggggggagcagtcagggatcttgactcacagcattcatctatggaaataaaagtcacactttccgttgggttaaagaatgatgagaaaccagtacgcatgatagataaggtctttcatgttgtgcggaatggccagcgcttattgaccctggcagatctctgttaccataaccctgacttagattttgataatgggcagttgctgtacacccagcggggcatcccaaatggggatttagtgtgagccagagaccccactcagaaactctaccagttcaggcaagaagacctgcaggaagggcacgtgcttttcaggcatcagggtgcagacttggatcgcttcgtgctgtttgtgacagatggtgtccactacacatcatctcttctcaaggccagtgtgtcagacccttatgtccagatagccaacaacacggggctgctcatacagagaggaaaggatggcagcctcacagtggccaacctaagtgtcaccacaaaccaaaatgtcagaacagaccacaagattgaattccacattgtgcagggcctaaagcatggcaggatcctggtcaatcattctgtttcccactcattttctcaggatgacttgttgatgtgtgatttataggcacgatggcagtgatgactttgatgtattcaacctgagagtgaaagttaaagccacatacttagaggtgagagtgggtgtctatgttcaagtgtgcttggaaggtcacccacatcacacgcaggttctgcacatcgagactctagtagttgaagaaagaaaaccagtaaaactgaatacaggaaggctccaggtaggtaattatcctatccacagcactaagaattctcattcttacaggtgctaataatctgtttgcttctgaaagctatttttgtgttgatttctcccctggtatcaggagtgaatttttaaaaatatagatgccattgagaagaaaacttggaaagtttcatgattttgatgctaccaattttcctacagttggaaatggaatgtaagcaatgctcaggcttattttaaagttgggctcacatgtgcatacatgtgcatcatatatatgtttagtacagtaaaaacttggactaagggagagaggtatatattatggtaaattaagagatcttttattcattatccatagcaacactgccaatatttcatttgatctgagttatatttatgatgtgctgaatgaagcacagtataaaaacttggagtaatttaacaaatgtaagaaacattcctaagataccagcaaatactatattatatagtttgtttaggtctgaatgtggccttgtttagtatcctgaaagtgatggttaaaactagcctagaccagtggaatgtcagaggtgagaccaaaaatcacctggttttctgggcctcgtactggaaacttccagcaggcacagccatgctgatcagagtttggaaggggtgttcttttttagggtaatgctgtgtagggtgtgggatgtgtaagctgcgatttataacaactggccacaaatgcaggctattctgaatctaccctcgggactgcaaacaagtttgcttttttgctagatgcagccaataaaattaagtaaaaatgaattcaaatcagaatgggttaaatacttttgaataagactttgaatagtgagtttggaataagaaccagcttttttgttctttttcaagagcttatatttaagtttcaccacaagggggcatatgcagtccaatgactatacatcagttataatcagatttgagatggagttcccggaataaaaaaatacgtattgaaagtgctgagcgagttcaaatgggggatgataactttcctctcaaggtcttacaagtttactgacccaactgctgcgtcttctaccatcttgtattccttctccttacactaccattttatttctttcacctcaaccttggagtcctgggtttttttgctgctgtgaatgacacttggttaatacattagtagctacttaggtgttgctgaccattacttttttttgtga

SEQ ID NO: 115240 - DNA, 1670 bp, Homo sapiens
ctgagctatctcttcaattaaaatttcataccagcaaaccacagggattacttttgcttgcagctgggacaaatgactattgtataatagaacttaaatcaggaaccttatgtgtatgattttaaatcttgaaaatacatataagcatataattactggagagaaaagcagttgagagagaaagagaacaaaacagctacatgtattgattgctgttatttcattagaataaaatgatgtgccatttgtataggttgggatctccttcggttttactagcatggcttaaatattccaactttaaaatttcctgagtttagtatgtaatctataagcatgggaagagttttcatgtgcaaatttctctcttctttttcttttgtgaaaggtccgattttctcaataaaacattatgaaatgaaaagtgagatgagattgattaattatgattctttttcaggtgagagtaaatttgggtacaagtgaacaaatgctcctttctgagcagagacttcatatggatgacctggtttggcatttggtggaactgtgctatgttaagcataatatttcctttgttattgacaaacgttatgagacaactggccaaatggcagctggtgggatgcataatttgaattttcaacatggaatctatgtaggaggccgcagggcactcaatgtaccttatctgtacggaaagctccccaatttttgaggatgtatgaaggatgtggtatttaaccagagggagatccttacgtcccttagatcttaccctggttttaagaaggtttatgaggtgtcactaggatgcaatgacgagttttttttgcaggggaggatgaagccatcaatttctttagctccagattctctgtcagttttccagaatggaaagtgcaagggtaaacactattggaatttactttgcaaactgtaactcagcaagccttgctttcatttcagttgggtaaggaaggagattttgttgctttgtaaatagatgaaagtctattgaaggcttatgtaggaaggcataaaagtaaaactcagctttcttcttttagttttgtcagtgacaacaagtggcatgttattcaattcaaattcacaggggagtatctggacctaacagtagatgaaaaaaaggtaaggaagtcactgcctttgcaaagcaaacatttgtatctgaaggagccctttttgtgggaggtcttgataaccaaatgtgggaagaagtaaagaggttagaacttgcctctgtgcctgggaaatttgctcgaggaacctctttcaaagggtgcttaagaagcttggaagccaattcagaaaagagagcgttaagggatgcccttgttttcaaagatattcctgttgttgtaaaactgagagtgttgataacacaaatccttccataacagcgatagaaaatctgcatcagtcagaagttttcctttccactgccgtccctgaggtcatcaagccttttcttcaagatgagagtagcgatttcttggttttgaataacttgcaggtccaagaaggtggaccttactgaaacaaaggcacatgaaactggatgtgaaatttaaggatttgggtatccatcattctcaaatactatttaaaatagagggaaggcctattcatgggttccttcaattaaa

SEQ ID NO: 115241 - DNA, 1026 bp, Homo sapiens
ataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaaaggacattcaggtgtcccttcggggttctgtaacaattaggctatgtgtgctgagagagggagcggagtcatttgctgatgtgctgctacctgtaactcaaatgcctcataggaataccagcgg

SEQ ID NO: 115242 - DNA, 1037 bp, Homo sapiens
acccgggctccggttgcccaggtaacgcaggacgcaggcgcgaaaggcgggtgcctggcgcgcgctgcagctccccctccccccggcgggccgcggaggcgacgcgctgcctgcgccctgaggcgagtggttctccagccggaaaatcgcggctccggtgccgctctgggctcagccagtgagaggccgggggtgtggtagagagaaggagccggccgggtacttaggaccgcgccagcctctgagcccggcctccttcgcactttcgagtgcgcgtttgctgcccgccgcagcccgggcgttgaaggtagtaaagcggccacccggccgcatcatggtgaccccctgtcccaccagcccctcgagccccgccgcccgagcggggaggcgggacaacgaccagaaccttcgcgccccggtgaagaagagcaggcgtccgcgcctccggaggaagcagccgctgcatcccctgaacccgtgcccgctcccgggagactccggcatttgcgacctgttcgagtcccccagctccggctcagacggcgcagagagcccctctgcggcgcggggtggtagccccctgcccggcccggcccagcccgtggcgcagctagatctacagaccttccgcgactacggccagagctgctacgccttccgcaaggcgcaggagagccacttccacccgcgggaggcgctggcacggcagccacaagtgaggtgctggtagagccagctccacgccgccgctcttcctctcctcccaggctctctcctctcctgccggctcggccctccgagcgcccgggcccgcgacagcccaggtcccgccccgagtcgaagcacaaggggccgtggaggggcgtcaccggcctcattttacagatggagaaaagtggggcgtagacggcttgagggacttgccccgtcccaagctggctactggggcacggtagagaggaattcgtttccgggttgagtctggactcctaccgaactcgggcaagttatttaacacccctgagcttctttcttca

SEQ ID NO: 115243 - DNA, 2781 bp, Homo sapiens
gagactccgtctcaaaaaaaagaaaaggaaaaaaaaaaaaagttgaaaggagagaatctacatttctcaactctgaaatgtggttatttaattacgaaaaatttcaaacacacatcaaattatatggacataatgaactttcacccatttcccactttcataattaccaacctgtggtcaatctacttgtactccttttattctactatctgccccctagattttgaagcatatccaaggtatcagatttttttaaaacattatcacacctaaaaatactcaattccttaataccatcaaagatacagacagtgtttaagtatcctcagttacctcattactggctttttttttttttttacagctagttcaaaggatgatccaaacaaggcccacactttaaatttggttcatatgttttttaataaagtctcttaacctatagttaccactttctcagttttttcctatttgccatttattttttgaagaaaccagatacattgtcctgtagagtttcctgcattctggatatggctgattgtatccttgcggtattatttaacatattcttctgtgtcctgtatttcttataaaggggtggtatattgagagtttaatccaattcaggttcatctttgttttttttttttcttttttctttttttcagagtcatctccctttttgtaacattaagatatatcaatggggtcagctaggttcatccattacaaaattccccactggcttttcatgtaatgctgttagcagccattgataacactcagacctattgtttcattagagtctggatatggttgattgtatccttgtggtattatttaacatattcttctatgtcctgtatttcttataaatgggtgttatattgagagagtaatccaattcagcttcatctttgtttttttttttttcttttttctttttttcagagtcatctccctttttgtaacattaagatatatcaatggggccagctagattcatccattacaaaatttcccactggcttttcatgcaatgcttttagcagccattgataacactcggacctattgtttcattagggttgcaaatgatggtattataattctacttgttagctagaattatttcatgaagaattactttttccttatcaatatttgaataccctgaggtacagtctatacaagaaaattaggataaatgcttgtttccttctacctagcagttttcataatgagttgattcctaagcatctccacaagtaatcagtgaatcttgtttttttaaaaaattgttatgaacttaatgatttaaatatatttgatgtgttttagttctctacagatgttaattttttaatactcaaattgtcccctctttgggaagtgagagcccctttgggttggctgctgagtccttttcatataatcttagcaatctttgatggcttccttgcttttcgtacggaagacttctctagtgtattttatgctccaggcttggaatcagtcatgtttccaaagagctctgattccttttcaggaaattctattatatgtccctaaatattggccagctatttagctacagcctgggatggctagttatgaaaaggcattcaaagcatcatacttagtggctggttgtgatcaactttatcagtctgttcttaggaacggaaaccagatggtttagcccattactcaggttgccattcaggagtagatttatttctgggaagagagagagtagaagtgtagttaaaatgtaaagacaggtgaatgtgaaaagcagggctcccccacaaatactgtctttttgtttttttattgatacttatttaaaaggaagtgatgtttaatacgatatgctataaaagttttttttttaaatagatggggtctcactgtgttggccaggctggttttgaattcctggtctcaagcgatcctcccatctcagtctcccaaagtgctaggattacaggtgtgagccacctcacttggcccagatatgctataaaagtattcagaaaataatgtatctctcacataattcccctttatatactcatattttaaaaagtaaaaaggtttttttcccatatttgacacactgcttttttgtgattaaaaaaaactgctaggatgacagcagagacttctctaagtggaatgaactttgtccttctcgaagcacatgaagggctaaattgaagaaatagccccctctggccaactgactgggaacatgtagaaatcccagtcagctggcccagagggggctatttcttcaatttagccccttttcctttatcttcaaattgctttccaccccttcttctgtgagccttttcttcacctccctgagactacaaagttttagatgtcttcaccaaccctgtggtgttatggcagctgtctgtttggtcttttctctcctagaatcaaagtcccttaagccccaaacttaaaacataaaggatatcctaaaggtaaacatcaccttttaattgcttgtatcctgtgtactttgaaaaatgcccacccttcctgtgctagttttgctgatcagcacatattaaacatagaaaaacattttaggcaacaattttagattaaatgaagttgccattaataaattctttcaaagttctttaagaaattaagatgagatttccagaaacaaataaagaaggtacttgcaatctaggatcaagatttctgtcaattctttctcaatgctgaccatcctcattgagtaaaaatctc

SEQ ID NO: 115244 - DNA, 1054 bp, Homo sapiens
aatttttgtgactgaaattgaaattcagtttttaaatttcatcagctcaaactaaagaaatttaaataatgatacattcatgaaagtagtctaaatgttttaagctttttgtttattttcagattgttttagcaaccaatattgcagagacgggtatcactattcctgatgttgtatttgtaattgatactggaagaacaaaagaaaataagtaagtttaaatttcccaaatcaaaacatttttaacctggaaagaggttggggctcttgaattcttgggagaaatcctaaaattatttagggaaaatcctaaatgtcctagttctgtccaaagcaaaagccttagagaaactataggaaactttaaaatatctgagagtaaatgtcagaatttcatttcatgggttttcccataagtaataccagtatactgctacttttagaaaagtgctgagaaaaattttcagaacataaatttttatagatattttatttgtaaaataaattgtttaacaaaaagcattctttgtgattatttaaaaaagaaacatggcttttggagtaagagctgaatttaaatctcttgagcaagtaatgtaacatataacctctctaatcagtttcttcatttgtaaatgggtaaaatgaaaatttcttttattttatttttgagacggagtcttgctgtgatacccaggctagagtgcagtggcacagtctcactgcagcctccacctccctggttcaagcagttcccctgcctcagccttctgagtagctgggattacaggcacatgccaccacactcggctaatgtttttgtatttttagtagagacagggtttcactatgttggccaggctggtctcgaactcctgacctcaggcaatctgcctgcctcggccttccaaagtgctgggattacaggcgtgagccacctcgcccagccaaaatgaaaatttcataactgaaagtgcctagttcagtaactggaacctaataggtaactgtaactgaattttcaacaaaaagattactactgtataaataatgt

SEQ ID NO: 115245 - DNA, 1107 bp, Homo sapiens
gaatttgcatcatacacatacatatattaaagtaataataatttgagtcaaattatattttaagatgaatatagctatccttttaagtgctaatctattgaatttccatattgaatagttagtgaaaataacatacctctgtttttcctttagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaagggtaagctgtcattcaactccacctcagtgaatgatggtgacattactcacctttgcttttgtgatccaaatggaatgtgtaccatatgtgagttttcactgctattggttgatcagtagcacatttcaggcacttttcacattttctttgatagatgtgatagtatgccactgtcctatgagaaggattatcagtagagttctgtcattaaaattctcatataaaagaaaaaatatattaactataataattgaatattcaaatatgttacacactaaattgaacagccaaagaatgtggacaaactcaaattctactaaaatatatctcaagtttttgcaaacc

SEQ ID NO: 115246 - DNA, 1035 bp, Homo sapiens
tgtggaaggcagtatttaattatggttcaattttctctttattgactgtttcttctgattaatcctttctcattattcctaatttggcttcctttcaaccctaaacatagtttgatctttcgttcctcttaggccagaagtctgaaagagagagtatgatgatccgacttttggagctatgctaatttagctatgctaaaaacagttgttagtgtggttgaattaaggagaatttttgttttgagacagcatcttgttatgttgcccaggctggagtgtggtggcagagtcatagctcactgaagcctcaagtgatcctcctgcctcagcctcccgaatagctgggactacaggcatgtgccaccacatccagctaattttttttaaaaaagttgtatagagacagggtctcactatatttcccaggctgaaaattttttaagtttgttttcctttaatgttatattgtctcgctcaacttaaaaaaattatgtagacattgcttccatttttcaattttaggttatattaacaatacacttccagtttcaggaaagattaaaataaagtgctactgaaggaagctctttaagagaacataatgctcttttttaaaattttggattgtcagtgtttcctttttacagtaaatgtgtttctttcttcgtaggaaattagaaccattgaaaattttagacactgattaagtggaactctggacagtagttcttttcctatttctgccagtaaaagttcttaatgtctttatttcccttattttgcaaaataaggcactatgaactatttgcttgataaaaatggctatcaatgtcagagagagaattgtggattctttatagcacagaattgagataacttagattctatccagtatagttaatttaaaatactttaacctgtaacattatacaactgccagaatctcaaaagaactgctttgtggttcattaacattttatatagtgccactgcaggaataagtaatagacatttgttcagtagttcaacatattc

SEQ ID NO: 115247 - DNA, 1615 bp, Homo sapiens
tagtagcattcgaggtggtttggaatattgagtgatgtttagagcaatttggaaagggtagggaggccattatggtagctattgcacttgctcaggtgtgagataataaaggttcatatcggtaattggaaaggaagagagacatttgtaaagcaagaatcagtagaaattggtgatttacggaatataaaggctaaggaagatttcttcagagaagatacacaaatcaccagtaagtgtatgaagaaatgctcaacattactaatcattagggaaatgcaaatcaaaaccacaatggcataccatttcacacccgttaggatgtcagctgtcaaaaaaaactggaaataataaatgttgacagggatgtagagaaattggaaccctgtgtactgttggtgggaatgtaaaatggtgcagccactgtggaaaacagtttggtagttcctcaaaaaattaaaaattgaattaccatatgatccagtaattccatttctgggtatatactcaaaagaattgaaagcagagtcttggaggagatatttgtacactgtgttcatagcagcattattcacaatagctaaaacgtggaagcaatccagtacctaccaataagatgaatgaataggtaaaatgtggcatgcacatcaaactgaatagtattcagccttaaaaaagaaggaagttctggtacatgctacaacacggatggacctcgaccgacattatgctaagtgaaatatgccaatcacaaaaagacagataccatatgatttcacttatatgaggttcctaagtcaaattcatagagacaaagtagaatggtggttgccaggggctagtgggggatgggagaatgggtagttatgcttaatgggaatagagtttcatgtttgccagataaaaagcgttctggaaatggatggtggtgctggttgtacaacattatgaatgtatttaataccactgaactgtacacttaaaaatggttaagatgacaaattttatgggggaaaaatgtgccaaagatggcaagaggtgcataagtggagggatggtggtatcattgccaagtacaggaaagatggaaaggataagtattatttgggtgaatttgaggtggtagctaaccctcctgtctgttacactgtattgatatttgtctttacacaaaatggtaccaaaattcggctagatatgcttgcttaattgtctctttttccttcttttaacagttgtgtttccttctgcagtccatagttttatgcttctaatctgctgtcacttattaacctaagggggagaaaaacagtaatttgagtttaactttaaactcttcctagtttttgctcaggagtcaagtcatgtccttgagggttatgacatccgttttcctcaaaagccatttttttcctgtcttccataagataagagatatgtgaagttaactttcagatgagtattattattactgcatgaataatcctttaaatacacatacttatgaaacaatttttttttgagacagagtcttgctttgtcacccaggctggagtgcagtggtacgatctcagctcactgcagcctctgcctcccaggttccagtgattctcct

SEQ ID NO: 115248 - DNA, 1056 bp, Homo sapiens
agaagatccttcgcggcccaggccccgacggtaccactgcacagccgagagctcttcacattccccggctccggggctgccaccctgcgcttcgatccgggcttctcgggccggggcgaccgctgcctcgcaattggtcgaattcagcaggctccgcctccttgagtcgccagctgcctgccacacgccaggcgccacgcgccgccctcgctctttatccactgagcagcttatccactttaggtcggaaaggaaaggaaagaaaagcaggaaaaaaaaaaaaagtcaggggaacatttttgtcggctgcgcgactcgactacttttgtctcctgcgggccactgttgagccttcacgagacgtcactgtcttcggtcgcggggcatcgtgggtaggagggagatttgctctcactgctcccaaaaatggcggacgcattcggagatgagctgttcagcgtgttcgagggcgactcgaccactgcggcgggaaccaaaaaagacaaggaaaaggacaaggggaaatggaaggggcctccagggtctgcagacaaggcagggtaaggaagaagttccagttgttgcttttattttttttctcggtggggaggaagaaaacactactctcttaggaagagcacgagaaagtgaagtgtacattgagtggcgttggaagtgaaggggttccagaaaaaagttggagagggtggaagaatgttggttcgtggaaggggggtcttggcgtttcctggtgtctgcaggcagcgtgatcttctgcttcaattcccttacgtcgatgttactgattctgtccccatcttcgcggttgtctcctgcatcagcacaacacctggcacatagtcgttaataaacaaaacgaatgattagttgagtaaaaggtgaaaaggtttagaaaaaatgatatgaattgatttggaggggaaagggcagataataacatgagaagggagagacatttaatctccaagatgtagtagttttctcttccgtaaaatggagataatagtgcctaccactggtggatatgaggattca

SEQ ID NO: 115249 - DNA, 1056 bp, Homo sapiens
gagccaccgtgcccggctccaaacgtcatttattgtcactacttttgaccagcaaatctaatcacaaaaaattttcttccaaatagtagtatcatgcctttagagaaagcattaaatgtttgttaaaggtaactcatgttaatgtctaatgatgttttaatttacagttttaaagaaaatatatttaatagttatgttaatgtgaattttaagataattttaaaccgtcaaagaaaaatgaaatacaaatgcagtaaagtattcagttttactagttataaagttaaggtattccgggcttcagccagttgttgtttgtaacattcatctatttaaaacatgactttctgttaatggtatagagcagtattttatgatgttgcccttaaagtaaaagtggatactgcagaattcattccaaactatttacttttcaggaaacgttttgatggtaaattacaatcagaatcaactaataatggaaaaaataagagagatgtagatttcgaaggtacagatgaacccatttttggaaagaagcccaggatagaagagtcaataactgaagacttaaggtaatatttccaaagtcctaaatgttagtaactcataattcaggtggttacatgaggttttaaaaattgtctccatgttgctacttagatatatgcccgtattagagaaatgaagatattctttctatttttacacaggcatgtaaatgtagaacacttacctaagtttggggagttggaaagcaatatggaaaatactcatcttttaatactttagaatccagttttgagaaaaaagtcttaaaacctgattaaaaaaaatacgttttctttatttgtaatgcctcaggaggaggataactggaagagtggaataaaaggaaaaaataaagctaactcagtggaaggaataagtgggaaggaacattagagcgaattagattttcattgttgcatgtggagtagagtggctgtgcatctcaagactcctgctatgggtatctgtggctggaatcgctggtatttatctgattttggaagc

SEQ ID NO: 115250 - DNA, 1047 bp, Homo sapiens
atggctgcatagtattccatggtgtatatgtgccacattttctttatccagtctatcactgatggacatttgggttggttccaagtctttgctattgtgaatagtgctgcaatgaatatacgtatgcatgtgtctttgtagtagaaagatttataatcctttgggtatatacccagtaatgggatcctgggtcaaatggtatttctagttgtagatccttgaggaatcgccacactgcacaaagactttattaatttccttttcccttaactatttctagagtctctttttttctaattgccattccctgtcagcatatgagcattcaaaagtttctctttctgttctatgttgttttctacccactgtgttgttattcttctgttttgtagtagtttcgactttaaaaagtacacagtttcctcagggagataaacatcagctttcaattattacccttagacaaatgcgagtagatgtaatttctgagtgttgaaactagctttttgccttgttcttaaagacagttatttgatttacagtgtctgagacagctaaagttcatcactctagttcatcagttttattttccaaaccatcattcattatggaatgctaaatacatcagttctcaaatagttggtgaggtttttttttcttttttactttgttgtcaggttgcacttcctgcagaagaggattatttaccacttaaaccacgagttggaaaagctgctaaggtctgtactttgggtaatacagtttatatagtttcgtgagactctctttttcttaaaattcttatttcaaatgagatttttatatttcccacaacatgtatatgtatgtatcaagaacaagccaactaaagacaaatataatgagaactgaatcagttaacaactatgctggaaaccagccattacatgatgagattttaaaatattaaaattatgattctcaaccttttaaaagaatgtaatgaaagttatcaacctttctccagaaaaaaatacatgtgtactagtttttgcctatagttttagg

SEQ ID NO: 115251 - DNA, 1846 bp, Homo sapiens
tttgagacacagtctcactctgtcacccaggctggagtacaatgacgtgatgttggctcactgcagcctccacctcctggattcaagcagttctccttcttcagcctgccaagtagctgggattacaaatgtacaccaccatacctgactaatttttgtatttttagtagagacagggtttccccattttggccaaggctggtctcgaactcttggcgtcatgtgatccacccacctcagcctccctaaatgctaggattataggtgtgagccactgcgcccggcctaatctgtagactttccatttgattatgttgttaatagttttggttcctttttgagacagtcagtttcttgtgactgcttcttttttcctacatatggtcatactttcctgtttgtttttatatcttgcaatttttttcttgaaaagtttagataatgtatgtagcatttctgtattttctttttgtgtatgtttcttgtaattcatatttgatgtttggacaacttctgattttttaaaaattgcttatttcactggctgggatgaatgttatttttatttccccaaatacattataataagcctattctgggcaggagctgaatcttaaataaggaggatctactacaatgttaagtttaatgctatctgtctatatttaaagaaaaacaaaactgctctattgtgttctgttaatagctatgaaagaaattttccataatcagaacctaccataattttcagaggactgacttgttaactgttacatgtgggaaaagaatacatatagattaacttatttgtgaaacttgaggaggaaacacttcattttccaggggctataagcacttgatcatctgtatatgtgtgaactcacagacagaggctctgaattttggaagcccgtcttagaaccaaaggtgttttccttgcaagaaataggtaactgttagtaatctattgctattagtgactaagttgcattaactctgagtgaccggagttaaaatgattttagatcactctatttcatatttattataattattagtataatagatatggtgttactgttcttcagagtccattcaagataaataattagggaaaatttggacacaatttaaatattaacagaatttttaaagtcataatttaaaggaaaagttgtatgattatttgttttcacatttgtaggtatgccattgcattggccttaagggaaaagcagcgtgtaatatttaccagcccaattaaggctctgagtaaccaaaaataccgtgaaatgtatgaagaatttcaagatgttggtttgatgactggtgatgttactattaatcctacggcatcttgtcttgttatgaccacagaggtaattcatgtagtgcctcatctgacttttcgtttttaattaaattaatgtgactattcagttagaacctgggaagttttattggttgctctacttaggtaaagtatagtactttattttctgattagacttaggcaaaatggataacatttatcttaaagtgttctgataatattacatttctaaattaccatactttattatttgtctcagatacatttttttcttcaggtatttttaaagtttatttctgtcagtgacatgaaaatattttactggttttatgtacatagttttaagcatttgaatatatagtaatagtgactcttcatttcatgtgactttgccgtcttctatatctgagtgttgatacaagtagatgagtaactgatttttatttatttatttattttttgagatggagtctcgttctgtctcgcaggctggagtgcagtggtgcaacctct

SEQ ID NO: 115252 - DNA, 1177 bp, Homo sapiens
tgccaggaagtatccatgttgcaagaaaacgaggcagaaaaaatgggcaaacagtcagggatgatccagtgttttgaatagaggataatttaagttgtacttatattttagaaagtatgaatcttgggacggtgctgtgtatagaaggaagttgcatcatgttctagacatatggagagtaggggtgataattctctctgtggattgtatctgattagtaactgtttagaagccatttactttgctttttatgagaaaaggaatatacaatataatatacaacaatgtaatattgaatattacttttgttaatatttgttaaatagtaagttctgtaaccccttaaaattattttaatatttccatttaataaagaatatccaaaattccttgttggaaaaaacaacttttctctaactattagctgttatgtcagaatccaactaaatacattttttacttttttctttagattttgagaagtatgctttacagaggttccgaagttatgagagaagttgcttgggttatatttgatgaaattcattatatgagagattcaggtatattcagtgttgaaatgtatatcatgtatttcccttcagaatgacattaggaattttgagcaagttattgttaaactttgcttctagtttttgtgtggctagggttctaataaactgttgtttctttatttttatttacctatttatttttgaaacagagtttcactctgttgcctaggttgaagtgcatgatcctaggtaggatcctaggtaggatcatggttcgctgcagccttgatctccatctcagtcccccaagtagctggaactacagacgtgtaccaccatgtctggctaatttttatttattttattagtagagatggcgtctcacaacgttgagcaggcaggtcttgaactcctggactcaagtgatcctcccaccttggcctcccaaagtgctgggattacaggcgtgaaccgcacccagccttgcttctttaaatagtggacaacatgatattatttttccattaagatttcattcaagtacagctctttaatagtaacttttgctgggtgagaaatgcaaattcaaataaagcaaaagaaattaaaagatggcgtgcttctaatagctcaccagtagaactaatgttacagaatttcta

SEQ ID NO: 115253 - DNA, 1233 bp, Homo sapiens
taactataaagcttcagagaatataattttagatattatcacagagtgacactgtagtccaactatagtccaaagtatatatttatttttttcagaacgtggtgtagtatgggaagaaactattattttgcttcctgataacgtccactatgtctttctttcggctactattccaaatgcccgacagtttgctgaatggatttgccatttacataaacaggtattttttcctccttttttgatgtcttcaatattcaaaatgttacagattagtcttgctttactctccctttgcttttctcctgatgttgtccagaataataaaaaaaacattttaatggtaaactgcttctcaaatcaagcagcttatcaaaatcaactgactgactttttagaaatgttgatttctgagccccatctcaaacccactatatctaaatctcaggtaatagtgccttgggaactccaattttaaaaattccccaagttgatctgatgatctgccaggtttagaaactactgcatttactcaaatagttatccatgagtacacagaatttcccctaatgccttggtgccaggaaaagctgggcatctctggagcatttgatttgatttttctcatgtaaacacagactttttactgactttctgttattgcctttctagtctgactttagcgtctgtatatgcttgtaataggcatttgtttatgtatactgaatttattcttgcttttatttttctgcccttaattttcctttacactgatgttctcatgaacttatctgtttataagctccctgatcgtgtttttatggcattctcccatattgcttctgtaggatagaaaaatccaatggatcttggggagaagctagatcaagtgctgctttatactaaggttttgaaaagcctgggtggggcagaaaagttccattttacttcatggatcctttgtatcaccgtatacctcctctatagaaaaataagcatctttccgtaattacagcattccagggctaggtaatgggtagttgatgctcaggtcatgtatttagccctggttagggaattggtaagttgggaagatggtagtataatttcatagacctaatttttctacgtttttctcttgcctgggttttagtgaattttttgaagtgttttctttttgaaatgttgaattcattacttgattttcttaagatcttttaggttggactaagatac

SEQ ID NO: 115254 - DNA, 1357 bp, Homo sapiens
aattttaatactgcaatgcaagtgcttcgagatgcaggtgatttggccaaaggagaccagaaagggcggaaaggaggaacaaaaggtaatttggaactttgctttgagagaattttacatgtaaattgtatattcagattactctgatattttttgtcttagtttttttttctcaagctatgtaaaggtctagacgatatgtgataaaattggataaatatttatcttttttgtatgacattaagtataatttacatactataaaattcactcatctaagtatacaattcagtagtctttagtatatttacagaattgtgcagccatcaccactgtctagttccaaaatattttcatgaacccaaaaagaaaccctgtacacattaacagttattctcccttttcccccaacctttcccttctcatcccgcagacttagttaatcattagcctgttttcgatctctgtggctttcccttgtctgtgcatttcatgtttggagcaactggcttctttcacttaatgtaatgttttcaaggttcgttacttttaattttttttttttttttttttgagacagtgtctcgctctgtcacccaggctggagtacactggtgctgtcttggctcattgcaactttctgcctcctgggttcaagtgattctcctgcctcagcctcccaagtagctgggattataggcacctgccaccatgcctggataatttttgtatttttagtagagacggggtttcactgtgttggctaggcagatctcaaactcctgacctgaagtgatatgcccatcgtggcctcccaagtgatgggattacaggtgtgagccactgtgcccggctattttgttcattttatgctatatgtactcattccttttcatggttaaataacattccattgtatggatataccacattttgtttctccattcatcattggatggacttttgggtttttctggtttttgactgttaggaatgctgttgtaaacattgatgcatgtactatttaatacaagtttttgtgtgaataggtgttttcctctggatatgtacctaggagtggaattgctgcaccatgtggaaagtctatgtttcaccttttgagaaactgccaaagtattttccaaagtggctataccattttacatttccttccaggaatgtgtgagggttccattttctctatatcctttgtatcaccgtactcctcctccatagaaacagaggcatctttctgtaattacagcatccctgggctaggtaatgggtaaatgaaacagattatgtattttgccctgatttcccatttggaaagatggtggtataatttgatggatct

SEQ ID NO: 115255 - DNA, 1478 bp, Homo sapiens
catactctcctttacagatgaatgccttgatttgtaagggattttccataagactgtgataacatgtttcttgctatttgaaaagggtatttaatgtataaacttttttgtagtttttcttcctggctgaattattagtatctaagggctgagccatgtttttatacatctttgttatagcgcacttctagtagtaagtatttaatggcgtttgatagattgttgaaagaattcttcaataattggtttatttttagattaagtacatattcatgttaaatatgtgttacagtgatttattttttgggggtttgagttgccagtatcttttaagtttattttctacaggcaaaaactctgcccctataatgtgtaattgttttttgaggagatgaagtgatgctggaaaatttaagacagcaaagcatttgtaaagtatacttactatatgcctttcctatgagcttggccagaattatattgaatttaataatccgtgagaatataggtttgagttttgcttttattctggaaagattttattaagtttctttaaagagaaagcattctttactgtttttcttaatttagtttaacattttaaaaatccttttctcacatcattataaaatcagtgttattccaaaatcacaggtagaacatgtacttcctcttttgaagaggggaattggtattcaccatggtggtttacttcctattttgaaagaaactatagaaattctcttttctgaaggattgataaaggtatggttttatttttattttttatgcccccatatcatgttgtatgaagagtttgaaaatgagagaacattgtttataggcaatatgtgtgtttttaacaaggcttaatgaaatgacttaaataatgaacttaatttttatatatgatgttatacttaaataaatcttgaagtgtaggtaaaaaaaaaacatttgtttcctttcttcaagaatgtagtggtggcagggtacagtggctcacacctgtaatcccagcactttggtaggctgaggtaggtggattacctgaggtcgggagttcgagaccagcctgaccaacatggagaaaccccatctctgctaaaaatacaaaattagccagtcgtggtggcaagcacctgcagtcccagctactagggaagctgaggcaggagaatcacttgaacccaggaggtggaggttgcagtgagcggagatcacaccattgtactccagcctggacaacaagagcaaaactctcaaaaacaagaacaaaaccaaagaatgtagtggtaacactattggataccacagaatgttgcagaaggtgtatttaattactaaacccggggttgtaaacttctttctgcatacagaataaaaggattagtttagagaagacaaggaaattgctggttagacttaggaaagagagtttttttaatattctaatttaaaccaaagagcatctgatt

SEQ ID NO: 115256 - DNA, 1380 bp, Homo sapiens
tcgggagatcaagattttgctgttttccagaatatccagctcaaaggtattttttactgccagtgaattagccaatatttcccagaagctgtcatatatttgtaagcataattaacagtaattggcttatgtggaaagccaaaatttttaaaagcctaaattttaggctttaaatttagattaaaagcataaattttcgatccaaaatgataataagtctaaaatttagttttgttatgtcagtgtgatgtcggtttgaaacattattctcacatgttttgcatttttgtgctttgactttaactcttctcaaacttcatgttgtttttaatcatgtttcctttcttagggtttataacttgttataaattttataaaaagagaaattttaagaatatgttttttaccagtttttttcctaaactctgaattttaactatgttcattcagatttcttctggtgaatacattcagatgtctggtcgtgctggaaggagaggaatggatgatagaggaattgtaattcttatggtagatgaaaagatgagcccaacaattggaaaacaattacttaaggtaactacattaagattgtgtacctttaccaagaattccagaaatatacttcaggagccatttcagaattggttgtgtcagtcagacacctaagtgaaatgagttaatatactgaaactatctgggcttgggaagatggaagggtgtgattactcaaaatactaacatcttgtatcctacttcacctaataggtggagagcaactcatgtaatggatagggtgtgaagatctccagagagggcagaaatgtttactttgtcctccaaatttaagaaatctctttatttgacccatccactgcacaagttgttctttacctggtagaacaggaagttctgttctactgataatcaagtgttttgggcaggcaatgagcttcctctacctttgcaagcgcagatagcttaataggttaattcagcaatctgcgtttacactttaccctattgattataaatatcccaatcaaaaaggacacattttaagctttattgcagattagacttttattttgcttgcttagtatttgtgcttcggatggtctaggattttgttttgaagagcttctcaaggaagattggcctggttgccttttttcttcttatccatatagagaaaagtgttaataagataggaaactttaattaaaaacacaaaattaattgccagcttattagctacttaaaagtagctacttcaaaacatgttaagacacacttaggtcagtatctatgaaacagattgtgtgtctaactttttagacttgggaactttgtggagaatttgagatatagtcataatga

SEQ ID NO: 115257 - DNA, 1286 bp, Homo sapiens
attttcacttttttaataggaactgtcctgggtggagtccacatagtcaagtctttgctgtataactttccttttgtatattttatgcaaaacagattatttaaatattttatttaaaaatgcggcattctgtactgaaaaaatatcttctgttattgcttcaaagatgctactcaaacatacattatcatagtgcagaagttgtgagatcttagtagttgttagatcttcagaattatagttttattacagaatattaaagactaaaagacaataaaaattggaaccacattatagaaatgctagcataataagcaataaaataatctattctcaatctattatgttagagtgatttgaagatgcaaattaattttctgacactgaaaattttagtttcttaacattattagaaacattctgtgacacacttgacagtgcttgtactattaaattagaatttataaatataaagttatttctgtgttttctcatccaatggaacatgttgaatccagagagacagttttcatttcataaaataagtatgtattacacagtttgtgtcagtcataatgctaaatgctgagaaaatagttcctatacagatggaacttaaaatttatgggccagtttcttaagaatgaatgaacatcttctgttttgttttttagcctaactctggtgaactggatcctttgtatgtagtagaagtacttctgcgctgtagcaaagagagcttgaaaaattcagctacagaagctgcaaaaccagctaaacctgatgagaaaggagagatgcaggtttgtacataactttctgtcttctgatttcagatattctgtaacttatttgtcatcaccaaagttctccaatgtgatggtaatgaacatactatcatgatttctaaattagaagttttcaaggtattttaaggtatattagtaaagctatctaacgtatcagtaggataattaatgagatttgtttttatttttcttttatcaaattacaacaagataaatcgtgacaaagtgaaagaaaaagtattcagtcattgaaattttacatgaagctggattttgccagggccataaagatttttcattatccttgcttgtgactgagtgattttacagtttgaatccattcatgctgtttatttcccattcccatggaaatagaggcagtcctgatttaggatttttagactttacagtagtgcaaaagtaatacattaatgagatatttaacatttattacaaaatagggtttgtgttagatga

SEQ ID NO: 115258 - DNA, 1016 bp, Homo sapiens
tctttgaaatacttcttcatttctgcccatccagaacttacatgaatctttcttgacttcctaaacctgttaacaagagtctttcattcttagtactatagtacctttatgtattaatatttttgaactgccaaatatctgagaccataaaaatgagtaaagtgtgcattctgtattgaggggagctcttatttttatgtaccatttatttacctgttatttagaagtttgaactggtttttattttttaaatacagtctctaataagaaaagcttcagtgtgggagaatgcttcacggtgattattatgtacttcttatacctgttacataccataaatgcaacttcctctttagggatccaagtttaggaaatagtagaatatgaacatgtgcaaatttaactgtaatactgtataactttttggtcataggttgtcccagttttggtgcatctcctgtctgctatcagcagtgttaggctttacattcctaaagaccttcggccggtggacaatagacagagtgttttaaaatcaatacaggtatgtgttaatttcataagttaagtataaattttatgtaaatacaggtagtgtttataaagaggcaactgaaatgcttttaaatatattgctttctttcagaatacctataaatactaccaatagtgacaattatttttcataaaaataaaggcagcagaccttcatgtggatttgtactctctttgaatctaccaacaaagtgagttagtaaaggaggactcacaaggaaaaccattctgctttattcattatgagtgaaagctatagactgtattacaagttttatgtataaaatcatgtactgacaggacatttaaccattttttaatatagttaataaatacatgaaattgttttattttcaatagggaaaattgagattttgtagtaaatttaatttcctagtagaaaaaaggtgcagtggttcatgcctgtaatcccagctctctgggatgccacagcacaaagg

SEQ ID NO: 115259 - DNA, 1010 bp, Homo sapiens
accgcgcctggccctcaggactttttaaaaagtctatactttacaagtcagtagtgccctccctaggcatcaacaccaaggaaataatctgaaaacagtttaaacatagatgctcaatacaagattacttttgatggcaagaagttacaacaatgtaaatatacaataatgaatttagcaataagttgtgccacgttcaggactatgatcaaattgtgacttgtagatttattaacaaatcataatacatctgtaaatcatagtatagcgttgaaaaagagttttcaaaaataaatgcaatggaaaaatgccctataatttaaattggcaaaagacaaaattatatatgtagtatactttttatgtccatgtgcatagaaaaaaagggaaacactgatttggtttggtcttactaattttgactataagatgaaaatgaattttacatatttttttcaggaagttcagaaacgttttcctgacggcatccccttattagaccctattgatgatatgggcattcaagatcaagggctgaaaaaagtcattcagaaagtagaagcttttgagcatcgaatgtattctcatccacttcacaatgatccaaatttggaaactgtgtatacgctttgtgaaaaaaaagcacaggtatggcagaaatttggtttttatagtagaattctatatgtttcactgaataaatatgtgtttgtcattttcttatcctgttggtttaattggctaaaacaggaaaatgtgagctatcttttaaataaactgtcagctctgaacctgtcagctctcatcagcaagacaagataaagttcattttgctatagtttgatatttcacataggatgttctgttttttcttcttttttaaatttgagatataatttacacagcatagcattcacccttttaaaatgtccaactcactggtttttagtgtattcacagatacttgcaaccatcaccactatgtaacttcagaacattcttctcaccct

SEQ ID NO: 115260 - DNA, 1004 bp, Homo sapiens
atttaaattttttagtagccacattttaaaaaagaaagaaaaaaccagtggcattaacttcagtaatatttttatttaacccattatatctaaaatatttcacgtatttttatattcaaaatacaaacattactcaagaaaaaatgtcttaaatattggactctcttctaccttctaagctttataagcctcacagttattagcacgatgctttgctctgctcacataggcatcctcagtcacttcagtcaaagaaaccctaaaaaacaatggtttgttccttttactctggtaggcctgataagtcatgctaggtagcatagcattcattgtctagcttggaaagcattgcttcctatgacatggcattgtgactacacatctgttcatagaaatataaataatcactaagagcttgcatctagggtctgataccctgggtttgaaccccatctttatcactcagtagccctgttcacagcaatataaataattgaaaagagcttggattctagggtctgctagcctggctttgaactccatctttatcactcagtagctctgtattcttgaccaatttacttagtaatctctccgtgcctcagttttctcatctgtaaaatgcagatttaatattagttccctaccttttaggattgctataagaatgaaataatgtaaagcactagaaatagaggacattggtagtctctgaataaatatcagttgctgatcaccttcataatttttcctccttagtagaagtttaataaacagtctaaaaaattccattatcttcggatttcaacttatcaaaacttttctgtcggtgtttttctgaaccaccacttcaggataccattgttttttgttcttgtactactgtatgcttgtcatagtcagaaaatatgtaatatttactgattaactaaattttaaaacttatctactctaaaggatgacatcaaggtgatacattttcattttaaggtttcatttatgtt

SEQ ID NO: 115261 - DNA, 2482 bp, Homo sapiens
agctgattttttgtatgtgtgtttttagtacagacggagtttcaccatgttggccaggaacctcgtgatccacccacctcagcctcccaaagtgctgggattacaggtgtgagccattgcgcccggcctctgttctctgtctcaagctttttacactttctaacatctgcttgctctgcctcaaatttttcaaatggacattttgtattttccatgtacttaatattttaggtagtatttaataactttacagatacatcattactcttgtgtaatgttccgggaatgtatctaagaagctccagtttccccagtctccccagcactgaagctttaacccagaagtatactgtaagatgttctttaaaaatattttttgtttgatttcatgaataaatctccttgtacattgttcactttattattgaactttctttatactttcatgtgctttagattgcaatagatattaaatctgcaaagcgagaactgaagaaagcaagaacagtcctacaaatggatgaactcaaatgtcgcaaacgtgttttaagaaggttgggatttgctacttcttctgatgtaatagagatgaaaggacgagtggcttgtgagataagcaggtaaaatctggttattgttctagaaagttcattttttttttcatttttaattttaatttttgtttattttttttgagatggagtctcactgttgcccaggctggagtgcactggcgcaatctcagctcactgcaactccgcctcgcagttttaagtgattttaaaaataaccattatctttaggaaaaaagagctttcttaaaaatataaagtttgtacaatatcttccacactaaatacagttttgaaccatgaaattgagaaattagaaaaatcttagatctcagtaattaacacaagcgctcctagcatttgtatgtatttcctttgactttttttaatgccttgtgggatttttacataatcttagcttatatataattttgtatactttttaaaaattattaacattttcccaccttgaaacttagcctagtaaccattatcttgttacgtgcatagcaaattgtaatgagattttgggctaataataggattttacaacagaacttattataagccacagattaaaactggttatattattttctgtttcagtaatcttttgtcacaaatgacctcaaaactaaattatttacaacatcaacagtgactttatcctcttattgtttttatgggtcagaaattcaggaagagctcatttggatggttctggctctgtcccccaggattgccgtcagacaggtggttaagctgaaacagtaggagtccggagcggctggggaatgttaggacctctctctctctgttagagcttctccatgtggtctctccatgtgggctggtttgggcttcttcacagtatggcagcagcctcaggatgcttacatggtagctgaaggctccagtgtgagtcttctagctggctaaggttgccttttctgacctagctttaccttttgtaacctagctttgttatcatacaccatcatttccaccacattctcttgattacaggtgagtcataaaccctcctggattcaagtgggggataattagattccaactcttgatggggaagtggctattgttcagtatggctttctgtgataattggattgttctgtgtctacactgttcagtatagtagccactatttagcatttgatgtgtgcttagacaaaggaactgaattttataatttatatcattttaattgaaattgaaatttccacgtatgcacatggcagtctttatagatcagtgcaattctagaagaatgtggtataggagatgctgttgtggccatctttagaaaatacaatttatgatactgttctaaaaaatgtgttcgttatttcccaccacgaggaatgtctcctgccttaggagccagcttgcctctgtcctccttaactggaaagtcataaactggtagctcaagcaatatccagtctgaagatatatcttgttttgtccatatagtgatgatcataattctcagtgaatatataaaagacacttttgaaacagttttttatgtactcagcatggccaggatggacaggactagagaattacaggccttgtaaatgatttcagactttcttggtaaaaatgtaattatatcgttcatctgtccagatgttacagactcagatgtcttcatagaaccaggagactgtggtgaacaggacaactcttagccaccaaaagggggcagtgactacccagccctagttagttgttatcacaggataatgtgctattggattttaattaataacatatccaggattaaatctaaactgcagtactggtctactgatttatatgctaatgttattgggattatttccttctaataattacctgttttacaattaatatagaaattaatt

SEQ ID NO: 115262 - DNA, 1041 bp, Homo sapiens
aatgtgtatccctcattatttttggcctcaattactgcagttgccctcctgattattcgttgcctcccttcttgagttttcaaaacccaaagcacaaatctggtatgtcgttcctctttccttcttgagatgggattttgctctgttgcccaggctggggtgcagtggtgcaatctcggctcaccgcagcctcaacttgccaggctcaagtgatcttcctgcctcagtctcccaagaacctgggactgtaagtgtgtgccatcaagcctggctaatttcttttttaagtttctgtagagatagggtcttgctatgttgcccaggctggtcttgaactcctgtaattaagcagtccgcccaccttaccacccaaattgctgggattacaggtgtgagccacttcacccagcacccagcccctttgtgccattctatttggtaaaagtccctcagtgattccttattgcttttagaatagattccataatttagtatattgttactctccctctccagcagtctgttgccacaccccacacatgcttttccttttgcttcatatgacctttcacccccaccccatatcctgcgattcttgcatatttttgcaaagaacttcgaaacttgctctgaacttcttcaatctggttttaggctcctcacctttttttcctcataacacttgtataaatcaattattagagcactctgttaaaccactgttctgtgattatcaccttacttgtctgcccccaatgttagactgtagcttcttgaaatagtctttcctcgtttgtattgttgcactctttgcttgacttaactcttaagcttaacactagagacccaaatttagtttttgacttttatttataaatattttaactgttagtaaagattataatagttcatggctttattcttttttaaagactttgcaaaaaataaaggcaaagtttacttttttaataatacagtacagttattgtatgggtcaattgaaccctgattatagaagtctagaaacatcatctttgtagt

SEQ ID NO: 115263 - DNA, 1001 bp, Homo sapiens
gatataataacttctattttaaaatgtatttataaaactgtctctacattttaaaaataatatttaaaaggttatgtaaatctttataatataaagatcaagtgcatacaaaaatttattaagcacccaatgtgggcagtgtacaggtctaagcaccagagatgcagcagaaatgtttgctttcctgatacttacatgttagtggatgaagataaagaaatacagtacacatacattctgtcaaataggggtgaaggtttttggagaaaagtgagaagaatcaaagatcactggggagatggtgttactattttaaataagatgattagaaaaggcctcactaatgaagtgaaacttatattgaggcctataggagagatgagggaacaaactgtacatacctggtgggagaacattgttaaaatcacaattaacctcctcacatcaggactggtgccttccacctatagtgaatagcagagaggaatgtgatgagtagctgttgaccatgaatagacataatatcaaagacatttcgcagtcttgggttctttattaaactgagatgttaaggtcattctggctattttgcttttttgccattcatcaataatttttggttttagcagcaataatatggaatctggttcttgatttattatacatatatacatgttgcaaatcaaaatcaagtcctttataagtactggtgcttaaaataaaggcagatatgtcgcaactagcctacaattgctttaaaaaaaaaaaattagcgatcgggcacagtggctcatgcctgtaatcccagcactttaggaggctgaggcgggcagatcatgaggtcaggagtcgacaccagtctgaccaacatggtgaaaccccgtctctactaaaaatacaaaaattagctgggcgtggtggcactcctgtaatcccagctactcaggaggctgaggcaggggaatcgcttgaacccgggaggtggaggttgcagtgagccg

SEQ ID NO: 115264 - DNA, 1029 bp, Homo sapiens
atgagatggtatggatggtgtccagatgcctcactaggccacactcagggtccttgaatagctgcagtttgccaggcttttctgcattgtcgtggtggtccttcccttgttgctgctgcctgagagatactgcctggttcttacagacacagattatgtcatctttgcagccttcacccaaagttgctccctccttctagggcattttgttttcctacttaataccaagtgtcagcatgttagtaataaacaggtgtctctaccattagtcaaaggtgggagttaagcctttcatctttgtagctttctccagtacctaaccatgatttacttcatgggaagtccctcaaagtactattaattatcgtgtgttctcctgccttgcctcttaacaaaaattctgctgttcctgattatttccattttaccagtgttttgttccttttctatccaggcagcataattcgttgtatgaggcgcctggaagaattgcttcgacaaatgtgtcaagcagcaaaagccattggaaacactgagctggaaaataaatttgcagaaggtcagtatcaaatggataagctgtttctaatttagacaaatttggtgaagcaaatcttgagccctggaccacaacctaggaggacgttttgagatgttcttcactgcattgtcatggagagctatctactagtgtttctataaaatttagtgtgttgggggaaaagttgagattttatatatacatgcatttacgtatattaattgtacgctaactacatgccaggcattgttttaagcactaggggatatagtgaacaaaaagacacccctgccttcatggagtttacattctagtgtggggagatagacaataagtcaacaattaaatttatcagatggtgataagtctgtaagataaaaacaaagcagaaaagacaatagaattggcagatggatatgatggtctagggcctccacagggaaggtggcagttaaggcctttggtgtatgcttgatgtacgtgaacac

SEQ ID NO: 115265 - DNA, 1102 bp, Homo sapiens
gtggtcttgaaagtttaaaccttactttcttttctcttaggaatcaccaaaatcaagagagatattgtgtttgctgccagcctctacttgtagagtcagctaaaggaatgtgagattttaaattattgaccacctgtttgattacagttgactacaaatgcctgcaagtgtggatttggttctcccatacattttaatatgtattatatttaaatcaaacatcattcatagaaagcatattacatacatgtttatacataagcattacatttttttaataaaaatgtatacaggtggggcactgttttggtggaaggcttggagtttttttaatgagtttagagctattagataaccactgagttaaaggtaactatgtacacacaaagtgtgcatccaagaggcatagcagcagcagaagtctttaaaggcttgtacaccaggaagaaagatgcatcctcttgccttgtggcaatcattttcctttagaaaacaggccagcttcacctgggcaccctgctgcctttcaaggctggtgattgctcggatagtgattcccagttgttggtgtttcatgcagagttgtatgagagtcctcctcttttctttctttaaaagaagttctttctttgaagaaatccgatacatatacagcctacagtgcaaaatatttaatggtataatttagatcaagttaaaaactacatacaaagttgtgatcaacagcatcctaagataaatataaacaaaaggatatactttgaggtgtacagattaagcatataaaaaattagagactaactgggattttttaaagattattccaaattaagagttgctttgttatgccttcagcaaatagcttcattttgccaatactgaataaaagagttatttctacatgtgaattagttttttcaagtcataatcccctaaaaaaactatttctagccagagcctttcacaataaaaatactaagattttacaaaactactaagttttagaaagagcaacctagtttttaacctggtgtgtatcctgaagtgacttttaataacattgagattcttgcccactgcatagtcttctcctcagctgggg

SEQ ID NO: 115266 - DNA, 1073 bp, Homo sapiens
tccttaaagaaatggggcgttgctctgttgcccagactggagtgcagtggtggtgtagtcatactcactgcagcctcaaactcctgggctcaagcaatctttccatgtcagtttcccaagtagctgggactataggtacatgtcactgagcccagctaattggtttttttttttttttatagagatgggggtctcactgtgttgcccaggctggtctcaaactcctcgtctcaagtaacccgcctgcattggcctcccaaagtgctgggattacagacatgcgccaccatgcctgacccagtatcgtggttagttctgagtcttgggataaagtgctagcattctgggcacaggttgccattgctctgggcctatctagggactatttcattaattaaccaaagagagctcttctaccctcaaattgtttaacaaggcaactgagactaaataatctgtatttgcaagtaatataggttgtagtttagttatgatccagccaagaagtgtattctttcaacagtacttgtatcccctttaagttaagttctatgagttttctgtacactaatcggacctaagaaattcccctttctcatgtcagtctgcctttgactttgggtgcatctctgaaggttttatgtagaaatgattctttttagggagtctgctctcattaaaaaaaaaaaaaaaaagaaaactacctaatttctatccaataacaatataatttataacattccctttaaaattctgttcaataatatatgactcgtagactaaattaaatgcagtccttagaaaacaatatacatagctctccccatggacactgcctatttaaaatagatgacacaaatccattcccagctctctgggcactgccatgggtgttcagtcaccaaaagctggcaaagacccagggcttatctaattttatcaagtacttagtataaaccatctagttctaaaagagcacaccagctgtttaactgagtctgactcatcagcaagtttaagaaccactggctttctgcagaatccttatttttgtttgttgttcaagctgtgaa

SEQ ID NO: 115267 - DNA, 1359 bp, Homo sapiens
tagatacaggaatttcataacaggcggtgatataaacaatctggggttacagcctcaatagaagggtctcaggaaaagtattttaacactcctcactgtattgaaagaaaatacagactcataccatggctgttctcctgaataatcaaataaatttggaatctctggcattcagccaagttcacggggagtcactaagcatataaactggctatgtgcaaagcagccctgccctgagctcccgcaggcctgggaggttttcactgatgctgacactctcttggcacagttaagtgtgcagggctgcactggctgccagagaagaacaatggtcagggtgttttaagagccatttttaactagaagttaatttctgggtgtcaggaattgacagagaagttttggctatcaaagactgtcctaggagaggatttaaatgactacgtctctacccaaatctgagactgactcatgaagccaaggtgcccagagaaacaagatgagtcattgctcaaggaattcgggggtggggcttagaggttaaatgttgtacataggccaggcgcggtggctcacgcctgtaatcccaacacactgggagcccgaggcaggcggatcacgaggtcaggagattgggaccatcctggctaacacggtaaaaccctgtctctactaaagatacaaaaaattagccgggcgtggtggcgggcgcctgtagtcccagctactctggaggctgaggcaggagaatggcgtgaacccgggaggtggagcttgcagtgagccgagatcgcgccactgcactccagcctgggtgagagagcaagactccgtctaaaaaaaaaaaaaaaagttgtacataaatgtaaaaagcaaggatctgtgtattcagggctgaaataaaagctggggcctacatccacatcaagcaaatatttccactacctagagtcagtaaaatgcagtgcatggttgctctggcctgctttcttctccagaaaggtcttggtctacaacaaatctatttatctaggcttctttttttgccattataactttacatctgttaaatcaaactaaaatctgtcctgaaaaccccctgctcacatacttgagttcttctgtacaaagaacaacctaatttggtaagtaagcaaactgggagcctgactcaggaatgtgcttctgtaacagcagctgagtctcagccagtccctgcagccatatttcaaccactcacagccattcaaaccacgctcaaataaagctccaaggccgagctgtaaccaatccggcagtttctgcacctcgcttccattttctgtactcactttcctttttctgtccataaattctccc

SEQ ID NO: 115268 - DNA, 1078 bp, Homo sapiens
tactaaaaaacaaacaaacaaaaaacaaaaaaaaacccccaaaaaaaccaacaaaccagcttggcatggtggtgcgtgcctgtggtcccagctgctcaagaagctgaagcgggaggatagcttgagcccaggagatcaaggctgcacttagctatgatcgcaccatcgcactctagcctgggtaacagaatgagaccctgtctcaaaaaaaaaaaaaaaagaaactttaagttcagattcctttttatagcagctttcagcctgctatagacaatacagaaatgagtggataaagttttatttagatactctgatagcttagccagtgacaatgacctatccaaatatggaatgctaaaatgttttctttttggaagcaaagcccatgaaaaattggtttggaagtagcgttaaaaacctggtgattaaatgacaacaagaacgtgagaagagatttttccaaaatccatttagtgtgtttggacagaaacaaaggaaagataactctttgttaaattggttaatagaggatttgaacactttgtttgctgtagacaaaacatctttatcttaaaactgtaatctttctaacttccgttgcatgcattgctgcatttccttttttacatgtgctctcatttattttcatggcaaatgcatttttagacagagtctgtgggataattattgccattaattagttttgatatttcttttttaatgatattttcatttattcccttttgctagctggattgccttttgcaattcttacttcaaggcatacccccttccaacgaggagtattctgtaatgatgagtccatcaagtacccttacaaagaagacaccataccttatgcgttattaggtggaataatcattccattcagtattatcgttgtaagttaaatccacttttccaagtttataacttttgggcacttggcttaattttctgttactcttttaatgcttaaatgtgtaatcctccaaaaacaatgtatgctttttaaacctttaattgatgctttatttgatcaagagaatctcagctattttaagtggagtcaaaaaat

SEQ ID NO: 115269 - DNA, 1413 bp, Homo sapiens
tcagcctttcaacgtgttgggtttataggtgtgacccaccgtactcagcctactttgagttcttatcgtgaacacaacatgtattatactgagtgaggtttttaaaggacaggttccccttctcccaatcatattctaacctgttaacctagccagatcacttgtctccatgggaggccgtatattccctaactctggaagagatagcttgtgttggaatcctggttccaccacttcctagtttcagcaatgttcctcatttctctaagcttcaacaacgttatatgaaaaaagcaggtagtgataatacctacttcacagaggtgaggtaaggattgagttaatctatgtggcctaattcccagcatgtgcaagcatgcaatacatgttggctacaaaatgcgtgtaccttgaaaacttcttgctcattccctttgtgctcttgttgatgcaattctcatgcttccctgcctccctctaccactaaatggtctccctgtgctcctccctattgcttgtgttttacctgtcatttcaccttcaactcagttgcctcttctttaatagtcttttctaactcctccagtctgtattgacctctgaattcctataggtccttctatgccattttagtaattatattcctatttttatggcatatttctgccttttatggtatttcttcttaactttacatgcaataaaagagttgtggaattaccatctcaatcaagatacagaacagtttcatcattttccccaaaaaatctaccttgggatttgtttttaaacaatttactgggtatacattatttttctacatatacaatttaggttcttgaatttagtattggttttatacaaatttgtcttccctaagtatggcttagtattgcgcatatagtgagtgagtttgtataaaacaaagcctaaaagcatggtaaatttgaatatcttaagaagccactaatttaaattatttaactttggtctttcagggtcattttatttaggtgcaaaatttcaactgaaattattttggtataacttgttaaaagtggttttggagccttgccagggctaataaaaccgggtgtttgtttgtctttggaaaacaaaaggctttttctttctatttttattactgaatatatacttgtggttttatcattttctttctctctctttttctttcttttctttcttttttttttttttttcctgagattgagtcttgctctgttggccaggctggagtgcagtggcacaatcttgactcactgcaacctctgtcccctgggttcaagcgattctcctgcttcagtctgcccagtagctgggactacaggtgtataccaccatgcctggctaatttttgtgttgttagtagagacggggtttcatcatattggc

SEQ ID NO: 115270 - DNA, 1025 bp, Homo sapiens
ttttggaatagtgatacctgtttactctggagggatggacattcctctgtgtgtgtgtgtgtgtaatacatatgaacaataggggacataattttgacatatttaacttgaagaaaggcatgcttagacaatgacaacccgatattgaacaatgctcaatactaagtttctttatgaagataccattgttgtattagtggagacggtataatatattctcagtaaagacctcagtctttactcagttctcatgctccttgatgtcttagcatttgatatattagatttgccatgtactagatactctgagctttggtttttgtatcacaacattgtcctacttctctattgttcattcattcttttgtttaaagaatggccagactatgctgctgaacaagacagacacagcccttgccccttggagcctgtgagcatcctttcttcctctcctatagcctcttttcatgttttctctgtggatattagtccttagctaattgctttgtttcttttagtcttgatttgccttctgtaagaactgttttattctcctagcttaagttgcaaattctaatgccaacaacttacacatctttctctacttctgatctttaccctgaattttattcacttagccatttaatacattttttttttttttttttggagacagagttttgctcttgttgcccaggctggagtgcaatggcgccatctcagctcaccacaacctctgcctcccgggttcaagcgattctactgcctcagcctcctgagtagctgggattttgggtgcccgccaccatgcccggctatttttttttttttttgtattttttttagtagagacagggtttcgccatgttggccaggctggtctcgaactcctgacctcgtgatctgccagcctttgcctcccaaagtgctaggattgcaggcgtgagccactgcgcctggccaataaatttttgttcagatctgtgtgcctggtacaaaggatacaaaaatggtaaaggtagcct

SEQ ID NO: 115271 - DNA, 1260 bp, Homo sapiens
tgtgtttttttgtttatttgtttgtttgttttttttgagacggagtcttgcttttgttgtccaggctggagtgcaatggcatgatctcagctcactgcaacctctgcctcctgggttcaagtgattgttctgtcaaagcctcctgagtagctgggattacaggcatccgcctctgtgcccagctaatttttgtatttttagtagagatggggttttgccatgttggccaggctggtctcaaactcctgacgttgtgatccgcccgcctcggcctcccaacgtgctggggttacaggggtgagccaccatgcctggcctgctttgtgttttaacagagtaagaaaatagacttttcctttgctctagtttcaatcttcttaatataggtaggactttttcagataaatttatgattaattacaaggaaaaggatagtatggatgatttcaggtaagttataggcataatttcaagaaacaaaaaatgtttttattgtgatagagcatctcaaacacctttagaatctacctctttttcctgttccccccgttatttctttgtttcaggcccttaacatctctcatatacactggtatttcttgcctctggccttgccgtctattctgtcttcacactgcttttttctttacacagctcttttcacagccccctcagttagagtacagattggattgtgtgtctccctgctacccacagaataaaacttcaaatgtgatgattttggtcttttgttttattataaaatattcaaacatggaagtatatacagtagaaaataagttttctccctgatttgatttgtattagtaccatctctgctatttagcccccactgttaaatttgactggcttaaaaaaaataccatctctgaagataactacttagaagttggtcatatgtttttccagacttcccaatgtttatttatatataaacataaataattttaggccaggcgtggtggctcacgcctgtaatcccaagactttgggaggctgaggcagggggttcatgaggtcaggagatcaagaccatcctggctaacacggtgaaaccccgtctctactaaaaatacaaaaaattagctgggcgtggtggcgggcgcctgtagtcccagctactcgggaggctgaggtaggagaatggtgtgaacccgggaagtggagcttgtagtgagccgagattgcgccactgcactccagcctgggtgacagagcgagactctgtctcaaaaaaaa

SEQ ID NO: 115272 - DNA, 1082 bp, Homo sapiens
ccatgagggagtggaaggaattaatgttgttcttggccagttggcactgttttcttgtgcctttctgggaagggaacaacaggtgagaaggtttgctttttgtttttgttagtgtataaataaataggttaacttgttttttatttgtgtggaaatgtgagagtccatagtgaagtaacttgccctaatagctcgtgattttttaaaagctcattaaatatatacacaaatttattttaagtgtcttaatgaactaagctactccaaggttgaggatattgtaggcaattactgacgtaaaactacaaatgtaaaaaccatctttggtaagtgtcacttatatcctatatcccaactgctttttctcccttttatcctaattttaaaataaaaaagaaaagataacgaagaactttttataataaaaccatgtcagccacagagagatggtgactgtaagctaagtgaccagaatgtaggtgcctctaaaagttgagggtgcactgttctttgaattcttgcctgttaacacttttcataacatctctgtgaatcacactcaaatatactgtacagtgctatcactgatacctctcacctgccaccaggctctgccccttccctaccaataccttgcacaaattcattgtcctgaagcacagctttcttgctcaagaaccagtgttgatttttcatttcttattgaaacatacacaaattgtttacctgaaattgaaaaccttcatgctgtagttttgctttgcccattcacatttatttctctttgttactcattcccctctacgttactttagtgaaatcatcctgttttttagttgtctaacagcagattgagttcagttaccaatttttaaattcagttctaattccatttcacattgtagttgttttgactagtttttttctactctattaaaagctctagttgttctctgctctcctcacttatctgactctgaaatcttctaaatggtacccactttatttagaacgttttagggtcaaataagtacaggttggaatcctgagtgcaccacttaactattgaggctgacagccag

SEQ ID NO: 115273 - DNA, 1052 bp, Homo sapiens
ggcggagcttgcagtgagcagagatcgcgccactgcactccagcctgggcgacacagctagactccatctcaaaaaaaaaaaaaaaaaaaaaaaaaaaaaaactcaacacgtgttaaatcgctaaagtctgaagagcccagaaaagaaaataaatatcattagtaatattctcaccatcatccaaagattaccccttttaacattttggttgcttatctttccagtgctttttaatgtccatatacccacatttttttaaacccatgctttaaaagaaaaaaaaacttgtgatattactgcatgtatacatatattttgtaattttcaatataattgtctgaaattttaatggttatatggtatttcactgtatgtatttggtagaagtcactttgcccccatttttggatatttaggttatttgcaattgtgctattatgctgtgtacaacgtccttgtggaaactttggcaaaccttgggttgtccatctcaaactctctcattgtactctgtccttttcagcctgcttctctctcttttccagtaactcctttaacaacaagatcagatcaggtggacagattattcttcaaacaatttactattaggcaatgaatatgctggtttctgtgaattctgggattaaagagatacatagacacattttatttgcagagataaagaattacaataataaactaagtgttgtgataggtttatatatgtataaggtccatgggggctcggaaagagagcaggggttgtgagggcagtaggcagggaagaaagatcagggagtaagcatttattaatcctcttaatgtgccaggcactaagttaggcacattactaggctcttagtttgcagcagttctgggaggtatgtacacagtattattcttacttaccagatgaggaaactgagctcagacaggtaagtaatttgcccaagctcccacaagtagtaactgggagaaagccagaagtaaacccagccagatatacttgactacccaactctgtccagtactccaccctggcacaccaaag

SEQ ID NO: 115274 - DNA, 1439 bp, Homo sapiens
tctgcctgccttggcctaccaaagtgctgggattataggcatgagccatgtgcctggccatttaaaattttttgtttgtatttttgattttcgaattttttttctacacatattttgaacactgagataactaattgtataccaaaatgactgaaatgaagtcagtctgatttccgtaagtttgattgctaaagcagtctccttaaaggtgttaaaatgtgctctcaatccccaccctacacaacatctgtctcccaggctgaagtgcagtggcacaaacatggctcactgtagccttgacctcctatgtttaagcattcctcacacttcagcctcctgagtagctggaaccacagatgtgcactgccatgcttggctaatttttaaaatttttgtcgagtcctggtctcactgtgttgtccaggctgggctcaggagatcctctcacctctgcctcccaaagtgctaggattacaggcattagccaccactcctagcctatgtatgaacctttacggaagttgattaccctagaatttttataagagcattagaatttgccagctttcttcaagagttaatataggccgggcgcagtggctcatgcctgtaatcccagcactttgggaggccaaggcgggcggatcacctggggttaggagttcgagaccagcctggacaacatggtgaaaccctgtctctactaaaaaaagaaaaaaaatacaaaaattagccaggtgtggtggtacctgcctgtagtcccagataccctggaagctgaggcaggagaatcgcttgaaccctggaggcagaggttgcagttagctgagatcatgccactgtacctccagcatgggtgacaaagcaagactctgtcttaaaaaaaaaggagtcattatagtagtaatactatagtaaacacatacttgatattctttggaatatgggccttactatgaaataggagaaattatttctttcccagttactaataagggagacttcattggttaagggaattttgtgggtagaattgctaagactagaaatctcattgttggttcaaagagagaaataagttaaccacgtgttctcacctgaatataggatgctttgctttacaagcttaaataatacccggacaaaactctacaggtcacaagttctttaaagacttaataaactctgtagaaactatacttcaaaggggaaccttctccttgattcactatcctgccttgtcttctgaaatttattggtttttgacaagcgtttgaagaaagaccactaaaatacagtgttgttaatatttggtgaaatgttcttgtacatacatctgttatagattttccaagttaaaaattacttttccattagaggagctccccataccttgtttctttccccaaaggggtgtgtgtgtgtgtgtgtgtagttta

SEQ ID NO: 115275 - DNA, 1024 bp, Homo sapiens
cctttagaaaataacaagcacaggctagcaggatcatctctgaggaggataggaggaggacctgttagggatatcagctgaaacatgaatagtctgggatcatagttttttgtgtttcctatgatgtgccagatgaaggaagaagaatcttgccagaaggagaaatgtcatttttagaacaatggtataggaatcgttgaccacccttacagaaccctcattgctgagaatttgatatattgttttctaactatcaccaagtatagcggaaagagtctgggattggagcctggtaatactgctttgctattttcttgtgttaggtcgcacagttgattatttagtcctaaagagcttcaatttcttcatttgtataatggagcgaatactgtctacgtcacggatttgttaggattaaatgacaatctgtgtatataaagtagcaggtatttagtaggcactcaataagctgatgtctacctgttttcttgcttctcatggtaacagttgtttattgtgtagtttcagcattataagtttgctcttagcctcaaaggaatcatttgtgggaatccttccttcttcatcttatcttttgtgtaaaataacttgagtgatacaagcatacatttctggggaaatggaaatattatttgctactgcaataataaccaataaataagtattttgccagtcgtttttggcatgtatgccttatatttgtgtgcctttaaaaaaaaagcgtgtgtgttttaaacaaagcttactaatttagatatgccaatttggtaacttcctgccagagtaagagtttttatgttttccttctgagacacaccttagtataactttattttagtttctgggccattgccatttggcataacttcaaactagatgtgatggacccacataaatacttttaagatttaaaattttttttatggtggggggatatgaactttcaaaaccagctgaggtgtcaggtctggattttatttggttgtttaattttttttttttt

SEQ ID NO: 115276 - DNA, 1081 bp, Homo sapiens
gagtgacctttggtaatgcattctagcagatatagttagaatctcgtgatttagtcctcagttgtcactgcttggaaatgtttcctgagtctttttcagggtggggtgtccaggaaaatgacatataggaaacgtgtagcagatgagcccttcagttaattggcagcttgtcacggcagattctgccttgccttttggttcatttgcatcagtagtaggagagatgggtttgctgcttggtgctggagaggtaaatgagtagagaagaaagctattatctattgaatgcctagtatatgcgtttggtaaatgtttcacatgaactcatgtaatcatcacaaaactctgaggtacatagtattagcctcattttatgccctacctaccactggagataccaaaaataggtatgcatttttcgatcaagggaaaaatataacccatggatttttactagcttattacttatggtagaagacagactcataggaaaaatgataaaactgtataatgttattgagtgcctgttagcactgagattactaagaatgagtgagacaaggtctccatcctcaaaaggtacacagagctttggaaggtgagataggcaggtattttaatcaagttttttgttttttgttttttgtttttttttgagacagagtctcgctctgttgcccaggctgagtgcagtagcatgatcacagctcactgcagccttgacctcccagactcaagtgattttcccacctcagcctccacgagtggcaaggactgcaggtgtgcaccaccatgcctggccaattttttttttttttttgagacagagtcttgctctgtcacccaggctggtgtgcagtggcgcaatctcggctcactgcagctctgccacctggattccagcgatcttcctgcctcagcctcccgagtagctgggattacaggtatgtgccaccacgcctggctaatttttgtatttttagtagagacagagtttcaccatgttggccagactggtctcgaactcctgacctcaagtgatttgcccacctcagcctcccagaatgctgagattacaggc

SEQ ID NO: 115277 - DNA, 1190 bp, Homo sapiens
cttcccttttctcgtaacatttatttgttcattcactcatattcagtacacatttgttaactgtatcataggtgctgggcagtgtgttagacactgaagataaaaataagtaaacaaataggacacggtgcctatcctgaccacttgctgtttcttctatttaactttttttttttttttttttttttgagatggaatctcgctctgtcgcccaggctggagtacagtggcccgatcttggctcactgcaagctccgcctcccaggttcacgccattctcctgcctcagcctcccaagtagctgggactacatatgtgcgccaccacgcccagctaattttttgtatttttagtagagacagggtttcaccgtgttagccaggatggtctcgatctcctgacctcgtgatccgcccacctcggcctcccaaagtgctgggattacaggcgtgagccaccgtgcctggcctcttctatttaacttctattaggaaacttattttgcttctgatgaaagtttacttgtttttctgtttgttgtcgttgttgttgtttttctctattctagtcacagagagagggaaggaatctcaaaaaacgaacaaaaatttgtcaaactggcatattcttgggtcagtctagaatcctattgcaaggctttttctttctttaaatgggtagtttggaacaaaagcagaggcttggaggaaattgctgctatttggctctagttggttttattcagctgagttttagcttaaatttaccttacttggaataaaatatagaaatgttcagaaaacgttccccttatagattttatgaaatgtaaattcttcctttatattctctttgaattacatcctttggaaactcaagaatgtgctatggatctttgttaatctctttctcatttagtcatttttggctgagctctaccaaactttccaatgtgttactcagtttggggaattattctgattcttttggttaagaaatttaaggttaaaattgtcaatgtttgcctatttttttttttaaaaaaagaagttggcagcaaaagtcactaaactcccagattttgagtgaactgattaacatgtaatttcagtttttatggaaagaaatttggaatgttgtctacttcctcctaatttaggtgccttaattcaacatttgaaatggaaaca

SEQ ID NO: 115278 - DNA, 1399 bp, Homo sapiens
ttctcagatataatgtgtgaccgtgatacagtgagaaagattctaccaaccactgtttcactactttttagtcaaaattgggtatgttcttagtattcattagtgagaatcataaagtattttgtagaaggcccaaatcacagaataaaggactaagagtggattcactgacattccatactaatatacattgtttatgctttctttaaaataactaaaagaacataaaagagaatctcagtagtttgctgctaatatatacatatattgtataaaaaggtatattttggttttgttctacactgaacattttttaaacttggtttaataaaaatgttaattttggaaaaggcgcgatgttttagcccagtgtattaaaccatatcctgaatacaacttattagtgtttaattgctaagggtcatttcagattttagccactatggcattaggctgccgattaatggacactgagtccattaatttattcaatgcatattgatggaaggctagcttcgtggccagtaccatgttaggtactagggatacaaagatgaataagataatccctgccctgaagggctcagagtctaatgatgaagaaataaacaagtggttataatacatcatgataagtacgataatggaggtttggaatatgttccctttgagcaaagacgagagccttgtcttagatctgctccattgtagataaatgatttgtctgtttactcttagagacgcagaaaggtcagaagttacctggaattactcgtagctgctgctgcttttttttttcttttccaacttgatatagggcagtaggaacccaagtaagtaccaatgtttatgacttatttgcgggcagtcccacaatatctagaagatttagctggaactgacaaaactttgattccttatacctgtgttttgctgtttttgacaatcatttagaatatctttctgtgctgtgtgtgttccatttgcccttccagatcttttctccactctgctctgtgcttctgggaaatgaattacatggggtacatcaactgagcccttcctttttggtttcagattagctttgcccagtgggagggacatcagaaaggatctccctaaaagctagttccctcttgctggatttagtgttgccaaagctgttctgtgagtagttcacaacttgtattcaataatggccctctctgccagccatctatagttacacatctttctgggttctaataacccttccctagcccctttagacctggagatgataatggcttcctgacgttgctaacctggagttataccaccatcttttgctgttttccctaaaccctgcctgtaccttttgaaatggttccttcattaagttttcttgaatacttcattt

SEQ ID NO: 115279 - DNA, 1040 bp, Homo sapiens
atttattcataaaaggggactatattaaagggaaatactttatttatattaagtatattttgcaaatgcaatgcagctactaactatagaagtaaaagacttttctgtccagtgctttggaggagataaagatgtataagacatcattcatatctgaaatgaacttttaatctagtaaaggaactgtgtatataattaactatgatgcaaagcaatttatactgaggactattagagaaacagatccctttcagttgggagccttgaggagggttgataaaagaagccgagaggtcaagcagcaacgacccattttcaggttcctcctcataactgtccaaaatttaatatttggtaccttcaccagcaaatgcaatcatataggttaaatgtattcgcttttagtttggtaaatttcctctaagataagttttctgcgacttgtttaatgcttctgtatgctatttattctctttgcattttgaacacattgcattattctgttaatcttggacagcaaagcacaatggattaatagggcaaataattagtaacacattgggtggtacaaacagaaaaatgcataagtttttctcaccaaagatttgacttatttaaatatcagtattcaaagtgtcaaatgtttgaactcattgataagagcagaaaatattgatgttgtatgttttctttacaaagcactgacctaattgctttttagaatctggtggtggtggtttttgttttttctaaactcaatttcatccccattagaatatccaaaaccaaatccaaatctagttgacacctaaacagtagaatgttacattagtttgtgacccaaagtgaaattaatcccctagatgcacacaaactggcctggctggccggttttacagtccactgctgccttcacttcagattatgtaaacacgtgttgtgaaacagctctgacgggaaccttataacctaaacattgttctctgaaatgtaatttgttgtcttttatataaaagaagaaattaaatcaaagataattt

SEQ ID NO: 115280 - DNA, 1017 bp, Homo sapiens
cctctgacagtacagagttaaaaccctgtgagaaaaactccttaaatctgagaaaaagattaaggaatctggatccttggaatcgacgctcttcccttatttcttctgaactaaaagctaaactagtatccacattcacgttttccaagtaatacagcctctgtgtccaggtcaggatacaacatggtgattttttttttctgaaaaaattagatttctctaattttaagctaaagtttaaaaatctattgtatgttcacctctcagatagtgtatggatttgtgttatttccttcctttgaaaaagaaaaatggtttttgcaaacctagtaaggagcccagattcaagatcagccttaatttctttcagcaaagctttctgtcctattcataaagccatagacctatattaatgatgaactgtatttcctaaagctcgtttgttttaataaaaagtctcattatgaaaatctcaagcccacacaaaagtaacatggagtaatacggtgaacctcacaatgcctatcccctagattaataattataaaacttggctgtatttgcttcacctatctttttttttcttttccactgaaatattgtcaatctcagatgttatttcatcactacaaaccttaatttacagctattagtaatagccttttgaacatagttacattgatggaaatagtctcaaaagtttttgttcacataaattgctggtagtaggagttcggttaattggaaaattctgcagtaggtgtcagatcactgtgttaatttctcttagaaaaggagtataatgaatggagaaagtgcttctctgtgcttgagagcccctgaatctttatgacttcagaatcttattcagttaagagacataggattcaaaagccagacagcactgggagcgatctaggcttaatcccagtttatccccagtcaccttccttctctgtaaaaacttcagaaacagggctgggcactgtggctcatgcctgtcatcccagttctttg

SEQ ID NO: 115281 - DNA, 1671 bp, Homo sapiens
agatgagcaggaaatcatattttatattaacttagcaagtaaagtaagttttaaacccagatgttttatgtcaacaacaaatgaatcaaaaataatttttgttgagctatcagactgaggaggatttaaattgtactatgtttaccttaattgtaaaaagcaaagtgcaagatgaatattaaccccaaaagcttttattttgcagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaactcctcttttatttctaatccagtaccagtgacttagatcgaaattacagttccccaagccagactttgcataagaacaagaatgattgtccccatagacccagggggtgcttttgctttttggatccctgagatcccagcgtaggctgtcatgatggacccagtggggaaagcatggcagagaggagcctgagaggcccataggggagacggcgaacagagaaggggccagggaggaagaggcctcagcccagcatattttgtgtcctctgggggtggactggtttctgcaccacaaaaaaggattgattttgtttgaggtatgaccttcagaaagagacctccatctgcttacttctgtaactggcagtactgttacaggaaaggggtcctgatccagaccgtgagagaaggttcttggatcttgcgcaagaaagaattccaggcaggtccacagagtaaagtgaaagcaagtttattaggaaagtaaaggaataaaagaatggctactccatagacaaagcagccccgagggctgctggctgcccatttttatggttatttcttggtgatatgctaatcaaggggtggattattcatgcctgcccctttcagaccatataggctaacgtcctgacattgccatggcat

SEQ ID NO: 115282 - DNA, 1366 bp, Homo sapiens
tcagggtaattgggatatccatcacctcaaacatttatctttttgttgggaacgtacaatgtggttttaatttgcatttctgtaatgatcagtggagttagcaacttttcatatgtttgttggccatttggatttcatcttttctgaagtgcttcttctgtttttctatttaactgtctgtttttttcatactgatttataggagttctttacacattccaaatatgaatcctttctcaaatacatgtaatgcaattatcttcttcctgcttacatcctttcttgatatgccttttcaaaggaataaagtaagcagtttgaaaatgatgagaagtttggagcttctttaaaaccattttgtgaaggagtctgttatttaatgtattatgtaataatcatggtgtaaatgtctatgttctttaaaaaagtgtattttccacacaaaaacttgtacatgcatgtttatagcagcattattcataatagccaaaaatagaaacagcccaatgtctatcaataacaaatggataaataaaatgtggtatatctttcttttttcttttgagacagagtctcactgtgtcacccaggctcgagtgcagtggcacagtctcaactcactgcaccttccccctcccaggttcaagtgattctcctgcctcagcctcctgagtagctgggattacaggcacgcaccaccatgcccggctaattttgtatttttagtagagacagggtttcaccatgttggccaggctggtctcaaactcctgacctcaggtgatccacctgcctcagcctcccaaagtgctgggattacaggtgtgagccaccacacccggccaaaatgtggtatatctgtacaatgggatattatttggcaatagaaaaggaatgaagtgctgtggttatggttgtacaactctgtgaatatgctattcagttaaaaactagttgtacacttcaagtaggtgaaacatgaattttatttcaatagtgctattaaaaagaatctcaggttttcaagaaattttctcaaaaagatagcttttgttagttaatgggaaaaagctgactatttacccactgtaatatgacaagttagaaacctaacagtggtcttacttgccttaattagaaaagatagaaaaggattagctaacaaattgctttacagggtatcttaactaagtaacagaattgattactctgagagacaggaaattcagctaaattgaaaagaacgtgttgaaaactaatagatcttattttatttagatttgtttattttattttagagctagtgcttgattcttgttttctcttcttttcctaaaataatatagcagagtcagtggacttttta

SEQ ID NO: 115283 - DNA, 1037 bp, Homo sapiens
tttgtatttttagtagagacgggatttcactgtggtctcgatctcctgacttcgtgatccatccgcctcggcctcccaaagtgctgggattacaggcgtgagccactgtgcctggcaatttttgtattttttgtagagatggtgtttcgccatgttggccaggctggtctcgaacttctgacctcaagttgatccacctgcctcagcctcccgaagtgctgggattacaggcatgagccaccgtgcccagccgaaacagttattcttgatagtgatattgtcctcatgttctttatctagatgtgaattctcatattctaatgtccccaacttttcaggcttatgactgctttctgccatgtactagctgccatattttgcttcaaaggtggcagaacttcagtttttctgtattcatcaaacataattatttcaaagtagttcaaagcatgggatcatagaggaaaaaagactgtaaaattatcctttgatgacaattaaaatactctttcataggttatacttatctatattctttcttgaacattgaaatgtaaaacaaaaagtttatattactaatataataatcctatcatggaaaagcaaatggttttagttttttgttttcttatgtaaatttctatcctaaatgataggaatctctaaatacatgctttttaaagttaatcatattgtattttagttgtcttctactttatcacctattttttagtacatgttatgtttctacgatcaccatttgtgtctcttaatgattgtatacagttgcacacggcagctctattgtatttgcataatcattgccctaggtcttatgttaaagtcattgctagtttttgctattctaaagaatactcttctaaaaatattttatatatactttctgtattcttttaaattactttctttttggtgcagtggtgggatcatggttcactgcagcctcaacctcctggtctcaagggatcctcccacctcagcctcctgagtagctggtactacaggtgcacgctgtc

SEQ ID NO: 115284 - DNA, 1002 bp, Homo sapiens
aaaacaccagtttagtaaccatgtgagtgaaactgctttttggagcatgacttaaactgtatatggatgaaaattactggttttttaaatttttgtctcaattaaaatgtttgaagagtgaaactccatttttttactgctattactctgtgttttcagttttatgatttggaataccatgatgggaacatctatactaagcattccttggggcataaaacaggtaatactaatttttcagcacactttttgcctaaatgtttttctctttatattgtaagttttataacagaggttttaataaatctacataaaattcattaaagaaaatagatggttatatttagtttttcatgagttgtcaagtttttatcatgattgtttagggtaaaataattgcatatgaatttatgcttacatgatgatatatgctgttttatacttttatttttaaacaggctggatttactactggaatgtgtgtcatcatactgatgggccttttaacactttattgctgctacagagtagtgaaatcacggactatgatgtgtaagaatttgacacagtgacaatagattatgggtattaataagcatttccctttgaggcagatcactagtgtgtatatgctacatgtgtgtcagctgtctactttgtacctaaagatttacttctgtaattcatcgctttcagctaaattgatttgctaataatatttagtggctgcttttgaaattcagagaagctgggagttatttgcagagtgcattcactttggtgctagtttcttcataagaatcatttaaaaactcatatttataaaataatgtctttgccaaaactaaattgagaattctgtgcttcctgtcagttaatggtgacttgttttgacctattcataccaaaagatctaaatgttagaatctgctaaaagtagaaattataactagaaaaatatgaaaatgtaagcaactccctagtaatgaatatttgaagttg

SEQ ID NO: 115285 - DNA, 1381 bp, Homo sapiens
ggcatggtggtgcacacctgtagtcccagctactctggaggctgaggccagaaaattgcttgaactcaggaggtggaggttgcagtgagccgagatcgcaccactgcactccagcctaggcgatagagtgagactctgtctcaaaaaaaaaaaaaaaaaaaagattagattaacagtatctccagaaatggttaccatatgttactacattttaagttcctttcagaaccataagtatagaggagttagtggaaccaatgataaatctggattttttttcttctttctttggatctgtgcctgaaatggcaaattatgtgcaatttggggcacagtgtcacttatgatttcaaggagcctaagaatcagcagagggatacagtcttttgataaaactctgcctggtcttttcattttggatagtatattactggaaacttcagaagaaaatgagggagtttcagaaaggaactgaagaggttgatgactgaaaaggatgattgaacaccaaaatctgcagttgattaggatgcagacgtggaaaggaagcatgtatataaataaaagggtatgttactaaaatccgcaaaaagtagaatgaggcaaaatatctccattgtcatgatgttccattttatactgagttggataagtctcataagggatctgatagttgaggtcactaatccttaatacatgaaccaaggaataagaattctgtttatcataggaaataacttgggcccataaggaaggagtagagactcttcaggagagggacattttagtccataatttctctgatttagtgccaaaagcttttttgagagactattcaaagctgtcttaagtttcattgttggaaattgatagctgctgtatttctttttaataactgttttaagttctttctgttttgtcttctcggttgctaaattcctgaagattacaaaaaaagtgtgcttaaagtaaaagtgttatgagacaaaagctttattctgtggataggataatacttcttttgtaacattttctgtttgcaccaaaagtgagaagtcaatgccttgcctttgtgcatcccattactaatggaggataagaagttattttcttcaaaggctgacttccagaatttttggctgaacactttttgtcaagtgtatattccctttgtaggcctttctgtatagagcccacaaacatcgtgaatgtgaatcatgtcattcagagggttagtgaccatgcctctgccatgaacaagagaattcattactacagccggctcaccactcctgcagacaaggcactggtaagagacaaaacattactaatagtctaaaattcagttgaaatgaacagtgaacaatataagccagggcac

SEQ ID NO: 115286 - DNA, 1681 bp, Homo sapiens
gtggtcccagatacttgggaggctgagactgaggcaggaaagttgcttgagcccagatggctgaggctgcagtaagccatgttaatgccactgcactctggcctaggcaatagagtaaaatcctgtctcaaaaagaaagtaagaaagaaagaataataaagccaacacccatccaagcaacataaggtcaaaacacagcagtaacctaaaagttctccatgtgtccttcaccaaacacatcctccatcctccctagggatgaccactatcttgactttgtataataatttccctacgctttataatagttttattgtctgtatatccctaaatactgaattcagttgtacctggttttgtaccttatttggggtacagaccttcttaagagtgatggcattgttattaaatttcagagaagcataactggtcagtaggagggtggagacagatgtataagccaaaaatttttaaggaatttaaggagtggaacctagaaaaggtgttaggtagaaataaggtttctctgtttatacatgtattaaatgaaaatatgaggtttgactcatattttaaaatattttgtacattttgcttaatattaaaagcattttttctgtggcatgaccataaatatttataaggtaagacaaatatgacttatttatttttagtgtggcacagctgaactacatttcaaatgagaagtaacattgatagggagcagtaatgtgaaactatgttcaaaaaaagaaagcccaagtttcaaaagtcttattctgaatattgttctctgtatagtattgtttaattttaaaagtgttttcagatccaactaaagttcaatttaaaaatatagttatattttttcttctcaaatgaagctttaagcatatgtttctaataattcagttaaatatgctgagttgtatattttttgaagagaatctgttttgaaaagattccaaaatatttgtttgaacaggcactcagcatctcgatgaaaactgttggaaaagaaaaactttcagagtcattctgccctcagagtagtcaagccaactaaactggtacagttaacacttctgtaagaaaccaggagccaagaaatttagcacttcctgactgcttttcagcaagcaggcctcaaaccaacttagtggttggaaccaataatattgaatttttaaagtaaaaggctagcagtagaacatctacatctctttctatcagtatgatatttatcagtctcttttggtaatccatgactagcttcaatctttgccttatgttggtattaaagctatcattctttcttgaattttgtagggcatcatttttgcaaagcaaaaagagaatgcactatagagtgtgaccccaggtataattaaaccatctgccagacataaatatttttatgttgctttttagtaccactgagtgtcatagtggagatgcaaattatattggacatcataatgctttgggataattggtagttacagcagactaccaaatttacaagtagggattgctttttcagcttctgatccattcatttttattatatccctttgaaatatattgacaccacttaattcacttaacaataatatgcttattgtcttagttccttttattctgctgtaacagaatacctgagactgggtaattttaaaag

SEQ ID NO: 115287 - DNA, 1010 bp, Homo sapiens
tacacacacacacacacacacacacacacacacacacaataaagaaaaaaaaagtattgatttagagggacccctcagaaggtggcaagtttctctgttgggggaaggagaagagttgatagacagaacaattcttgggcaggcatgttggctcacacctgtaattccagcattttgggagacagaggcaggaggatcagttgagatcagcctgggcaacataacagccccatctctaccaaaaaaaaaaaaatttttttttttaattagctgggcacggtggtgcacacctggagtcctagcttcttgggaggctgaggcaagaggatcacttgagcctcttgttgctgctgcgagctatcagcgcaccacggtactctagcctgggcgacacaatggaaccctatctcaaaacaaacaaacaaaaaaagacctacaattcagtagcttctgtacagagtgaaggagctgcctagctggtctgaaagttccattggaggagtactaaacactttaggaaggtcctgaagtctttctggactgattacttgagaggtgtcattttgaaagacacactgggtggaagtttacaaagggtaaagaagcattgcatacagtcatattgaatactttacgttagaatcataactgtttaatgtttatgtttttattttttaatgtttatgttttatatattaatgttttatttgatactttataatgtttgtaaatttccacatttgaagtatgttgagtatttaatttcactgatttctaaacattgttacacttctgcacacttttcaattaaaatattagtattaatacttgcattacatggagtaaatacctagacactggtagtgcaatttgctttagaattataattattactttgatttttctgtcatgtttaatgtcaggttcaaagaccatttaaattcttcatttggaagtttttaaatcttagaaaattttgaatccatgtgtgtgaaattgcagatgggagt

SEQ ID NO: 115288 - DNA, 1024 bp, Homo sapiens
ggtgatctgtttaaggagtagatgtgtttcgtttgcatcacatctatgtacagtattaaaaataaaatgtatctctctctctctatatatatatagatatatacactgaaacctttactgtctttcattgtctttctagtttttaaggataggaaattttagttaaaatgctagcctggcatttttcttattccccacttttatttcccccatggggaattgggttatgaaactggaaattttattaattttccagaaattgttctggtgggtttgtgtaaggaggagagtaataactggcatggcattgcagttactctttatttataattaagacatgctctttatttcaaaatattaagttaataatactcttaacttattgcacttaagtagattgagacaatttgcgatttattttgacatcctaataaagtggataaaaggagaagctgcttggaaaactttcccacttgggaattttttccacattcctaattttcctttgtggaatgtcactcaccatttcccatttggaactgctctttctagatagtagatggaatggagtggttgcagtggtggtggtggtgttactgtttacatcaacctagagaaaaatggaagcatcttaacttggttaaaatgtttctgttgtttatataattctttaagcctcattccagtgttgctgctattaaaaaaaaaacaaaaaactaaaaacttgcatttcttttactgatcattttgtagacatagaaataagagattctcagcatagtagaatttttaaaaattaatggatttttttaaaaccaaaatttaagaacataaattgcattgaaaagaattttgaaatttattctcagcagaatctgtaataaaatacatgggccggagaattaattttcaggtcaagttctttgtctatatgttgttgatgaagttgttttctttcagctaagtaacagtttggaattctaaaacagagaactcataatcttcaaccaagtgtttattaaca

SEQ ID NO: 115289 - DNA, 1040 bp, Homo sapiens
atatatgtgtctaggaaatgcactaaaatgttaacagtggttatttctgataggtgatttcattttcttcaataacttcttgattatcttaaatgtagacaatgtgctacatttctaatgagaacaaagttattccgaaaatatggcattcctataacttaggataaaaatggtatatacaaaatgaaaaactcattttcttaaaactttgtttaaattaccttggtagtctcagctactcaggaggctaaggcaagaggattccttgagccgaggagtttgagtccacagtgcactatgatcgtgcctgtgaatagccactgcactccaacctggacaacatcatgagacctcatctgtaaaacaaaccaaaaaaccttttggtatatttactgtatttactcctagccttcttttctatgacgtttttaggtgagatcacatagtatatgtaatttattgtgctgctttttcattttaaatttatattacatgccatcattacttctgcaagttattcgctagttgtctgtctgcctgcctccttccctctcttcttctcttcttccccacctccctgccatctttcttccctccctccctccctcttttcctcctctgcctgcctgccttccttccttcttctattcttttgtcagcaaacattcattatgttccttctgtttgccagacactttactcaaacacagctttactgaaacacagctccaccctccagtgggggagatggatacctagcaaaaaataaggggtgctaaatacttaattttatgtgtataaacacacacacgtctgtttttgaggcatggtctcatgccatgctggagtgcagtggcacgatcatagcaccttgtaactttgaactcctgggctcaagcagtcctcctgcctcagcctccctggaggctgagagtacaagtgcatgtcaggatgcctggctgctttttctattttttgtagagaaagggccttgctgtgttccccaagctgttcttgaactcccggcctcaatcagtcct

SEQ ID NO: 115290 - DNA, 1021 bp, Homo sapiens
tcctctttcccttccattctctcacacttgggcctccctctcttctctccaactttccactgttacttttcctcaaaggaactgtctttttgctaaacacttgaagagtgtttagcaaatcctggccttagagtcagagatgccttaaatctaaatacaggcaaggcacagtggcttacacctgtaatcccagcactttgggaggctgagggaggtgtattgcttgaggccgggagtttgagaccagcctgggcaacatagcgagatatatgcaaaacttagcaaatttctacaaaagcaaaaaaaatctaaatacaaactttgttagactgggatcttatttctagtcccattagaatccttttattcttacaaattcattgtccttatatatttttctttcttcctctcttttcaaatagttttgtttgcttaattgcccttttgtatccataattgcttgcctgagtggcttctttctttcctagatcaatctgttctaattgattttactatttgtttacttgcctggaagctagttttgctttatcatcttttcttcctgtctcattattattatgatgcttctccacttattttggggtgttcctgataaacccatcataagccaaaaatatcctaagttgaaaatgcatttaatacccagataaaaccatcataaagtcaaaaaatcataagttgaactgctgtaagttggggactgtattagagaagcctgaagaaagagggagcctcgttgggtttgactggtactcgttagggccaaatcaaaagtgtgggttttttggaggaaataatatgaagggttgggctagcattgttctctgtctgctcaatattgtaacacatccaagtatatatttagtcaaaagggttttagtgtaatagtataattatgctataaaagcagtaaaaccaattgcaagtatataacaagagatttgaaacttcttttaacaagcagacttaaaaccaaatattattgaattgatggaggcac

SEQ ID NO: 115291 - DNA, 1437 bp, Homo sapiens
tagcctcaacccagctttgtaaaacgatggatttgaagtgttgtttatgctttttttctaatacgcattgcattaaataccaactagtttaaatagcatttattcttgtgctacttacaatcatcttacatattaccatactttgagaaactgtctttggctgtcagagtatgtcaagtatatatttagattacttatcctcagtttagcttgtggttttctatctcttccactaggtggcaataaaaatcacataattttaataactgctttggactgaaagtatgatggttcgcttatccttttagtggaactggggtctaactaaacttaggtggaggaaggagcttgttgttataggggaataatatatgtcaagtcatttggggggctttttcaaactatgcaggcctactttttattctgcatacccctcccccaccagttttccccctgatttgggggtggaataaggaatgtgagtggagggacagaaaggtttagaagtctcctatcttgatatatgtgctacattccattagcaagtaccagtctaagaggttactttcctgtttttctcagactttctggtagccaaagatagaacctgattttcagtattgcttgatgttgctgcatattcaggattgctgctattctcggactatgccctggggaagttgcccatccagctagcctacaaacagattgtgaaatagttaatttgtttttgagcttctcttgtttttcagtctttctctatctctgtttcctcttcttccattttccccagggcctagggatttcatatccttctctgtatgcccagtattacccagggcaggaattcactcagacttaaccccttaggcaattctttgtaaaccatatttttcttctgccccttattcaccagtacttatctgtcctattccctccagggctctgttgtcagcttggtattataatggaaaacaattggatatgtcagagacttagtctattacatttccatggctatttgcattttaacatggagaatccggtaaatatgaagtcctaaccaaaagtttcaagatttttctaactgagaacatttcaggtgctctgataagccaagtggggtacaggcagcattcctactgcccttcaaacaacctaggtatgctgtggcactcttttttataatgtcctctagcgtgcacatctgtaaattggtctttctgttttacctgtcactaatactgtcactatagagcagcctaagttgactctttttggtacttaaggtcttaggagagaggaagaaggaaaaatatataaggacaaagaatttgagagaataaaaggattctgatgggattgtaaataaggtcgcagtctaacaagtttatatttagatttaagacatctctaactccacatctcagattgtcc

SEQ ID NO: 115292 - DNA, 1562 bp, Homo sapiens
atactataacattggcaattaagtttcaacatatgaattttggacgggacacaaacattcaaatcatagctggactccttattaaaaccaatcttaaacaattagagactcatttaatgacttagatttgacttagtggtcttgcatctgggactttgttttaaaactcagagattgagtgagatgttaaaagtgattatgtctgggttttgttttgagacagagtcttgctctgcaacctctgcctcctgggttcaagcaattctcctgcctcagcctcccgggtagctgggactacacgtgtgtgccaccactgctggctaatttttgtacttttagtagagacagggtttcactatgttggccaggctggaatatgtctgtttatgtcatcttgtatatttagcccctaccaaattatatcaatgtaatgtctgacaaattaatactatagaagtatttagcatttttgttaatcattgataaactattctgcattatcacctatgtaatatttgctgtggaactctaattcacctctcaacctaagtcatcaaacttcgggatattttatacttctcatcaagacattcaaaaaagctttaagactaggcatggtggctcatgcctataatcccagcactttggtactttgggaggctgaggcaagaagattacttgaggccaggctgggcaacatagtggcgcacagctgggatcccagctattttagaggctgaggtgggaggatagcttgagcctggcgggaggaggttgcagcaagcccagatggcactactgcactccagcctgggtgacagagtgagaccctgtctcaaaaaaaaaaaaagaaagcatatctgttgtcacctgaaattctcaggagcaacgagtacagttgtttctgttgtgacaaaacttgcaccatctacacaaaaaaataaaaattaaaaaatttaaataaaaaaattccaccttggctctgtgtggggaaaaaaggaggggacattaaatttctgttgaaaatttaacatcatgctaattgactaattgagacaactgcaaattaccagttttcttacagttcttcatatttacttgaatattataaatctttgaaaggcaccagggactttgaactcctcatttatgatttgttatttgaaatcatcagttttctacttatttagaataaatagctaattctgctatgctgcagaactttggatttgctcagaacaaatacacataggtgactaaactggaaattttaattcctcagtggcccttacatttttccccaaccttgatttcactttttgataaggttcactgaaatccaaggatctttctagatttctcctctttcctggtttcttcactttcaatctttaagtaaagtattaatttccagaaagtgaaaggatcttctctctctaaactcacccacattctcagtttagtttaggaaccaatactacagagtatattggtttacaaagtaaattagaaagtatagccatatatttctgccattgtttaggcagatatgtttttgctac

SEQ ID NO: 115293 - DNA, 1065 bp, Homo sapiens
tttgctctgatactcaagctttagtgcagtggcactgtcatagctaactgttaccttgaactcctaggttcaagcaatcctcttgcttcagcctcccaaagcattgggattacaggcatgagccaccacactggacctatatggtattttttaaaaagtatatatgggcttaaaagttaaaaaaaaaaaatcacttagaggttaaaaatgtctaccaggcctgcattttgtaacatacttaaatttctgtcgtttgctagggtttttttctttcttaccactgaaatataacttgagagcatttagtgttcccattgtagaaggagagattctttggtaccacagcgttgctttggtaatttttttgtgagaccacactatcctccagcactgtcaaatttaacgccttttgaagcatttattgatcaggttggaagcatgttccaactgtcacatcagaataggagcattatagatcctattggctaaccagtaaatgattcatcaggaagagatttagataagtttgttattggagtttatagctgttacagactaatacagaagaaaatatatatacatagcataactgcttccaccagggtgacttttttgtggtgtggttccatttgcttttatgttggcatactacagaggtgagtaaactatgaccaaatttggcctgctgacagatatatttttttcataaagttctattggaacacagccatgcacactcaattgcctttcatgctaacaggtagaattgagtagctgcagaaactatatggctcaaaaagcctgaaatatttattatctgaccctttacagaaaaaaatatgtcaacctctagcctaggacactgagtataaatgtagtatctgaaactctataacatacacaaaagtattcagtaatattcatttttagtctctgagaaagaacatatataatagttgtatgtgggtccatagtcacatttatttgggcacaagctagtgtattctattgcagattgatgctagcatcttggcatagattctatagatttatttttgcaaagaa

SEQ ID NO: 115294 - DNA, 1050 bp, Homo sapiens
acgacggagggagcatgccaactcaacagttttttcaaaccagcttccctttgtgtctgtagggtccaaggacgtaaccagatcatacaacacgcgccaggaaagcccaaaagaggggtgatccctcgatggaggtgccgcatcagcgttttctcacgtggcctccggggctctatgaatggcaagagattgcattccttctactacccctcccagcctccagccgggacaaggaactggagcaaactcggggctgcagttccgactggactcgcccacctgggcgcgccggctgcccagcctcctgaagcctcggggctgggccctgcggtgatgggcgtgctggccgtcgcagagccctctgggagttgtagtccgtagcggcgagaggtttgacagcgaccgcgggcttggcgcattcagaactccaactcccgccggcccctgcgacccaggctattgccgcttcctgtttggactaggagccccgcggtcgcaaattgcgagaatttgggaagggaatctttatcttctcgtctagttctccgaggttgaaggctcggcctgctcaggtagatcacgttcccacgtctagcaaactcgcccctcggggaggtgggaaggtatccgagggaaggcggcgggaagggttgaagttggggcgaagccggctgtcacctgggatagttctttgcagcgcatcggaaccgtctcttcttttggggctcagggaggccatagcctggagccgcggagactgctccggaggcacggcgcgcgctcctcaagggctcagggaaagaaagtcaggagtccctcggggtctgaggaaatccgagtgtctatgggagtcggtgtcagctggagccttagagaaaagatagggttggggtaaatgaacaccctgaccctcgggtgagagaaggagggagtaggagaattgtgggacttgcaggaatgggagcacccttctttctctctcttgagatagggtcttgctccgtcgcttgggcttgagtgaggtggcgcgatcacggctgggagcacctt

SEQ ID NO: 115295 - DNA, 1025 bp, Homo sapiens
gaaaaaagtcttcagattttaaatagaaaatattggataattgttcttgttttaatgtctgtggtagtaataaactggaacttttttttactgtagcaattaccaaaaccccaagtcatttcaagtatgttgttatttttgtgcccttaatgatgactcggaaaaatgtttggatgactcttgagctttttaaaagtagttttaaaagtcagtgtctttgagaaagaaattttagcaaatagatgttacctaaagaagcctaccttggtgcattctctctaggtttgggacttagttaaatgaacttatttgaaggaacattgtaactgttgtaatatagttagttgattaagagatcatctgtagatttcctttcattcttaaattattaaattctgattgtcatgtgcaagaatttcagagccgtattctgaacttttgccataattaaaggaagtttacgtgagaagaaataaagatgtggattaatgatgataaggacaccctaagagttagtgagaaaaaaattactcaaattgtcattaatctagagctatccagagaaatgttggaaggttccaaaattaacctgcattcagctattgattttataataagttgaattttctaaatctggcagtcattctaccactgctaatgtaatgcatgtgtgttaatagtaaatgattttctttagcctaaagtagggaaagtgaacagttagtatttgggagcaaagacagtcttcagctactgctgtgacaaatgtgattaaaattaaccatgaatattctgatgctacagctgaggatataccttttcattgtagttgtagtgcagtggcaggttgcatatataaattgtttccagtccataagtgaatttactttacagtgaatccttttttttctttttttttgagatggtgtgagacagtgttttgctcttgttgcccaggctggagtgcagtggcacgatctcggctcaccacaacctctgcctcctgggttcaagcgattcttctg

SEQ ID NO: 115296 - DNA, 1252 bp, Homo sapiens
aaccttcacctcccaggttcaagtgattctcctgcctcagccttccgagtagctgagattacaggtgtgcgccaccacgcccagctaattgttttttattagtagtagagacagggtttcaccatgttggccaggctagtcttgaactcctgacctcaggtgatccacctgcctcggcctcccagtgtgctgggattatagacgtgagccaccacgcctggactgtatagtttcaatcttgattttcttctcagtagaacttgcataactaataatgtggtttttgaagttgactcttcattgcttaaaatatcgactagcttgttatgtcctgtgaagtatgtctgagtagcttggacttcttgaatcacacatctttgaaatctgattaaaatacttttatagttgggcatacacaattttacaggtggtttcaggagttacacagatcccttttaactcccctctacaagggttttacagaggtaagtaagacagtatatagggatcacagggaatgctttaatttttttctcagtgatagtttaaagcatcattttatgctgttttggatgtctctcctgttctttttttaatgttttattttaaataatcgttcttgctatcacatctctgctctcgagatttttaatttagtggtagagaaacacatggaaagaaatactactttaaaaaggtacagatagtatgctgtgggaatgtggaagaaggataaattatgactggagggctaaaggaagacttcacataattggttttttgaagaatgaagtgaattttgataagacaaataagaaagtagggaatgccatgccaaaggaatagcatgtacaaagatacaaaatattagcagttgacagtgtggagtattggagttgtttggtgtgaattaaaatgttgggtgtttagaattacatagtgagaaacaaagctaagaaggttagtatggggaaatagtatggcgagatggggaggccaggaggggagtggtagtcttaggtttttcccttatgtagccccttgttttaattttaaaaatggaaaggatatgataaatataagaaatagaaaaataaaaaatagaacagttaaacaggacacgagtgtaagattttcaatagcagtgactttcacacagggcagagcgtaatagctggctctatcaggatgagaattcaacatatagaaaactatggagcagaattttcctgcttgaaggtctccaatataa

SEQ ID NO: 115297 - DNA, 1057 bp, Homo sapiens
aaagtaattttttattttgaaatagttttattcataagaagttgcaaaaatagtacagaggtttttcatgtacccatcacccaacttctcttaatgttttctatttttattcccactgtgatcaaaataactgtaggtttattttagggaaataattggccaaagatattgtgagactctttcccttgccaggtcccagattagtagttttgttttttttttttttttctcgaaagcagtaaatattagttatcatcattgttattccagggccaacttttcaaaacttatttctttcctgcccttctacattgtattaagtcctgccttccagaaagttgtcttgttaatggctcttcaggattgtttgtcagttgtcagctgcagctgaaataggagactgcaacaagagctttgggtcactgtttattgtagaacattattagttgttaaatggattgggactttcacacaggaacttagctaataacctgcaagctgtttggtcacttgctgtcattattttgacttaatgttcccagatattaaatattaatgatatgtacaaagatcccttgaaaccatctttgtattcccaaatgtgactttttttggaatcttctggaaagcctgatgtcatagtaataacatagaacttttacatttcgaaaaatcattcctttcagaataaacatttctgggaatggggtctaggaatttatttttaaccaactctccaggtagttttcaggcagccttcagtatagtaatctctcatactactattttaaaactctgggaatgttacttactaatatcaaaaatggagaagctaggatatccccaaattatttcattagcatgaatgggggaaagtttgcatatatttaagaaagcacaaatgtcttgagtttattaagaatggtaaattggccgggtgtagtggctcacgcctgtaatcccagcactttgggaggccaaggtgggcgaatcacctgaggttcaggaattcaagaccagcctggccaacatggcaaaaccgcatctctcctaaaaa

SEQ ID NO: 115298 - DNA, 1057 bp, Homo sapiens
agcagaggttgtgccagtgcactccagcctgggcaatacagcttgactccatctccaaaaataaagtaaattacagaaaagatatgacattataaatagaagagtctagtggtctatggaccttatgtgagaaccacttgattacttaatagcttagatgttcctgaaatcatttttggtcaaactgaaatttatgaaattcttattttttgttttgttttgctttgcgtagtataatgcttggcaaatagtaggttctcaatttcatataataaacatttaatatttagatacatgagatgatttgtatagggaatcgactctgagtaatgtctttatatatctgttaaaattatttgaagaaatatgtttatattttaacttatgaaaatattttgtcttcttactaatttatcttgtgacagtgctattctttatatattgcatcatttaagttaattaaatgctatttacatgttaaatttttattgaagagtctagtaatgactgcgaagataatccaacacggaacagagggttttccaagagaggcggtaaggaccacattttggaacaatttgtacttaacacagagacactaaactggtaaaactgattttgaaggagctggatgaaaaacactgatcgtgaaaacctttgaagaaaaatactttggtatatgttttctgcttttaatatttgagtgagtattcagtgggtgcccctcctttcactcttttattttatttttttaagtttttggttcaggggttcatgtgtaggtttgttatctaggtaaattgcatgccatggggttttggtgtacagattattttgtcacccagataataagcatagtccctgataggtagttttttgatcctgtacctcctcccactttctaccctaaagtaggccccagtgtctgttgttcccttctttgtgtccatgtgttctcagtgtttagctcccacttataagtgagaacattcagtatttggctttctgttcctgcattagtttgcttagaataatggagctccattcatgttcctgc

SEQ ID NO: 115299 - DNA, 1054 bp, Homo sapiens
tggccaggctggtctggaactcctgaccctcaggagctgtcacctcagcctcccaaagtgctgggattaccggcatgagccactgtgcctgtccttgttttactttctaatgtcactggatctgttggttgtggtttttttttcccccctatgatctccagaatgtgctatcaattacagaagagggacaatgtgaatcttggtcagttgcaatttagatgaactggggatgtctttgtctctgaatagagtcattggaaatttgaggggggaagaaattgtagattattttttgttcaagtctagctgtatttcaccatactctggtaattcagcttctattgaatttgagatgagattgtatcaaaaattaccatgcttaattcttgattatatatgggcagtcatgttaaaatagcaatgacaacaaaacgtatgaagaatatagtgaacttactataaaattgctgaggatgtgcaaatctatgataagaggttttattgtttggaactacatagtaatcagatacatcagtgtttttaccgcaccttggagacattcttttcctttgcccattaggtaggtagctggctgaattaggccctccctagtgaaggtaggacttgtggatttcataatgagggaagactgtctccttaattacttcttatgataattgtggagaggggtggtggtggggagaaagttaagctaagaaaaaacaagactcatcttttaccatattttttttaacaagcaatttttggcacttaatgttcctaaaacatagctcatatttgaaatttttttcttcagaccagtgaatatcttttgtactattaacatttactttaaatcaatttaattcatatttaaatgaggcagtcgaaaccatttgcagctctatgtgcttggtcctgacttacagattagtgtaggataattagcaggggcacagccattttgcagggtatccctgatttccattctctgtagatgtatacatttgaggataggaagtttgcatataggggtcactcagaaaatacacgt

SEQ ID NO: 115300 - DNA, 1175 bp, Homo sapiens
acttaaacttatgtgccttacaggttattaaataaaactagaattaacaaagaagccaaaatgtttcactttaattgtagacagacacagctcctatattgagttttacaacaaaaaaacccatgtctttcagcatgcatctacacagtgttcaatgtaatgtagcaaagggcaacagtgaacataattcaactccttttacctcaatacacttactgcttaagaacatcctataatataactaacttgagcaaagctggaacttgtttaacagttatagtttactcaacttcagtgttacatcctagatgagtattgtgttaaaaaatactgagccttaagtcttcataacaatcctgatttctacttagagagtaagcataaatcataagtttgtattgcagaaactgttaaactgaagttttgggtttttcttaaaaaaaaaattgagcaagggtcagtgatcaattatattccccatccaccactcatactggacatggtagacatccctcccattccattcacacctatagatgcacagcttccattactgtagtagctgctgttcattgctccttggctacctatgcaatgtctgattgaaaatcacatgagttttcctgtaaaacttggtcaaatccactcatgctgctgtggccaccatagccacctccataaccaccactcagctgcgggctggctgggccaccataactggactggattgacaagcccatgccccccatcatttggctaccgtaagcagtaccgctggctcctgctgcacaattcaagaagggttctacatagctgtgttgcatatttgctttgtcttttgacatagctgccacagcatcttcatgagttgcaaactcaacatctgcttcaccagttactctgccatcaggaccaatttcaatgtgtaccctcacagcattgagcagtcaaaaaaattacaaatgtcattctcagtagctctgtaaggtaatccacacgtatatacagtgtcctgttgtgctctggaaggtagagccaccatccccatatttgtgatcagacattcctgaaaaacaataattgaggtctcttccaaatctatctgacccaaatccatagccatagccattataattgtcacaggctccatatcctccaccataagcaccatgcct

SEQ ID NO: 115301 - DNA, 1071 bp, Homo sapiens
ggctctaaagaaacacaaggaaagaatagggcacaggtatattgaaatctttaaaagcagcagggctgaagttggaactcactacaatccaccataaaagcttatggccatgcggcggccaggtcccatgacagacctggttctggcagaggttttaacagcattggcagaggagctggctttcagaggatgaggcatggtgcttatggtggaggatatggagcctgtgacaattataatggctatggctatggatttgggtcagatagatttggaagagacctcaattattgtttttcaggaatgtctgatcacaaatatggggatggtggctctaccttccagagcacaacaggacactgtatatacgtgtggattaccttacagagctactgagaatgacatttgtaatttttttgactgctcaatgctgtgagggtacacattgaaattggtcctgatggcagagtaactggtgaagcagatgttgagtttgcaactcatgaagatgctgtggcagctatgtcaaaagacaaagcaaatatgcaacacagctatgtagaacccttcttgaattgtgcagcaggagccagcggtactgcttacggtagccaaatgatggggggcatgggcttgtcaatccagtccagttatggtggcccagccagcccgcagctgagtggtggttatggaggtggctatggtggccacagcagcatgagtggatttgaccaagttttacaggaaaactcatgtgattttcaatcagacattgcataggtagccaaggagcaatgaacagcagctactacagtaatggaagctgtgcatctataggtgtgaatggaatgggagggatgtctaccatgtccagtatgagtggtggatggggaatataattgatcactgacccttgctcaattttttttttaagaaaaacccaaaacttcagtttaacagtttctgcaatacaaacttatgatttatgcttactctctaagtagaaatcaggattgttatgaagacttaaggctcagtattttttaacacaatactcatctaggatgtaac

SEQ ID NO: 115302 - DNA, 1875 bp, Homo sapiens
aactataaaacttcacactttgtaccattaaaacctaaaattttaatcttgtccttttttactatggatcagtcggcactcgggaacagcagcaaggaaaaaaagcaaatttcattcacatgttctgtgttcatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcatagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacaaaactttacaaagccaagcgtattatcttttgcattaacctatttttttccatcatacatgctactagtatgtgcattagcatgatattctcatatacattgcattaaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgttttttttatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaattttttttctgtatgtggttactatcatctgactatgcatatttgtaacagcatttatcattagtggtgttagctaaataagcatcttagtgtaaatgagatgcttcgtgtgggttttgtgacattttaaatgacataatgg

SEQ ID NO: 115303 - DNA, 1391 bp, Homo sapiens
tcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaaaaccttgtctggacaaaactagttcactcactgcttctgcacctgcagttgctccct

SEQ ID NO: 115304 - DNA, 1987 bp, Homo sapiens
attttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccagttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagagttactgggaagtttcagagatgcattagctctgtggctttaactaatacttgccatatacaattttttctcttccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatccc

SEQ ID NO: 115305 - DNA, 1050 bp, Homo sapiens
tggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccagtatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttcgcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggt

SEQ ID NO: 115306 - DNA, 2916 bp, Homo sapiens
tttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttttgcttatagtgttttggtccgttgaaacgacttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcgtggtggcacatgcctgtaatcccagccatttgggaggctgaggctggagaatctcttgaacccgggaggcggaggttgcagtgagccaagatcatgccattgcactccagcctgaacaacaagaacgaaactccatctcaaaaaaaatagaagctagcataagttgtggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtggtgcatgctaaaaaagataaaaataaaggaagtttgttttggtttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctct

SEQ ID NO: 115307 - DNA, 1049 bp, Homo sapiens
attcattttaatagcaaagcatttgattactatttttactaaatagaaaggtaatgctttatatgtattaatattatatagaagtcaggttcataaactacaaataataccttataggtatttaagtacagttctgtgaaagtataagttctataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaaggtttgtatctgtgagatggagcctgactcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctg

SEQ ID NO: 115308 - DNA, 1010 bp, Homo sapiens
tcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcagga

SEQ ID NO: 115309 - DNA, 3378 bp, Homo sapiens
gctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacataataaaccttaggatttattttatttttcagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctatccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaagccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccacctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccag

SEQ ID NO: 115310 - DNA, 1093 bp, Homo sapiens
gcttcccaggttcaagcaattctcctgcctcagcctcctgagtagctgggattacaggcatgtgccaccatgcccagctaatttttttctatttttaatagagagggtttcaccatgttggtcaggctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagccttattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaaatcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattata

SEQ ID NO: 115311 - DNA, 1076 bp, Homo sapiens
acttgtatttccttttctataaactattcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggctagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtccttgtccccaaattacagttacccagatatctaatcattctataggatctggtttttaaccctgtgcatgctgatta

SEQ ID NO: 115312 - DNA, 1229 bp, Homo sapiens
actttgggagtctgaggtgggcagatccctttgagctcagcctgggcaacatggcaaaacactatctgtactaaaaataaaaaaattagctaggcatgatggtgccatctctagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacactgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcat

SEQ ID NO: 115313 - DNA, 1030 bp, Homo sapiens
aaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatagctctggttagactggcatgctctgggattttgtcattggtaatcttcacttgacaattagagtcaaagatgatgtagagttcatatgtgtgctattttctctatctaggaacccctacccttattttaagactgggcgctcctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatac

SEQ ID NO: 115314 - DNA, 2334 bp, Homo sapiens
tggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccggacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctcctccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactcttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctcgctgaaaactagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagcttctccgtttctttgattgcaaaggcagaatgatcagagttgaggttcctattgtgctttattattttacacagcaaatactaagcaattactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgagcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataat

SEQ ID NO: 115315 - DNA, 1279 bp, Homo sapiens
catgattgttaagtaatgtctgccactggtagaagataaaatgatgtcacatatgtcacatacttgccatctgtcatccaatcctgttttctcatgacagttttaaaaatattaaataaaatagcaaaatttcctgtcttagcctctcatccaggctaaagcacctagtagaaatactgaagtctgtaaattctggttgatatcaaaagatgacccctcaaggcatccttgaagtggccttaaaattagagcaagaaagagcattttattttttcatttattaccttttattagatacctctggctcttcccttttgcggctatcaccgaagcaggagtggccaaaatgaagtttaatccctttgtgacttccgaccgaagcaagaatcgcaaaaggcatttcaatgcaccttcccacattcgaaggaagactatgtcttcccctctttccaaagagctgagacagaagtacaacgtgtgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagactgtgaaaagatccttgaacggaaagccaaatcttgccaagtaggaaaggaaaagggcaaatacaaggaagaaacaattgagaagatgcaggaataaagtaatcttatatacaagcttcgattaaaacttgaaacaaagaaaaaaaaatacctgtgaatacccaagagtgccataattatttggaatctctctaaaaacactgatttttcacaacttaataatgaaattagtattctcctaccacccattgcacacacattgctgttggtgtgtagtgtgttgctgtggagagaacattagatggggagttagggagtgttatggcccgaattatgtctcaccaaatttcatatgttgaggccctaacccctagtcagactctatttagagacagggtctttaaggaggtaattaagcttgaatgaggtgataaggatggcactgttcttcaaaagaactgaattccttatcgaaggggaagaagcctcattagggcatgcatgcagaggaaagaccaggtgagaacacagcaataaggcgggcatttgcaagccaaggagaaagcctcaccagaaaccagccctgccgaca

SEQ ID NO: 115316 - DNA, 1037 bp, Homo sapiens
gaaatttggtgagacataattcgggccataacactccctaactccccatctaatgttctctccacagcaacacactacacaccaacagcaatgtgtgtgcaatgggtggtaggagaatactaatttcattattaagttgtgaaaaatcagtgtttttagagagattccaaataattatggcactcttgggtattcacaggtatttttttttctttgtttcaagttttaatcgaagcttgtatataagattactttattcctgcatcttctcaattgtttcttccttgtatttgcccttttcctttcctacttggcaagatttggctttccgttcaaggatcttttcacagtctttgtccagttttagcctagtgataaccaccttgctggggtgaatgcctacgtggacagttgtgccattagccttttcccgctgcacccgttcaatgtagataacatatttcttcctgtaaacctggactactttgccaatttgctgacctttatagtgtccacgtacaacctgaacttcatcatcctttcggatgggcatggatcacacgttgtacttctgtctcagctctttggaaagaggggaagacatagtcttccttcgaatgtgggaaggtgcattgaaatgccttttgcgattcttgcttcggtcggaagtcacaaagggattaaacttcattttggccactcctgcttcggtgatagccgcaaaagggaagagccagaggtatctaataaaaggtaataaatgaaaaaataaaatgctctttcttgctctaattttaaggccacttcaaggatgccttgaggggtcatcttttgatatcaaccagaatttacagacttcagtatttctactaggtgctttagcctggatgagaggctaagacaggaaattttgctattttatttaatatttttaaaactgtcatgagaaaacaggattggatgacagatggcaagtatgtgacatatgtgacatcattttatcttctaccagtggcagacattacttaacaatcatg

SEQ ID NO: 115317 - DNA, 1718 bp, Homo sapiens
tgtttggagtttgaatttggcctttgaagtttgcatttggcggagtggtgtaagagccaggaccggatgtgtcagccattcagtttcaaagcagtggtgactgctccccgcagcccctccggcttggcccggggactgcggcgcgggtgcagtgcttcctgctcggtgccctggcgcgggccgcccgctgaattccaggggccgcagtgcggtgggcttcggctcagatgcgtcttctggtgcatatgaagtacagtatgtgtaaggtaatttagaccagcggtttattggcctcgcccatttttggctactggaaatttttatgttaaaggaaattcttttaagtgtgacagctacatccttgtttgtttgttttttaaaaacctgattaacgtatgcaaagtacaaagtcttgatgggtattttgagttgctggaaatgtttttgtgatagtccctcgtggccctgtagaattccctgacctttattatgagaagaaagcgtgtcattttgtgagacgaatttgacagtaggagtccttggtttggattcattatctaaagtgatctggcattttttgtgcatttgattatttgcttaaaatcacgatccatttagtatttggaagtccccttcctctccccaagaactaaaaaatatgcttcgcactgtaccatggcactactgagaccaaaggagatttgtgactgatacagttttgtgtgcacttgtacatgtaatttattcttacaagagttatgtacctctatagttttcccatttctgtgcagattgtattaaaacttaactggaataattctttgaaggcaacttctactttaaatgaattccagataaaaatttttaaccccaaatttaagaaattgtatctattgagacctaactttttggatacaataaataatttagcaaacgtcagcattctagtactcttaatgagctgtgaatatagtagaagagcatccactgtaaaaataatgtactgaaattgtttaatgttgtctcttgacacaaaataagaggactaaggtggaggcagatagaatttagggactaagtaatccatgcttagtatttgcgttttgtaaccgaggttttttcccctttgcttaaggtgtagattataattgcacagtataagaaaataatgggcttgtaaggataatcttttttaaagaaattatttttacgagtcagaatgctgttggtttatcccaaatgtcatacgtaaagatttcatttatagtaaaatgttgattccctaaccttatgaaatatagtgaatttttttttcttaacaattgggttgaaattcatttgaatctgttcgtataaaactttgtggggaaagggcttgtatcttatttgagtgtgtatattttgtattgcatgttggttatgctacactattacttaccatttaaagttttaggaaaaaaaacccttaattatagccaactcaataaaatatcaattgaactttatgttttacttttttttgacagttaagttacattcatacttccaagaggaaaatctaagattttgaaatatttgagagttctgtgatcttttttttaattttagaatttccttctgatctttgaatgtagaaaatatactttgaattagaatttatataaataaataatactcgtatttaaatagaagattttaagtttgtccctctttttcag

SEQ ID NO: 115318 - DNA, 1088 bp, Homo sapiens
gattaggagtaacccaaagttgtctttaagaaattatttaagaacatgtttaatcatgaaagaaataatcagggccggaattagtaaatggttcattgcaaagcatgagattagtcagatactcttttcagtttgcaaaaatatattaggattttatctgtggcttaaaacatactcattgagcatatagatatgcctagataccttttacataatcaactcttttgccttctgtgtgtgtgtatgatatctattatatgtattatatatatgtttatatataatctcatttgatcatcactgcagccccctaagatagtgtaatttctgttttctgtaggtgcaaactcatctgagatggtaaaacctcatgattacacaactagaagacagctaggattcaatcccaagtcagactgactccacagtccatttctttccactactctgcttcttccattttcttttttcaaattaataatcaaattaattgattatttttaaggagaaatttgttttgcaggcattctaatagaccatgagctaggtctctaccctgtgctaagtttgcctgttaatgtatataataggtatgtttctgtaacctggccttgtatatgtaatacaagtaaactgtatttggatcaccctatcatgtcagccaaagagggttagtcattagtgttgaatgtttcttagatttattgatttgtgctgtattaaatcataagtgaaaggagataagctgaaattaatatggttcattcatggtaatcacacaggaagagaaacttttactattgctagaccctacccctttgttattgttttagatttcatccattcaacatttatgaacttctgcaaggtggtggtcttgagtggtggagaaaaagatcatgagtgcacaagctgtttctgtcggtaggttgtagtatgaacatgtttcacaataccgtgttaagtgctataagagagatggggatacagaggggatacaacatattagtttcaaactatttctgcctattttctgataagaatatatacaacactgcatgttcaggcatgtttttttttcttccaag

SEQ ID NO: 115319 - DNA, 1058 bp, Homo sapiens
tccatctcaaaaaaaaaaaagaacctgggccctaggaattagacctgttagctacttggaccccagggaagtcacttctctgaaccttgaatttcttgtctctaaaatggggtcgttggtggtataatgaagcaccattcttgatccagaaaagtattcagttaatactaactgtagataatactcttgcaagtaactgtctatgctcactacttaaacctttaaccttttagaatgaggttaagagcctcccccaaggttgctgtgctacttatcactaggttagcaaaggcggtttgtgtagataatacatcatcttgataacaatacattttcccctgttattttgaaatgatttactagaaaaatagaaaatggcaactttcaaaattctgtgatatgggataaagcatctcctcagggttcttatctctgtgacctaatgcaggtttcttggtcttcttttctcatctgtgaaaagaaaaggttggtttacataatctctcagttccattcaagctctagcaactctccaaaaatttaacttggaaattacttcttgtggctaaatttagctgtaattattgaaacaacaattagttttttgaacttagaaactcttggaattttaaacctgggtaacaactataaagagaaatgcaaatgaaaagcaacaaaagcttagaaaaaagaaatcatgtttgtcaagcaacattaagtgatgagaaaatctgttttttaaaaagcgtaataactgctaggagaatattattttgcaaattggagaaaataaattaggtcaaagtcattagcatgtttgtgtttagcaaatactaccttagggggcagtttttaaagtaactttaattttttgacaactttgctattaaaagctatctttttcttcttaatgttaattgtataaagaagggacatttttggatataacctctaaaaaagcttcttctttgacttcttcttgtgtttatttataaagacctttttgtaaataaacatgtatgcatcttttttttttaagttaaaaatgcatcgcttgg

SEQ ID NO: 115320 - DNA, 1061 bp, Homo sapiens
tcaggctactactttgcatctttttgacttacagcacttaaatatgcaaatgcaaaattgttaaggttttttttttttttttttaaagatggagtcttgttctgtctgtcacccaggctggagtgcagtggcacgttctcagctcactgtaacctccgcttcccgagttcaagcgattctcctgcctcagcctcctgagtagctgggattacaggcatgcaccaccacgcccagctaatttgtgtgtgtgtttagtagagatggggttttgccatattggctgggcaaggtgtttcacacctgtaatcccagccctttgggaggccaaggcaggcagatcatctgaggtcaaaattgttaagccttttaaggaagagaaatgtatggcttattgatttaaaaaaaaaaaaaactagacaggttaatatttttcatgtaaaacgatcttaaaatctttgtgctctctactttctcgaatgttctgcttgacagttgtctgaactttctgagagctttgatagagtcttatacataatacgtgcctctcttagtaataaagtttgaattgctatgatagtgaatattggaggagtctaaaagttcgtaacagtatgtcacccatactgatatactgcctgagttagtacaaggggtctgcagatccacttagctaccacgtagatggtgatgataccttaagaaaggattttcacattcaaaaacatggagagccactggattatagaatgacaaagaatattttactcaaaaaaattttgggaagtactctccagatttaacgattaaaaggaatttgtggtcctattgagctttctatcttctgatggtgtctatctgcctgacaggaataatattgatgtggcagtggcgataaatgaattgtatgttcacactgaatgaccctaagctatcatcttgtagtctgatgtgatttcataggttcttaagttccaaaaaggttgtgaatttcttaagagcatgtcatggctaatggcacagtcaggacttgattatgaatttccagacccctgaatcctgtc

SEQ ID NO: 115321 - DNA, 1032 bp, Homo sapiens
cttttgttgcttctgcatccctgtctttcttctaatttctctctcttctcccttatttctgtctcagtgtttctacttattaccttgctctgtttccgtgttaagtgccactcttcctgcagtaacactatttgtgtgttttactttcaaactctcagggagagagctgactcaggcgtacaataccgttcagtacagaaggtcattggaccaaggaacattcctggaccaggcagctgtggaagctgggatggattcagatgtataaagcaccttaagcattagccaccacccttaggactgggcagacccttcgcttcccagaaaggggcagtatgtcaggtcactgggcagtgtgatagaacaatgaataagagggaacttgtcctggaagagctcacaatgtggagagggaagcagatacttaaacatatacttaattttatgatatattgtagttaatatttaccatgcagcgggagagcagctaactgccgtagaatggtggtaggaaattcttcattgaagccatattgagatggcaaagggtattcctggcagggaaaaaaaaaaaaaagtcatctgcagagacgggagtaaaatatcatggtatatttatgaagtttttttgtgctatgagaagagggccatagttggtatttaaggggctccaggaagaaggtctaatttatggtactgatgaagatgattagacatagaaccaggagaaaaagacctcatagaagagtagaggagagacctacaagagagttagcacaatcaacagtggctgacaccacattataaggggaggactgactacagtttccctgagaagggacccttgaagcatcttggtttttaacaggtgagttttgtaggtctaggaagagtctagcactagaaacctaacctcagggagtaagcgttcttgaagttctgtgtcaggtcacaaattcattcttaggaatgtctagaaaccaaaaccaagaaacctcatgtttcctaaataaacaggaaatgaagataaag

SEQ ID NO: 115322 - DNA, 1720 bp, Homo sapiens
agccaccatgcctgaccggataatagtttcttaattaagaaatgagaaacgtacctaataaaaaaaaatgttgtgaagtttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcaggtaggattcgtcaccattttatactttattagtagtagtatatggtactacctcaaatttatatactataatgttcttaaatttagatcaattaattccctatagtaaacaaagttaaacttaaaatgtattttaggctaatatttttctttaatgtatttatgaggttttactatcttaatataccatagaatagaaatttgatctatttaataaattcagtgaaaatgaaagattaaatcatggaaatagctgtagatttttcttatatacaaagataatgaagaatatgaattaatagaaactttagtataaaaagttggaaatattgtaaaagtgataaatttagaagttcttgtgaaccacagatgtattaacctataggttttctttttaactctttagaactgcagctgtgcacgtggaacattctgtattcatctgctatttgtgatgctccgggtgtttcaactagaaccttcagacccaatgttatggagaaaaactttaaagaattttgaggtagtttttaataaatgcttagagtaaaattgttagcatattcttaggatatattcttaaaatttatccttcactaaatttaggcagtgaccattttaaaggtgtgaaggtatgtaagaattagttgatgcttataaatagttctcatgagatatttactaaactttttcttctagcttgaaaaaaacaaacactgacctgctgtaagaatgttgtccttagtaaaaactataatgtgttcttatttttgaagctcttaaatcaactttatgaaaaacatgcaaattaaagataaataattcagcctctagaactcttcatatgtataattatggcacaaatatcattgttactgtctttttccaatgttaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacaggttagtactttttaaggatttcaaacattaatccagtgttacttttaattttaggggtaattttttatatctacttgttaagttgctctaaaatgatttaattattgaatcttggctttcaagttaaaatcaagggtgaagatactaaaagttcgctgggcatggtggctcgtgcctgtaatcccagcaccttgggagactaaggcagaaggattgcttgagcccaggagttcaagaccagcctgggcaacatagggataccccaactctacagaagtaaaataattagctgggagtggtgatacctgtagtcccagttactcgagaggccaaggcaggaggatcgcttgaacccaggagttcaagtctccagtgacctatgatcgcaccactgccta

SEQ ID NO: 115323 - DNA, 1098 bp, Homo sapiens
aagtctaggtgaaagattgtgtacacttaaaatgtgatgtgttcctagattcatttctgggaaagttggatcagttcatactgccaccagaaatttctgaaataggcatttaaatttaggatgtggaatctttgagctctaaggtccgccagtacttaaaatcttgaaactggtaccatgtagtgtatttttatacatagtcaaacctgttggtctattcaaaaggtacagtagcagaatttgggggatacaaatgtttctttctaagattgcagtctgtgtattgaattgttttcatagcaaagaaggttaactcacacctacaatctataaatactcgtgtgttaatctgattttaaattactgtatattaatagtgtaaatatgtatctcttagttatataagatgctcttaagaatttctaatgtatttatattctaagcaagcagaaagtgtttttagcatatccgttctactttatattcttttatgcttaatactttttcttccccttttctatagcataaaggatgaagaggaacagatgtgtcctatttgcttgttgggcatgcttgatgaagaaagtcttacagtgtgtgaagacggctgcaggaacaagctgcaccaccactgcatgtcaatttgtatgtggctctttttctccctatgcttactcaacacagttgctctctgagctaactatgttatttaagagtgtaacatggcttgaggggaaattggtgagagaataaaaaaagtatatctaagtcctaagtcctatgtgaaaagttttcaacaaatgggaatgtaggatctttaggagatgacctgtgtgagcaaagaaatgcaataaagtgtgtgtgacatatgtgataatggaagaagtgcacagaattagaaacaatttcaatctggaaggtatacatgaagggaaggaggtggaagaagacctgggcaggcattacagaaaggctagcatcaaagtaaggtttggaaggactttacctggtagtcaaacagggcagaatgttttgaaaaatagtaagcagagtacatgttatcagaatgaataaaatagcatttgcaaatcaaaatca

SEQ ID NO: 115324 - DNA, 1027 bp, Homo sapiens
actatactgcttattgtacagcttcaacttcaaaacttcttgtggtttcacttcacatatctagaaacatctcttcctgaactaacggacatacggggttattcaaggatagaaggatagaaaccagaacccttcaatgctaacttttcccaatgtttaatccccgtgcctgccaagaatttttatcatgtttcttatttgctgccatttaaaattaatttctcttttcatatcctaatggcatacaatgggtgcttaataattgcagaggagatgaataagaaaaaaatatgtgatggttaccttgagttcatcatttttatttgtaagaacagtttcccatccctttaccatctcttctgattgaatgttttttcatcctcagtaagtagggcttttttgtcagttggtttgtaatgattttcttggttgttgaatgctcagtctattattttttaaatgtaggatctaaaaccagacgggtctccagtagacaataataaagtaaaataattattttcaataatctgttaaattctgttgaattaaatttgtgaacaggtgcattaacacattgagcttatatatcattaggatttgttacatttttcttttgtgaccattacagtcctgcagctttggaattctcttagcatattagcaacccatttatgaatctaataaaatctgcaaaaatattaaacacattcttgtacctagttcattaatgaaatttaatgaactattaatgaacataggccctcacctgccctttcatgacccatcaaagaactctcaagttgattctgagctgttagagttcattctttcaagcatatggtctagtttgttttgcctaagctttaggtcagactaggctctacattcctagctttttattaagcatgttaggtaagacagttaaaacataggtagtggtacactacttaacagtaccagaagctcactatattctagttggttcattctcccataatatccctttataacaaaacatatgtaaata

SEQ ID NO: 115325 - DNA, 1038 bp, Homo sapiens
gtaaattactaccattttttaagtttccatgtatttttcagtaattggaacttatatggtaatgaatgtttttttctttcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtg

SEQ ID NO: 115326 - DNA, 1061 bp, Homo sapiens
gtacttaccaactagaagtccgtggcccttaaaatacggttttaataatatctttcagacccttattctcgacctttctttgccttggcaatattcaaaaaacaggttttaatagatttacttaacggctgttactaataaagaattctggggtaatttatagcagttgttttgtaataaactcaaagtgcacataagaaatttttaaaaatattctctctctattctaaaaggagatgagcatacagaggcagctcctgtctgtagtggaaggagtttaagcattgttcttctgactcagcttcttctgtcgtgttcataattcttcatgttcatatgtagtaatgatctgttgtcctcttgccacatagtttgctaagagcaaaattctgtgatgggactctgcttcagaatctcacaattctccaaaatatttttgtgctacctggaaaattaagctcattaatgaaataaattagatattaggtagtccacagaattcctgtttgtaccagttttctccctaaagtaaggaagtagaatctataactacaaaatggccttctctttttcaaatgagtcctatttccaaattaactctgatttattttaggtactaagaggtcaacagtatggaaggagctgtgatgtatggagtgttggctgtgctattatagaaatggcttgtgcaaaaccaccatggaatgcagaaaaacactccaatcatcttgctttgatatttaaggtaattgtgagataaaaattacttctttgtgctaaaaggagtacagcagaatttggcaggaggcaaattttgatgggttctccctaacaatctagcatgaaggtaaataaatagtctgtatatttattcagagaggatttgatatacaagttttttactttaagatggtgcaaaagcaatacaaatttggtaaaaaccatactttgaattttgatttttgtctgagctagcaatatgtgctatgatacactggtgatgctaggcagtggcagcgagtcacagctcccagtcagccacacaatcacgagagtgaaca

SEQ ID NO: 115327 - DNA, 1575 bp, Homo sapiens
gcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaacaaatgttgttacttttatttattttgaaataatttcatacttatataaaagttgcaagaataccacagagaacttctgtatacccttcacccaaagaccccagtcaggtttcaccagctgcccatttatgtcctttatagcaagaggatccaaaccaggatcacatgttgctctcagttgtcatgtttcttcagtctcattgaatccagggccattccttagttcttccttgaccttaatggccttaattttttaaagatttcagattattgttttatagaagctcttcaaattgagtttgtctggtgctgcttcttgattagattcagagtatgcacttttggcaggaacatcacagaggtgatg

SEQ ID NO: 115328 - DNA, 1028 bp, Homo sapiens
cttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttcactaaatggaggaaactattagttttattgttaaatatggtagatattaatattcctcttagatgaccagtgattccaattgtcccagtttgaaataagtaccctgtgagtatgagataaattagtgacaatcagaacaagtttcagtatcagatgttcaagaggaagttgctattgcattgattttaatatttgtacataaacactgatttttttgagcattattttgtatttgttgtactttaatacctggtgtacagttccagaaataaaaatctgggaatctttttttcttggtttgtgtgaatat

SEQ ID NO: 115329 - DNA, 1340 bp, Homo sapiens
gttgccactcaatggtttacattttgggacatcttttaagttgtttgtagcactgcagttcaaagtgttaatatttagagggacttctagattttatacctaatgcagtagaaccttgaagtatatttaagcttttttgttaagcttgaacagttggcaagaataatgtgagttcctatctgaaatagaatggtacattaccacttttaagttttaaaaattgatagatgttcagatgtatctcaaactcagttttatttttattccaaatattgtgaatgagaagccattgtcctaaactttggccatttttgtgctataaacatgcatttttaagttataaggtgaatcaaacaatatgtaatacagtattaggatgtaatctttgcttttgtagtactgttaaaatagagaattatgttgtttgcaccgtcttaattaaaattcttgatttttactagttgctttgcaaaaaacaaatgtttggctgcattgctaatatttgtaagtataagttgcttcaaggttgtgctgatgagtagataggatgtagtgatcttagtagtgattgaaagggagggtatttattatacaaactgtgaactgcaatgacatccttagttttggatgatgtgtattcttgtttttctttgcagcattttaatgaagattgctttgaagtgtttacgcagtagcacattagtataaaatttagtttagcacagtggacaaaaagtagttaaattaataacttaaaatcagtctctaatttatacatctgaagtatagcattcctgtatgcacacagtaaataatgggtagcctgggctctgtgttactttcttgtatttttatccaagttgtcagcttcttattgctgtgttgttgtgctaaactttgaaccttatttcttttattaaaaatcagtacactttctataatttagtaagatactggccataatcttccattgttataaccttaattttcactctgggtttacagtggctggtctgtataaataatttacacaaagatgactgaatgctaataccagttgcacttaaatgaacatgcccattctcagtagctgatgcagtaatatattcagtttatctatgcattgctggggtcttgatataagatggaaacagtgtttcttatctaaagttttgattatcagcaagttgaatggacactttagttatttaaataaagatttttgaccaaaatccagaaaatggtatgagagaaaaataaattccagctagtttaatagatttttaaatgtcaatctgattttagcctcttagagagtgctaactagctggtaatgttta

SEQ ID NO: 115330 - DNA, 1011 bp, Homo sapiens
atcacatcaccagtgccaaaatggctgtttctgtggctgactttggcagtctctctgccaacgagaccaatggtttcatcagtgcccatgctctgcatcagcacgcggccctacactctgagtgacctgagtgaggatcccggaactgcgtgtgcagcaccagtaaacttgaggggagctatcaggtttgcatagtctttcactggaagtttgaacctttctcactatgacatcagtgatgtcagtatgtatagaactatatcttgatttatcaagagtattttcatttttcaatccataaatgtggaaatgaactatgatcagcagagttgggaactaagattgaactctgtggtgcagctttaagctctgcttctctcttcctcatctcccaatacctcttccccactcccttctttttctattcttttgtgttccccactgccctcactcccaattttaaaacctgtagacagaggccaccagctcaaaaccagcacagatgttctgaactgaatggtgtggcctgtttttgtgtaaattccttttgccgtaatggatgcagtggaataacaatgtttacaggtaccgatcccgatccctgctcaatgtagcatttttttggttttattttcttaataaaagcaggggtaggtttctttaaactgcacaaacatgcaaggattttttaaaaatggaaacttctctcatgttattcaactagagcacttcagtttacaaaacagcaagtccatctttatggaagccagcacaaggaactgtgtgcaaataatgaagacgcttgcttggatcctgtttcaaaattctagaccagggctaccttacacagaattggtcatgttactgccaggagatttctgtgtaacttcatttattggctacagttttggcatttgaagatgtggtactcagatggggttttgtccaccattgtcaagattgtaatcttaaaaatcataccagtcattgataatttagtttatcctgagg

SEQ ID NO: 115331 - DNA, 1066 bp, Homo sapiens
aataattatcaggatactatacacttttttttttgagatggagtctcactctgttgcccaggctggagtgcaatggcgtgatcttggcttactgccacctttgcctcccaggttcaggcgattctcctgcctcagcctcccgagtagctgggatgacaggcaccccccaccacgcccggctaatttttttgtatttttagtagagcctgtcggccaggctggtcttaaactcctgacctcaagcgatccacccacctcagcctcccaaagtgctaggattacagccatgagagccactgcaccggccaggatactatacactttattaggattttcagtgtctcattttgaccaatgtcgattgtgagaaacatgcaggtggtttagtatacttatgctgatctcacatatttaacaacattttgtaaaatacaacaggcattcttccaggttctgcaaaaataggcagtaaaaacctttttaatttttgtcttttaagcaaatactgcatgtgatggtgataaggaatcagaggttgaagatgttgaaacagacagtggtaattcacctgaagatttgaggaaggtaagctgagttaatatagtggactaaattggcttttaaaaatatttctgaaatgatttatgataattttgttgttttgacttgtagaaactgattaatgatatggggctttttttcagtattttttttttaataagttatttttacctctcaattttcctgtaggaaataatgattggtttacaatatcaggcagagattcccccttatcttggagagtacgatggtaatgagaaaggtaaggaaagcttttgattttgataatgtttggtagataaggttaccacttgataagtgtatttaaatatctggctttataccagccttggcaatagatagatagatttgggaaacatgcagagttaggatttttaggcctgacttaggaaaaatgtatcaaagttaatcactagactcagagtttccccccacccccaaccctgcccaaggcacacatagtgcttattagccagtgtgctca

SEQ ID NO: 115332 - DNA, 1279 bp, Homo sapiens
ctggttctcttcctgatataaatcctttgacttacagaacagttcatttataagtgtgactagactctactgtgtcccttaaaatgtaaataggttcaacaaaatacccaagaagaggaagagaaaaatccttatacccgggataaggtgatggatcacacttctaagctgatttagctaccacagatccttacagactttgagacttactaattcaattttgaaaaaattgtttttatgttttaaaggacttaagtgctttattaataggctctcaaagagagttcatttgtgaagtgcttcagagactagattcaccttttccagttttgctttaaaagttttggtgcaaatgatgtgtgttttagcatcagccctctggccacccgtgtcatcccttgaacttattaatgcagtttctacggagatggtcatcttgtccctcaacagatggtcattcctgtgtctttatagaaaagcggggttttcttgagtggatgctgggaacctcctgtctccctcacatgtacaaacttttatattattctttccctcctgtcctgcaaagtatctgtgatatcccaggctaacctctagattctatccctcctgccctcaatttattcttctaccttttttttttttaaatttccacataagaatcctactaatgcagatcccacatttggaagaaattctcttttgatcttgtgttgccctcagtcactctccttttgtagccaagtctcaagtcatgtatgtactttcttccctcccgttcagtctttagcttggcttcttccaccatgctataaggccaccaataattacttttttagagatggtctcactctgtcacccaggctagagtgcagcggtatcatcatgccaactgcagccttgacctcctgggcttaagcagttttcccccactcagcttcccaaagcccagggattactggtgtatcccaccaccctggctaatttaaaaaaaaattttttttatagagaaggggtcttgcaatgcccaggctggtctccaactcctgggctcgagcaatcctaccttggcgtcccaaagtgctgggattacaggcagcagctaccgcgcttgtcccaggtcaccaataattcctgattgccagatactaagatttcttgtctttctcttgctcagtttctttttggaatttgacccaagtgaccattcttgattatccatacttgtttctgccttaatttaagtaatcctactttttcctcgttctattttctggct

SEQ ID NO: 115333 - DNA, 1466 bp, Homo sapiens
ccaaaacaacttgcaatggatatatcttccaaaaccttcagatgtgattttctgtattccctacacataatcctaagaactttgttagtaatccaaagtaaagcaaagtcttacagtttaatgcttgtctgattaatgctagggaacttgaagtactgttagagaaatgtaaagtgatacaatgcttttaaaagctgaatggctgtatagctgcttcacagaaacttatatttgttttataaagcagatttttgttgtgttttctgtctttatttgagggttagaatttgagtaaaatttatattatcctgaagtgtgcatcttagtgtatagtcgattcttgtgaaatcttccattcatggaaatttaatctttctgatattttgctattgcttttagacagatgtattaaatgataagcaagtttgactttttctattagaatgtttctttaaaaccatgctgcttaaatcactttgttgttatcataagttgttttcttgtggactaaaccccttataaaagtgtttgtgaataactttgccttgttattttgctgatttagacatattttcagaatcatggggtcttaatttataacctataaattatatagtaaattcatttagtaaaaccctcatataaacatgaaaagggactggcagaagaacacaaatttttattttcttttgttaatagccttgtaaatgtgtaaagtgattcagtttgttttattccagttgggtctttgtcttctgaggatcatgattttgaccccactgctgagatgttggtccatgactatgatgatgaaagaactcttgaagaagaggaaatgatggatgagggtaaaaacttcagttcagaaattgaagacttagaaaaggtataagatttactttaatatacaaacttaacaaagattttgaaattctgttgtaattttaaaaataatctacctgaaataaaaataggatcataatccttttttttttcactcttattttgggggatagcctaataagtatgctttcatttaatttttcaaaattattttgtatctgttaacttaatttttaagcttatatcaacacagtgaagtaggtacacgtaggcattttacagatgagaaaattgagatacggaaaactataagccctaagattatttctgaatcctagtctagccctctttccattgtaactactattctgctaagggtcaaacttgaatttgtataagtactgtagtagatacagagagaagccttttccttcaaataactcataatctagtggaatattttaagaaaattgaaaaagatttactgtattttcaaatataaattggtaatatcccatcccctgctcctttaaaagtcatctttgaaaaggttggcaagagtgagtgtagtttgtaattttttaagccccaagtcaatataaattcaaatgaactgtattttc

SEQ ID NO: 115334 - DNA, 1034 bp, Homo sapiens
gatgtccctgatgggcttgttcaaggagacttcaccagcataggaggtcaaggctggctgcctggaaagacctctgtgggtgggtgacaggtgccaggtggtaccaaggagcaaaagaagttgactaaagatcagttgctaagaatactataaatatttagaatctcaacccagagagttttccaaattttcctttacctctctaatagtagctctgtgataccacctatgaggttactccaggagcagcatatgggaagagaatgttccagagcccaaggattacagcatgcctggtactgtgatcactctggggccacagaaacaatcaaggatcccacggtccactgaccagcacactgaccattgttagtccactgccttttttgtcctgtctggagcctagttctttattttccttttcccacagaacagtctttcggttccagttcagctacagccaactctcatagagatccttaagcaaagcctactttgtttttgaagtctcagtcttctttcccatgtcccatttcttgcatctgggcttcggtctttgagcctatccccattattaacctggaaggtatccccatatcctcttagaacaggagcctgcctttgtcttgccagtctcgctcccagggaccagacccacaactattgatacaggagtgctgggaagggaagagcgtggtccctttaaatgatacagaaccggggaagggaagtgctgggtagaggactgcgtggtccctgggtagggctctacccccatggacatagatgaggtcaggcccttctgcctttgggcccaaatgttgcattttccaagaccgccctggctcaccacacccccaccatgggctaataaaaacctgagaccctagcaaggcagagacagaagctgctggatggcaagaggaacacatcagtggaagaaaacacaaaaggctggacggcaaaaggacgtcgggacatcaaagggagcacgctagcggaagagcacaccgacagaggcctgcaggccatca

SEQ ID NO: 115335 - DNA, 1029 bp, Homo sapiens
gccttgattcaaataactactctgattctcaatagctttttatgaaattaccatgcagagcctaaattggtgcagctgaattaaataaatatcggagtttaacattcttaatcgcaaaccctcaatttaaccaaccatttattataatcaaaaagcaatcaatatgttgattgtggtgacatgcaaaatggaggtagaattattagtaattaccatatatttgtggttcaatgtgatggtgaaataactgggaaaaaaattttaaagcacactacagttaaaggactggttgctatgttttggagcagcatgctatattgattgtagtctttaaataagttgagtaacatagttgctgtcaaacatatgaattattcatgaagcaaagtttgagaacactaaagcagcccctgtttatgaatattcggacgtgttaatatataaacgactgacccaacactaaccaattcttgcatgaagaaaaggtctcagaaacaaaatggaaatctattaggcaaactcacttgagtcactcgcttgaaatgtaatcagtctgagagatggggaataaagactgagctgcaagtcagggaggtatcaggccaaagagggaggcatggggaccttcttcgactgggattgcttggtgatgccaaagtcttttttgcaggctccagggaccctggaatttctatgatcacatttgcaaaggtgtggcctttggatcccttcctatcaatattcggaactacatagtaacacacctctggtttactttttcagccctatttaggaaaggatgaaaggaaatttcagagcattccatatttgagaaaatcctcacaatttcttttctctaaataaatttccacaatggcctgtaagctgtatgttttaatatttacaaggcctcattagaaacacaattcttacttcccaaaaactctggacatcactgagtcttgggacaatatattttagtaaaagataaaatagagaatttttctgaggccagcagattacatagat

SEQ ID NO: 115336 - DNA, 2070 bp, Homo sapiens
gttcctttgagtcctgtggggtctgaggggacatgtgcatttttgagagagaaccattctttggtttacgaaaagggccctgtaccttccaccccctcagttttgggagaaacctgttttcttaattcgaggaagtggaaacctacaccttctagccctttgctccctcagaagtggggaagtctcctcgggagaatttaagaagcgggtttgccctacttctagttcacctttctggccttactgggtgggaatatgcctcctctagtagacgttctgatttggagggagcctctttctctttacacttatctctgagttacattcgctaatactccgtggcagcacacctgtcttcgctttccttggtccatcgaagagggttggagatcttttgtaagattatgtgtcaatttcatagttttaaaatttattcaagaagtataagaaggtttgcttatataattccccagtatgggatctgcaccccttcccaggtgaaatctgcccttgccctccataataccgtcacctaccgtttttccctccctctactccgatgtcttgttcattcagtagacttttatcgggtgcttgcttgggtaaagaagcccttttccaggctcctgtagggttatatagaagtgattttctctccagaggttgactttttaagttggggattgatttttttagctcaaaatcaaaactcagtatataattttttttataacttttacaggtgattgaattactcagatatgaagatcatcatctaggttttgtgtaaaaggccctggatattttaagtggccattttggatttacagtgtttttggataattttgccccagaagtttattaaaattggcaagaatcgtctgtgaagtgaattgatagtagtgaacaattcagcaagctacttaaaaagagacccaggcagcatttcttcagtattttggttcaaacggattatataactggttacagtatttcagctggtggtaatttttgcctccccttcccccaccccgttgttggggttcttcagccgaaactgagagacgttgatttgtgtactgagtagtttcagcagtttcaaatgactgagtattgctgaagtttcatggcagtttatttttacctttattgaaagttttaggaatttttgacttcagctctttcatgtcacaatgggacactttttctgaatgaagagattgaaagaatacagagtttttttccttttatcttttatttacgtggaaatttaagatgttgcagttttccggcagcatggtagtattgagatagctatgtgtgtctctgtatatgctgatgtttaggaatgctcttcagatgtgaaattttctttttgtttttgctttttggctcgtaaattggatatttcatctggagtggacaagtacaacagtggcaagtacatggaataataaagaagactttgatcttaaatctaaagaacttggctaattcgggagatagccatatgaaaactttaaaacagaagtatgggtagctgacttgaagtaactctatgtcaaatagtcgtaggttaagtatcttcaaagaacttcgatattatttcagaggatacaaaataaaaatacaaactggaaaataaagattacagagaaaaaaccaacaccttcctgtgcagtcctgttggaatttgtaagtactattatggtgagcaaatcaaatgttcatttgtaaactgtaatcagagttgagtttatcctatgttattctcggaagcctttcagtttcttgcagtaacattgcttggtttcagtttccttgacagtctgaaaacaactattaaccattgtctgagtaaactgaaattcagaaaaaacgtttaaggcttaggaacttttcagattcaaacagtcctaagctacaagtttttgcgctttttaagtaaaaagctaaattcgtatggccggtatatattgccttaggctttgaagattcattcacagtggtagaaaggtaggaaaaaatgcaacaaataattcaccacgtgtcttcctagccagtttgtat

SEQ ID NO: 115337 - DNA, 1050 bp, Homo sapiens
agcagttcttcaaggacagatttacttgaacgttttgacagatattttcagtattttatttttctggagattggaataaatagttgcatccgttggtaattggaactattgctggacgctgcttttccccagaagttaacaccacttttccttttatcttttctactctttatattttgcttttttgtccctttctaaactgtaggtctaaaaataataatcatagtggctaacatttatagatgatgatggtttttttgctgtgtaatttatgtggcatattttaattaattcttaatcccgtgaggaaagtactattatagtcactgtggtactgatgagaaaattaggatttaggggggctgagactgggagaaagttactttgttagaattgtaatcttgaccaaataaatgttcaagcagtctgactccagagcacatactcagcactatgccatacttacactgccttcttggggattttactttactaattcatttatttgaacattatctttgatatttttttcttttcatgtactgcttctctttggttgatgttgattacagactgctaatggagtttggaaataaactaagagatattactgttttgctatttgcagtaactatttgggtgatacctttggttagctaaaattgtgtgtgtgtgtgtgtttgagacagggtctcgctctctcacccagattggagtgtaatggcacgattgtagctcaggcaacctcgaactcctggggttaagggttcctcctgccttggcctctcaaagtgctgggattacaggcctaaaccacagtgcctggccttgtatttttctttcacccatagcctgtttccacaggcatggagctaaatgcatagctttgttttaccttgtcttttttttgttgtttttttgggtttttttgagacagagtttcgcagttgttgctgagggtggagtgcaatggcgtgatcttggctcactgcaacctctgcctccccggttcaagcgattctcctgccccttcagcctcttgagtagctg

SEQ ID NO: 115338 - DNA, 1325 bp, Homo sapiens
ccttgcttactgtcttactggcccattggccttctttctcttacctgaacacgagacatttttctttatatttgttccctcttctctgttcttcccttgtcagctcaattttagctcaaacctaactttctctgagattctctaaccattttgtgtaaagtgggccactctattcaatactttgatttctcttattattctatattatttcacttaaagcacagcttataattatcttgtttaccctgtgcccgtctttatcacataagctctttgagagcagggaccttgtctcatttgtttactgttgtagtctcagtgcacttatttgcacagtaaaagaactattaacatctataaataatttagccttacttttttttaggggggggattgggtgtatatggttgtttttattatagagctatttttaactgcttggggactaggtggaatttgttattggattataggagggttgatttgttgtcatgtcatttagaagctgttttatcagctgggcgtggtggctcatacctgtaatcccagcactttgggaggccgaggcaggtggatcacctgaggtcaggagttcaagaccagcctggccaacacggtgaaaccccatctctactaaaagtataaaaattagccgagcgtgttggcacgcacctgtaatctcaattactgggaggctgaggcgggagaaccacttgaacccaggaggtggaggttgcagtgagctgagatcacgccactgcactccagcctgggtgacagagcaagactccatctcagttaaaaaaaaaaaaagaaaaaagctattttatgtgtctagaattaaataaattgttatatgagctttttgtctgctagattcaagactggctttggatttgctgttagcttttttttttttttttttttttttttttcctgagacaaggtcttgctctgtcacccaggctagagtgtgctccattatcacagctcactgcagccttgacctcctgggctcaagcaatcttccggcctcagccttctgagtagctgggactacaggtacataccaccatgtctggctaatttttgtattttttggtagagacggggttttgccatgttgcctagaactctaggcaaaacatgttgccttgaactctaggtaaaacatgttgtcttgaactctaggcaaaacatattgtcttgaactctggggttcaagtgatctgcccgccttggcctccccaagtgctggggttacaggtgtgagccattgtgcctggctcctcttagctgtttttttcttttcttttttttttaag

SEQ ID NO: 115339 - DNA, 1004 bp, Homo sapiens
ccttttctttctttcgttttagaattatgctgctggccaaggcatggatgcaggcagggagaaacggtgataaattccatgttctttctatgttagtgcttgagaaggtaatttcattttctgtttaattaaaacaaaacataaagcattgtagtttttgtgtcttgagtaaataagtttgaatttttttttttttttttttttttttgagatggagtatcatactgtctcccagcctggagtgcagtagcacgatctcggctcactgccacctctgcctcctgggttcaagtgattcttctgcctcagcctccctagtagctgggattacaggcatgcgccaccatggctggctaattttttgtatctttagtagagtcagggtttcaccaagttggccaggctggcctcgacctcctgaccttgtgattctcccgcctcggcctcccaaaatgctgagattacaggtgtcagccactgcgcctggcctgaaaattttaaataacaaaacttacttttgtatcttaagggatacactccgttgcccaggctggagtgcagtggcatgatctccgctcactgcaagcttcgcctcccgggttcacgccattctcctgcctcaggctaacaagtagctgggactacaggcgctagccaccacgcgcggctagtttatatttttagtagagatggggtatcaccgtgttagccaggatggtcttgatttgctgacctcgtgattcgcccacctcggcctcccagagtgctgggattacaggtgcaagccaccatgcctggcccatgcctggctaatttttgtatttttagtagagagagggtttcaccatcttggccaggctggtcttgaactcctgatctcgggtaatctgccctcctcggcctcccagaatgctgggattacaggcatgagccactgcgctcggccatgagccttgttttttaaaaagttaaattctgtatcgtatgaggtaattgttaggtat

SEQ ID NO: 115340 - DNA, 1080 bp, Homo sapiens
atttttgtatttttattaatagtagaggtgaggttttgccatgttggctaggctggtctctaacgcctgacgttaagtgatctgcccgcctcagtctcccaaagtgctgggattacaggcatgcgccaccgtgcccagcctgttctattagttaacaagtcagtttttattacaccatcagcgtacactaagccatttatttcaaagttgtcttttgtagtaatcagagtttcacaaattttaattcttaccagtcatatactttgaacagagcatcttacctttttctatactgttttttactcttacatggattgacttgttaatgatatccaccatacatgatgtacttcagtttgcagagtgctttgctgaacattatctaatttgttcataattccatgaatgtggtgatttagaattattcttagtccctgctgtactcattttaaatattgatctcctttatgagggaaagtaaaatgattgaggtgcagagtaaagggtttgtgcacagtcactttgggatgagggtgatttatctgagttttctgtgtctttccccatctttctgtaaagctgtttgcctcatttgatatcaaacccatccgttaggctccattaattcccagctgattgctctattgttttcattaatgcctgaagggcctaaatttgatccatgctctgatccaatttagttatggcaggtgtagttttgaggcccagtctcctgaggttggttctgaccctagtagggctctccttacgtatctctttctcaggttcattcagaactagctggcctgtgattcagcttattgctcttcatgcagaggagctacttattttcttactaccagtatctccattgtttctgagagggctgttagtgtttgaataaagttagttcctttgagagactgcttcttacccttggcaaaatctttgagtcattactccacgtgctaggtggagcaatagcctgaatcttctaagtttttccagtgtgaaactacttattgcttattcagcttattgctcttcatggagaggagcctcttattttctcactaccag

SEQ ID NO: 115341 - DNA, 1947 bp, Homo sapiens
ccaaagtgctgggattacaggcgtgagccaccatgcctggcctttttcaaacatttattgatcattttcatgcattttctttttagattactgagacgacttgttaaaattttcccttcccttcccatcccgttgcatcgcatcgcgtcccgtcccgtcccgtcccgtcccgtcccttctcacatgcaatggcgtgatctcggttcactgcaacctccccgcctcccaggttcaagcgattctcttgcctcagcctcccgagtagctgggattacaggcatgtgccaccacacctggctcatttttttgtgtttttagtagagacggggtttctccatgttggtcagctggtctcgaactcccaatctcaggtgatccgcttgcctcggcctccgaaagtgctgggattacaggtgtaagccaccgcgcccggcctaaaattaaattctttaaaaaaactgttggaagttttgattgtggttttatcagattagtagattaatatttggggctagtgacttttatacattgttagaacttttctgtatttctaattttttggaatacttattgtacattcttttattttgatacctttttaaaaacacttggtttggggaagaggaatatggaaataaatttaagggacttagaactgaagattcatttgacaatttttctctgatgtagaaggaaactgagctgtagtgaaaatttatatcaagtagtgtatgataaagacttaacattttgttgagaaacatcgtattttaacttgttttccatacagtggcattttacctttatattttttggaaaaaaagatgtcgaactctaagcacatgtgcttgtttccattagatagaagaaaatggaccatcggtgaatccattatacagttacccagttatcaaataccttgaaaataactgcaatatgttgttcttaatcatttaaaatttttggaaataagtgaagttggagtattactagtttttaaagttatatttaggtttcataaatacctgtatttttataatttgtttcagtcgtcattgaattttgagaagcattctgaaaactttgcatggacagagaatcgttatgatgtgaaccgtcgacgacacaactcttcagatggctttgattctgctattgggcgtcctaatggaggtaaaatttgctaaggaatgatgtttatggctaattttctttatgatttttaaagaatgttttgatgtgattcaatctttaagcttctcttctttgaatttatattactttgctattatcaaataaaggtaactttggaaggaaagaaaaaaatggatggcgtacacatggaagaaatggtacagaaaacataaatcatcgaggtggataccatggtggaagttcccgttctcgtagcagtattttccatgcaggaaaaagccaaggactacatgaaaacaacatacctgacaatgaaaccgggaggaaagaagacaagagagaacgcaaacagtttgaagctgaggattttgtaagttttttatgacttttatacaaatgaagtttctgtaagtgctattttaagtgattctcctgcctcagcctctccagtatctgggattacaggcatccaccaccaggcccgcctaatttttatatttttgtagagacagggtttcaccaggttggccaggctggtcttgaactcttgacctcaggtgatccacctacctcagcctcccaaagtgctgggattacagccactgtgccactgcgcactgagccactgtacactgagctactgcacccggccaaaatactgtatttcttaaattacagaaaaattgacccagtgtacagtcatatttatctagttcttgcgattcattcttgataatttaaaagctagatagaatttgcactctttttatatattcattgtcaattcttatt

SEQ ID NO: 115342 - DNA, 3998 bp, Homo sapiens
gatcatagtgtgacatgaagttaatatttttacctatgaaagtggttacgtatatatatatacacatatatgtatagactgttacagataattgtataaatttgcttgtggagctagtctatatttgaagttatttgtctctgatttctgattttcaaagcttaatgagagttcttctagaaataacccagcccccatttttttttaaaagactgctgacagttcaatttgttagcattttacagaagattaaactgaactcatatagtacaatttagacagcttttttaaagattcaagtgaagtttaaaataatggaaaattttatactaagatttgacatctgaaaaataaaattaatcatttgatactaaattcagaggtgctcaatccatgttggaacttaaacacatgttcatttgtatttttctattgaaaatcaactcactaaaacaaaaggattgtggcttttgacagcatactagtcctaacagtaaaggcattattttaaactttgccacttcctgtgctatattgtatgtatgaggtgaaactcgggaattattttgttttcttttgatcttcctctttatttaagggctttttgagggtgggggtgggggtggtcagacacttttgttagaaccatgtgaatggcattgttttttctgtattgcaaattagtatttctaccactctccccaggcctacacgcccagacacacacatacccaaccaaaaaaatctcccaagctcctctcttaggtatgtttccttattattcagtttttctgggaacaactgattgcataagaatatagaaccacctggaaggtgttaaatagaatctctaagaaattaggaataatttggatttgattagaatgaaagttttaaaaatcaagaatgccagtgagcgtttgtcatataaaactatctatagatactattggtactgatcctgggttgatttaataatcttagaaatgatttagagacaaagacatatttgaaaataatgagagtaaaatgtattaatatgaagattttggttctactgtttcagggttggtctaaggattttgagtactagttgaaaagatgttcaaaaggaagatgtactctttactgtgtttaggtaaactaagaaatgtgtctgcataaacaaaaaaagaaaatggttaattgtggaatggttaattgttaaattcccagtacttcccataggaatacaatgaaactctcattgtatcacactttactattcctctctcactttcccccctgggttcccaagtattgttttccctattgcaacatttaaaatagctatgttcctgaggaagacgagaattttaggaaagacttcaatagagcttttctagtgctacttccttccaggtaagtaaaaatttactaacgaaaatataatatttattaaaaaaaaaaagcaatttgtccctgaaactataattttgtagattgaaaactggcagacttaaacatgatgccccaatttgagaaataccctgcggggaatgtagttaagtgatttataatatagctacataaattgaattctgcttagaacctagttggctttactggaaacaccctcatgcagcttatatctgtgacttcaatagtgtttttatgttaaccagaatcatagctattaggtacataaaattaatggttattaaatagtccatctccacgctgttaatttaaaactaaaacaggaattcaagctgcctatgagaatttaaaaataatgtaattgtttgattgatttctttggtgagtgaggaagaaagagtgatgtatgttcaagtgttagtgtgcagttgagttgagttgcattaataattagtggcgaccaggcatggtggctcatgcctgtaatcccagcactttgggaggccagggcaggtggatcacctgaggtcgacaccagcctgaccaacatggagaaaccccatctctactaaaaataaagaattagccgggtgtggtggcgcatgcctgtaatcctagctactcgggaggctgaggcaggagaatcgcttgaacctgggaggcagaggttgcggtgagccgaggtcgcaccattgcactccagcctgagcaacaagagtgaaactccgtctcaaaaaataaataaataaataaataaattagtggctactgatcatgtgtttttagaagtcctatggagtactgtttttgtgccagtgaccatgtcagcaacatactattggcagaacttaacatttacttaagatattaaaaaatcagaaatttcagtgactagtaattagcttaagcatggtcttcttccaactcagcatttatatattttttcagctccttggtagtttgatgagctttcttgattttagctcatatttgatatactacttaagaacataaaggttcattgctcagagttcttttggtttgttgagcattctgaatcaaagcaaattagtcaccagttaatataaatggattgttttctagagaattccaatatttgccacaagcatacagattgagtgacataattgcattcagtgaggtaaattatgatgaaagccaatggggattgattttattaataggaactttggtaaacagaattaagggaagggaaaattcttcgttggatttttttgacagtattctgttgatgaattgctttgtatgttgaaatgacttttaatatctgtcttatatgaaaacagttgttgaaattatagtgttttaagaaaaaagtagtacaacgtgttcatggttgaaaagggaaaattaataggatttgagtagacagcttgatacagcttgacccaagtacattttatttggtctgaattacttgttcaccatggaaattgttgatatttgtgaaatgcatttctttaagcatgttctttatatgaataacgttgagagcccccgttaaagggggaaagtaccatatcgattggtgttgatataaattataacagttagtgaaactcatttgactaaaactcacagtattgtaaaccaaaatagatttgttaataaaataaagacgttaaaaaccagctgggcgtggttgctcatgcctgtaatcccagcactctgggaggccaaggtgggctgatcatcagaggtcaggagttcaagaccagcctggccaaaatggtgaaacccgtttctactaaaaatacaaaaattagctgggcgtggtactgtgtgcctgtaatcccagccacttgggaggctgaggcatgaaaatcgcttgaaccggggaggcagagtttgcagtgagccaagatcgcgccactgcactccagcctgggcgacaaagagacactccatctccgaacaaacattagaaaccaacaacattcaaacagcaccaattgttgtaaaaatgatcttaaacattttttttggtattaaaactagtgttcacaatagaaatttgtttaaattgctgccttatagagtctttgcatttggtctgtgtatgtactattgtcttagtgataagttttctcttcaaattaattggaaagcttgctgggtgcagtggctcatgcctgtaatcccagcatttttggagcacaggatgggggtatcacttggggccaggagctctcatagggagacccttgtctctacaaaaataaaaaataaaaaattaactggacgtggttgtgtgtgtctgtagtcttagctacttgcgaggctgaggtgggaggactgcttgagcccatgatttccaggttgcagtgagctacgattgtgccgctgcactccagcctgggcaacagagcaagactctttctccaaagaaagaaatgaaaacttgattaattcagatactgattacccttcacttggctacatgcttttgttgatacattaaatttacctcttctgtcaaaataataggaaactaaattagtaactggcatcaatgtgatgatgactcttgacgtcac

SEQ ID NO: 115343 - DNA, 1053 bp, Homo sapiens
aatatctgccacaggaacaatttccattttcttcattaatataatggtggaagaatattgagttcagaatcagatgtggctaacattagatcttttgcttattgattatttagattttgggcacattgcttaatctgagtgaatttattcatctgtgaggtgaggatgaccacaaaaattataatgagaaaagcactgttgggccgggagtggtggctctcacacctgtaatcccagcactttgggaggctgaggcaggtggatcacctgaggttgggagttcaagaccagcctgaccaacatggagaaaccctgtcactactaaaaatacaaatttagctgggtgtggtggcacatgcctgtaattccagctactcgggaggctgaggcaggcggaggttgtggtgagctgaaatcgcgccattgcactccagcctgggcaacaagagcgaaactctgtctcccatttaaaaaaaaaaaaaaggcattgttaaggttaaattgtctactatgtaaaaatatttggtcatgtcacaggtgtttaataaatgtcagctaattatgttgttcaaatccaataaatgaaggagattctagttgtagctttgttagaaggcaaaaatgaatttctaggtagtgggccaaagaatgaagtagttaaatgtagtgattgagtcagaaacttcatgtatgtagaaggtagctatatggagagtgtagtgaaaggaaagaggtgaggaattgaaatgtcaactctgaattatctgtgtggccaatttactttgtattatatgtggcagtatttttgttctaatttgtcttcctgagaattgggccagttccccgtcatcactgcatttatagaagaaaactaattcttacattcataggtatgggaagagcatgaataacaagacaataaaagtgatatttaatatttaaagtcaattatagggccaggattggtggtccaggcctgtaatcctagcactttgggaggccgaggtgggaagatcagttgaagccaagagtttgagaccagcctgggcagca

SEQ ID NO: 115344 - DNA, 1031 bp, Homo sapiens
gactggagtacagttgtgccatcacagctcactacagcctcaacctgggctcaagggattctcctatgtcagccccccaagtagctaagactacaggtgcacatcactgtgtctggctaattgaaaaaatttttttttgtagagacaaagtttcactatattgcccaggctggtcttggactcctggactcaagcggtcctcccaccctggtctcccaaagtgctgggattacaggcatgagccaccacacccagcctacttcctggatctgataccttcatatttataaaaatttttatttcttcttatatcttcagctttccacattggatcattttccttctgcctaaagtacattctttagaattagtaaggatcttttgaattattctatttttatcaaagttgcatttctgccttctaccatatctggcattttcaagtcctgatccctttgaggctctatgtggtagattaggtcctcctcagctgttaggttcctttgtgtacactctaaattgaaactttttatttacttctctagaactgtgtgttgaaatcattttcttgctgatgactctactcctattttatatagttgtgtttggtttcctcccttacagtaattttaatataagaatctagaagaagataaacttgtgtgcttagccacattgaactagaagtctctgttagccatgtttaaacttacttagttgtagtatagtgatagaactgccccctgctttaacacctggattcctctcagatgagattacctttcacattttgtagcactgatcattcctcagattcctgggctttactcaatttagattttgagttacatgctaagattttctctcacattttattaatgtcaagaattttttttatacttcatccatgccattatcatctgtttaccaaaaataattggaaatcttacattgttgagtacaatcctaatattatttactattctttgtttgagattttttttttttttttttttttttgagatggagtc

SEQ ID NO: 115345 - DNA, 1597 bp, Homo sapiens
cagtggcgtgatctcggcttactgcaacttctgcctcccaggttcaagtgattctcctgcctcagcctcccgagtagctgggattataggcacatgccaacacgccccgctaattcctttttgtatttttagtagagacggggtttcaccatgttggccaggctgttcttgagctccggacctcatggtctgcccgcctcatctcccaaagtgcagggattacaggcttaagccatcacgcgcagcctgtttgagatctttattcatttttgttttgttaactttgttgtgtaatatcagaaaagctatactttggtagtaatactttgtgtgtttttgtgtgccagaagttgtcttttttagccctttatattgggctttttttagaccgtcaggaagtttcaatctttaccctagtaagtcaacatgtgtttaatttttggaaagatgaaccttttctcagattattttaagcccttgttctttttatcctttagcatttcaataggtgaagcaccataccggctttatcttttggagagcttgaatcctcccatgaactggagagtccctccgggtttccctaggagtccatatttagttttgggttttgagatgatccatgaggaagcttgatttagtttttgaggagggaatcattacagatatctacccagctcactaattcacatgatcttatttaatgtggagaacttaatttattctaaactttccagctgtgaaactgatgcttttaaaagtttttgtaagggaagaaagaaagacttcactgcaatgtctgtttgattacacacacacattgattaaattataggaataataggtatttttggcaactgcagtagtcttgagaaaagtctgcctttagcaattattcgtagtatttatcttcagaaatcaggattgagttggttggtctgcattcatataatgctttgaatgtagataaatggtcaataaatacatgaatgaattgatattgtgaaatagaattctcagtcataactgaagtatttagaaataaaaggaatgtaatttcttgcttattggtaataactttgtaagtggagtaaaaagaatgaaaaaattgaaattttaattctcttcaaatggggaagggaaaatagaaatgtattttatattctaaatcttaagagtcattaggttgatgtttgcaattttttatagttaatgcaaggcatgttaaaatataatttgtcttggttttaacattctgagccactgtgtagcagaatttatctgtattacttgacattgcccaattcttcctatattctgtgggataatgttttagctttacttgttcaattggaatatagtttgtacttttttagtttagttattttacccaggaggcagctgttagttaaaaaaaaaaaaaaatttggaatatactgttcttttggtggttttattctatactaaaacttgaaattgtgagtgactcttggtcatgctttatttatgcagaatatcctccgaatcctaaatctagagctccaaggatgctggtcattaagaaaggtaatacaaaagacttacagctatctggatt

SEQ ID NO: 115346 - DNA, 2477 bp, Homo sapiens
gtcccagatcttgggaggctgttgtgggaggaacacctgagcctgggaatgtcaaggctgcagcaagctgtgattgtgccactgtactcaaacctgggcaacagagtgagaccctgtctcaaaagtggtggcagagtggggatgggggggaattccaaacatcctaataaacaaagaataattttttggggggtggtaggagggacagagtctctgttgctcaggctggagtacagtggctcgtttgtggctcactggtgccttgacctcctgggctcaagcagtcctcccatcttagtctcctgattgtctaggactacaggtgcttgccactgggccagctaattttttactttttgtagagacgaggatcttgctatgttgtccaggctggtctcaaactcctggtgtcaagtgatcctctctcctcagcttcccagttcctgggattacaggcatgatccaccacacctggaccaagagtaatttttaagaaaacaattaagaaaattgcaattttcttaatttgatacttgtgatagttaccttgtaggattgaaattaactaatgaggatttgtattgtataatgtcttcttttggggatgatggacattttattactattaacactgattggggggaaaggaggaacaagagagaaaggtatgtattgttactgtactgactgtgagtacctggtagttcaggtattttctttctcatttgatcaaggttttgaaactcccagaacagggagttctctgaccagtctagtgtcaaaggacacccatagcacttatattattatacctgaaattgctttgggtactgtattggaacccctcatatactattttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggctgggcatgtagccactacgcctggctaatttttttgtatttttagtagagacggggtttcaccgttttagccgggatggtctcgatctcctgacctcgtgatccgcccgcctcggcctcccaaagtgctgggattacaggcgtgagccactattttttatttatgatctcagacagaatttttgagctttgagggaaggactagcattcctagctgcttaattctgctaagattagttataatatacatacattaatgccaacaagtaagcattattatggtttgtttccgtgactaataatccatatgacacagagttttaacattctgttttgtgttccactgtcaaaacaccaaagaaccaaaaacaaaaggattctttctcctctcctccctgccatctcacaaacattttaccaggtgaaatccactcttataaaccctatgtatgtgtataaataattataaaatacattttattggagctgttactgaactctagaactctgtgtaacacagtttgaaaagctgctcttctgtgtattatagaaaagtttaaacaattctaggatgcatttataaaataatagacacctaatttagaatcatagttctgagtattatcagaccttcattgtttgtgggataagaaaattattttgttgactcattcagtaggggaaaaaacagggatagaactagactgtaacatagacattataatcaattttattttgtgagtaaaggtaaaataggaagctgtggtagtagtgaattttatgttgacattgattccttggctacatatttatcagtatttctgaatttcctcttagtgtaatcgctcaaattcctcttctcctgttgacaaacttaatcagcagcctcgtctaaccaaactgacacgaatgcgcactgataagaagagtgaatttttgaaagcattgaaaagagacagagtagaagaggaacatgaagatgaaagccgtgctggctcagagaaggtaattgaatttatagcaatacttgatttgacattgatatgtcattgaaatatttgagcatgtattaggaccttggaatacatttgaatcatttccttggaaagaaacttggaaagccatttgcataaataatgacttggcttctcccctcctctctccttttctcgcctccccccttccccctcccccttcccctctccccttcccctccttcccccctccccgtccttccccctccccttcccgtccttccccctccccttccctccttcccctttcccccttccctccttcccctttcccccttccctccttcccctttcccccttccctccttcccctttcccccttccctccttcccctttcccccttccccctcccctccttcccccttccccctccccctcctcctcgtttgagacaaagtctcactctatcacccaagcggagtgtaagggcatcat

SEQ ID NO: 115347 - DNA, 1445 bp, Homo sapiens
agatatgaatacttagggtaagaaagctttggatatccatcctggcttaatttttcattcctaaatttaacaattataagtattacgtttatggttgttggtttttttttttttttttagagttttgctcttgtctggagtatagtgtacaatggcatgatcttggctcactgcaacctccacctcctaggttcaagcaattctcctgccacagcctcccaagcagctaggactacaggcgtgtatcaccacgcccagctaatttttttgtatttttagtagagatggggtttcaccattttggccaggctcgtcgcaaactcctgacctcagatgatccacccgccttggccttccaaagtgctgggattacaggggtgagccactgcgcctggccgcatttatgtattttcaatggaagcttagttaggatctattaaaagtttttaataactgtattctgtagaactcattcttttttttttttttaactctctaaaaatcaggatgacgactcatttaatttacataacagcaatagtactcaccaagaaagggatataaaccgaaacttcgatgaaaatgaaattcctcaagagaatggcaatgcctcagtgatttcccagcagatcattcggtcttcaaccttcccacaaactgatgttctttcaagttcacttgaggcagaacacaggctagtatttgtttgtactttttgctcagcattttctgtattcgagatttcaatattatagagtttttacgtgatttaacaggtttattggaatacaacttacgccataaatttcacccattatgatatacagatggtttttaatatattcaaagtagccctttgttcactcgcatttacttttcatttgcactctgtcctaggcagctactattctttctatagatttgccttgtgtatgtatcttatataagtggaataatatagtatgtgatttttgatgtctagcttctttcactaagtataatattttcaagttttatttgcattgtaagcacgtcagtactttgttcctttttattgctgaatagtacactatatgactatactgcttttttgttcatcagttgatgaatattagttgtttccacctcttttttttttttttttaacagtaggctctagtccaatctactttttgactgttttggataatgctgctgtgaacattcatatataagttcttgtgtggatatgtttttatttctgttggatagatacctaggagttgaattgctgggacatatgatagttgtgtttcacatttttagaaactgacaaactattttccaaaatgactatgtcattttacttccttatcagcaatatagaaggttctagtttctccacattcttaccaacacatggtaccatctatctttgattacagtcattctagtgggtgtgaagt

SEQ ID NO: 115348 - DNA, 1025 bp, Homo sapiens
atatcaatacaagatatgtggccatataagaaacaagcttggaggtttcctgatcaaatgaagtagctattgatgcagtgttcatgactgcccaagtagaaaacctaatgagtagtcagaaatatggtggtactgaagaaaaagaggagtgatattgctgttacttttagtataagaatttagcagatttgcttcacatctgttaaaagtttccagcctgaagagcctttgacaccaaggattaagcagtcaaggagttcattctaattttaatatcagtttattaatcttacctgtttattcattttcagaaagatactcaaagcctgagctcaaaaatccttttgatgtgtcttggggtctttgtataatggatcctggtggatcatgttttcttatacataatgtaaatgatactgtcctactcagggtaagctttacattaaacttaatttcctctccttttcagattgttaaaggaaatgggctggcaggaagacagtgaaaatgatgaaacatgtgctcccttaactgaggatgaaatgagagaattccaagttattagtgaacaggtaagaaaacctgaatcatacaacttcacttttaaactgcccttatttagaacaatataattatatgtaagcatggagtgggggagatttaggaatttatcacgataggtcagaattgcttttaaaaaaaaaaagagggaggacaggcttttgctatggtgtccagctggcctctagaactcctgggtgccaggtgatcctccaaccttagcctctggagtaactgggactacaggcaggaaccactgcacctggttgaattgactttatagaagtctgcaatagtgacttatttaaactattgggtgtgcaatagttaggaattagtgtaagtgatgtctatggattagtcattttccagaccttttttgttttgttttttgtttttgtttttggcttttctgggggaggagcaagagtgataagaagtagagagtgttagtagcttcctaa

SEQ ID NO: 115349 - DNA, 1858 bp, Homo sapiens
tatttattaccaaccttttagttatgatttctcattttcagaaatagagaactgtattttttctagtatcttcatctccggttaaacgagacaattttgtaactttatatacctcattctactttacaaactatgaacaaagcagattggggggtgtattaatttaggtcagaataataaaaataacagatacagcttaatggtttctgattatattctggtaagtccctgaaggtatttattacagttgtcacttgaggcaataaaaatgtgggaaagtttagtaccttaatcagtgtgacaattattactcacatctactttgtctggatccagaattttttcagaaatatcattacttgtgtagtttttgggttaggatacaattttattatattcatgcttatattattacagtaggtttgtaactcttgagggataatttatttattttgctgttaacattttagttacagaagaatggtctgagaaaaaatggtattttgaaaaatggcttgatctgtgacttcaagtttggaccgtggaagaacagcactttcaaacccacaactgagaatgatgacacagagacaagtagcagtgatacatcagatgacgacgatgtgtgaaggatttcctaacagctttagaaatcttagtgtgatacatctctcatacagtttggggtgaattgtaaaaatgaagaactataatttatgtagtgaaataccccattagaagaggattttttgggggacttcaatatgaagaaaaccaagaatgttttgttgggctgtgttgaacattatttctttgtaaatgaatgttgtaggaatgaggacttgggttggtccaacattgactttcttcatcactgcaacatttctctgactagcaatgtgacgatgtaacaaatgagattttctcatttaataataaaaaattgtgtaatgttttgcaaagcttctgtcttaaaatgtccaggtcttaagaaaaaaggcagcttacactgttttgcttgcagagtcatatctttttcgtacaatggaaatcctcaagtccactttgtgcggtctccctctccttcccccaaaaaacaacaacaacaaaacaaaaaccaaaaaggaaaatgtagcatgttggctaaaactggagcaaagtgcactaaaacaatttcctgaactcacctgttgtactattcaccttttaaaccataaattgctctttagccatttgtagtgcagtaaatgttacaggaaaagacttggcacattttcttccaaattttaagaggtgattttcaaaagctttattggggtatgttgtcagaccagggttttcagagttgatggaaaagagtcttgtgagaaaacttattttgataaattattacacacgcagaaaaactgatcacactgactggatctgtccacgacatggaaaataaactggattttcagaatattgttgttttctgtagtgttcaaggtattgtttctaaacataaacatactctaaacatgctttattcacttgttaaagtcatacttttaaaagtaataccttactaaagatggtgattacttttccgaggtcagaaaaggaaagctaagcgttttcattatcaaatacacaagcttattaaatgaatgactgttaactactttattttcatttgcacattaattttggaattgtttctgttttgctgctgacggaaatactattttggctctgtgtatatttgtattttgatttttctggtttgtttacccccatttgcttttagctcccccttatgtttaaatatattctaacttatgtaaagagcataatcttagagcaaaaatacttgagg

SEQ ID NO: 115350 - DNA, 1030 bp, Homo sapiens
cattttaaaccgttggcaataaagagtatgaaaacgcagaaataatggtctcctgtctttagtagaactcttcaccacatcgttacattttttgataagatcgtgccaagcagtgccaagaagccactgagtatagaagcatactagagagttagatctttaattttttctaactacagtttctaggaagtctaatacctgaagtacaatcataaactttcagagtagatctagcttaagaacaccattcttcttacaaccaaaatataagcctcctacaaaatccaaacccaatttctctctgtagtatttcttcaaaacttgtttagcttggaggtgaagccagattaaatagatctctgttattcagtgtcaataggtacaggaagtttatcttaatatgggcaaaactctgaattagaatacatgcaccacctaaacatattactcagcataaacctgcctaaacacttccagtgccactggcagtactagcacataattccagtagtgagaaatactttgtgaataagtcattttattttccttctggtgcatggtagttgaggagtggtatgggaaccaagttgtggtttggggtccatcttttaatctattaaattaagaggtaaatttgaggttttctttttcagtgggatctactctttgacaggtgtagtaaaggaaagctgctcatcctgttactctgaacttacaggcatctgcataagatgtaaatattttttgttcaattgtaatcccactataaggaaaatactgtcctatgaaaagaagtgctttggtttgttaaggctgtgtttacattgtggtcctgtacagcatagtatagagatgctagttgcacttttacatttttctaaaattgttaaaactccacttggtatattgtattaataaaagccaaatccagggaatatgttatgagtatttcacaactcctagattaactcctgctggctggagttctctggccatgtatacaaattcagttgtatttttataagcagag

SEQ ID NO: 115351 - DNA, 1743 bp, Homo sapiens
gaaaataatcttgagttctatgtctttcgaattaatggagtgaaacttagcatctaccaaagcctgaggttttattgctaaaatattgtataacttgaaacatttctgtctgacttttcaggccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaagtaagtgtatcaattaatgaaatcctgtcagttctctagtcttgcactaaagaaatctaaaaacaatgattaactgcttctatttttttttcctcttctctccctttcgttcctgtttttatagaacagttcactattacgcagagcttggccaatgctcagttttcccagcaacagatgctcctgagcaatttattagtcaagtgacggtgctgaaatacttttctcattacatggaggagaacctcatggatgtaagtactgtggctttagagtggtgacatttgaagtgtaggccacaaagcagtagtgtctgcatcactttgaagcttgttagaaacagattctcctgacctaccgttggtgtactgaatcagaatctccgggaggtggaggcagggatttccaaagccattctgatgcttgcttaagtttgagaggattttcttagaataataatagagtgcatgctacaaaatctttgtaggcactaactcactctcctaatctcttccagggtggagatctgcctagtgttactgatattcgaagacctcggctctacctccttcagtggctaaaatctgataaggccctaatgatgctctttaatgatggcacctttcaggtaaatgaactcttcaggaaagtgcacgtttaggtcctaaacagaaagatttgtacctagacagtttagtgattgactgaacttttctaattctcgaatattttgagagatctaatgtctatgtttattttttaaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggcc

SEQ ID NO: 115352 - DNA, 2392 bp, Homo sapiens
cacttacactgcaaagttaactttcattgctcatcctgcaaagggaaaccagtgattttgataactgttttgacagattctcttttttccttctcctcttcttagtcaatggctcatattttgaaagcaagaaaggtgttgacagagccagaagttcgatactacctcaggcagattgtgtctggactgaaataccttcatgaacaagaaatcttgcacagagatctcaaactaggtaagtcattgacgccaaaagctgagttttgtgttagagttcttttttctctctctgtttttttttacatattaatgttcttaattgggatctcgtgtctgcaatcttgcttttgaatgggcgactttcatataacaattggctgcctggctccaaagtggatgtgtgtgtacttggttagaacgcattttcaaagggattcacattttgttttgtttatcgtctagggaacttttttattaatgaagccatggaactaaaagttggggacttcggtctggcagccaggctagaacccttggaacacagaaggaggtaagagtcagaaagatgcatcctagtagacttttgtggagaccaaatatgccttcattattttgcatttaatgtttcagaggtccggtaataaaatctataaatcatagcaatgttaatttaaagaaatacttattaaatgcccactatggactagacagagcaccctgtgcctctaaattgattatgaaagcagtcaatgaagtcttttcttggcttaaaatgtataaaatgccacgacgtccctggctttagttggttaacaacactttgcatgtgggctaaaacaacgtgtgtgcatttttaaaaattaccaaaactcatttggtcagatctcaattgaattttcagatgccaaaagtcaaatgtttccaaatagaaattcagtatagattttaagattttgtttaagattttgtctcccatcaagtcatgtcaagagaaccaagtttaagtagtggaatagttcctaacacgatctcaatattttgtctttccagaacgatatgtggtaccccaaattatctctctcctgaagtcctcaacaaacaaggacatggctgtgaatcagacatttgggccctgggctgtgtaatgtaagtaaatgcagcagaataattaaaaagcaaattcggatttagattttaacacttgaaaagagttgctttatgaccattgctaaagatgtgtttctttgcacacaggtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcaggttggtgcactatcttttttttttaattacctggtattgatcccagttacctgacaggttactgaaggctttttctaatattccacagggcttcactccggacagactgtcttctagctgttgtcatacagttccagatttccacttatcaagcccagctaagaatttctttaagaaagcagctgctgctctttttggtggcaaaaaagacaaagcaagatatattgacacacatagtaagttaacaagacttcttttcctttttcgtacccaatattatatttaaatttggtaaattagttaaaagagaattttatattagcataacttggccatatttgcgtattcttaaatgttgatatttatagcataataaatccataccttgaattgtgattgatagctttttattttgcaaacactaaagagggcttttgggggtagctgcagctaaaggcaaaggtaaaatgctatttttgcccaggatgctcataagttggtcaataatgcaagaaggagaaaatatgactaaccctgttcctaccttgttaagatagactaatgtttgtaattctgtttcttgatatacagatagagtgtctaaagaagatgaagacatctacaagcttaggcatgatttgaaaaagacttcaataactcagcaacccagcaaacacaggacagatgaggtgtgttgggaaagagtaaagtagatactcacgctttacgttatttccactctttattaattagcacttggactatgattatcatggttcaaatatgtcatatttacttaaagtttttcttcaaaccctttgaaagggaagttaaaactaaaaggaagtcttttagttttacagtgcatgcaagtgagtttactgcgttatcttttatctggcttgtgtccattgctttttgatgagctttcccagcaat

SEQ ID NO: 115353 - DNA, 1136 bp, Homo sapiens
cttgggatttcttatcctttctaatatgtactaatatctgccaattcttaaaatcaagaaattcttctcgaggtctatatctacctcctttcaatagtaacacagcctagacacagaacactatgtgaagcttcatacaaatgattttactttatatagtgacaaattctgaaagtcgtaattaaatcatcccttgtcttgatgaagtttgaatatggaaaaggaactctctccagaagcagctagctttttcactgaactctcaaggcagaggatgagatgatgatgaatctttcttaggatggctacttccttgtcaaataaagccaagccatgcaaatgccagttaagtaaagttaagggtaaaatagagacaatagggcatagtaccaagatttagtggagaaaactattctaatggcttacacggatgaaatatcatgggtcagtctgtacacagctgaaagcaggtgcctacaggcatcaaagagagtatatctttgggatttgggattgagacaagaaaaagtcatccactgagaataaagttattaagtaagtgccacaaagtccatgagattagccatctgcagaaggaattcactccaagataggatgaacaaacgattttctggtgagaacagcacacttctcaaaatccatcaagggactagagtgtcttccaaatttctcagatggagggtaagacttctcttttatcagtagtctaataaatgataaaaatttcaaggtaaaaccattaaaagaaaatggagttgatttgtgtgaagtcaaggaaaaaaagagtcaaggattgagattatttactgcccagtatggtcaatggggaaatgagaggatgcctgcattgagttggctgagtatacaggtttacttgctctgtatcccaataaagagcattgtacttactcaatggtatcccttaacatcacatgcctggcacatagtgagagctcaataggataagaaatacatgagtagaaaaggaccaaggcaaggaacagacagctacgatttgtcaaagggagaatgctaagtgcagcaagagactgcagacacacatagggtgatttgaaatcaccatagggctgtgtagaagcacccaatctctgcag

SEQ ID NO: 115354 - DNA, 1598 bp, Homo sapiens
aacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggtttt

SEQ ID NO: 115355 - DNA, 1058 bp, Homo sapiens
aaaaccttatgctctggatgtgttatagatactaagaataatgtcatattctgctgagctcatggcaactctagaggagaggttaaagatccaattctttcactttagagaaagctgagacctacagagtgaaatgacctgccacatgttagtagcattagaattcactccccaagattcattccagtgttgttcctgctcttatgttatctgatttattctctcctggatattgtcaggtaatgataagggcagcagagaagtttaggggaaattacatcctaaatccagaattttaagaatcagataaacttctcacaaacagttttgctgatctttggccttttgtcttttttacagactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtaagtagctgataaaagccaaagaagagaactgtgatgcaagttgtttataatttagacataagaacaagatgagtattaggtaaaaggaactgcatttcaaaacatattatggccctttatgttatagaagctgcccgtgatgctggctgtgatgttctgtaataggtttttcacttctagcagtttggacttgagaataatgtcagctcaccctcatcatttattttctgggcccctccagtctggtggcgggcagagaaaaatgactaacaaaagcagattgtgtgggccacagctcaaatggattttttccccaccttttctcatcagtagacagtgccatttagacatccatgactttactcttttttctatgcatcttattcagtgattatgagacacaggaaaatctctagctttcaaaaacttataaacttgtgatgatgtcttatccatggagatgtcacccatttttcaccatgaaagtggttgtcagtgcctagcatttctgtatattacacacatttatctgggctttgg

SEQ ID NO: 115356 - DNA, 1030 bp, Homo sapiens
ccagattagacaggataacatttcatgttctacctacctatgagcacctataatgaggtacttttagaactcatcaaagcatacatacaaatattaatatacattggatgcagctccctgcatttacatggtatcagtggggaggtatcagtggggagggttcattatgtcctttctaagaagagcagggaggtcatgcaatacagtgcatgctggcactttacatgagcctggcctgatttattttgatgcttatgaatgtcttgagatattctgaattttatcaatttttagtaaatacataaaatgtatttttacataaaatttttgtgttaaaggtatatatatatatctatcttaaacaccaaacattcaaactggtatgttttctttgcattctgttatatagcatattatatgttcccttagaattaagagtagatttagaagacaaattaaaacaactgatagaaaggtcactgtcttccaagtactctgatacattttttaagggtaatgaggacctgctctattcttcattcttttgagcccttaaagcagcagtctccaatgtttttggcaccaggcaccaggttttatggaagacaatttttccataaactgggggcgcagggagagaatggttttgggatgaaactgttccatctcagatcatcaggcattagttagattctcataaggaacgcacaacctagatcccttgcatgagcagttcacagtagggttcacgctcctaggagaatctaatgtccctgctgatctgacaggaggcggagctcaggcagtactgatgcgggcttgcctgctgctcacctcctgctgtgcagcccagttcctgacaggccacggaccgatattggtccacagccgatggatggatcggggacccctgctttaaagggcacttgggctttgactggcacctggaggaccctggcatcagggtccctgtgcagtctgccatttaagctaacaaggcctcagtctacagatgaatctgatactctaa

SEQ ID NO: 115357 - DNA, 1021 bp, Homo sapiens
cattttttcatagtaccaaactgtaaaatatattttatagagagatctattcatatcttcaacaaattcttattaaatgccagccattgttgggcaataggtgtttaatgataaattagaaatgattcctgccctcgatgaatttaccgtcttgtgtacatcaagcctagtaaactggtgggcagataaaatacaattgctaaataaaagtttgctaataatagctgagtttggtgtcctgggacaactcttgtacctcatccacagaaagaaaatgcagtaaataaaggtcagtaatttgaatgtatcctggacttactttcaaaacaaaattgctgttatatatagttaacatttattaaacacttagaatatgttctatatataaggatgagttagagttgctcatcactgccttgaaatcgtggatgaaagtaagaagatatcttaggtcttttactatagaacacaattagcttatgtacgtattcacttatcaggtaatatttatgattctctatgctcccataaaacctggggatttaacccttatctcactatcatacagaaataaaaagtagcagaattaatctaagtcatccaaaacctgctgtttcagctcccacagtgttacccatttcagttagctgttagttttatatactgctgttttcatgacatttgcgtataaagtttctaccatttcaaagtatgtattgaaactgtagtccttagttggcaagaacaatattcagttcattaagtcagtttcacaaaggaatggaattgaacagtggaaataaccacctgttgtgtattctgagtctgctgtcatgctaagtcttgcagcattttttattaggacattgtatcaaagaggtaaccatggaatacatttgatattattattttgtaatggaacttatttgcttaattttgtgtttgaagacatcaaattaagtccaattcaaatgtaaatactgaactctctaaaaggaaactttttagttggaaacatttc

SEQ ID NO: 115358 - DNA, 1003 bp, Homo sapiens
gaaggttttatttttataccatcaatggagtatttgtttaaataactttgaatactgatatctaccaaacttgtaatgcatcacagtgcagcatattcaaatgatttttagcagaatattgtcaggaaaaaataagaaaattttcttactattggacccataccacctccttaaatatatattgggaggatatataatatacccagtagcacactggcgtgatgtagaagtaaaggagattacatttaaggacattttgttttattattttagtttgcttcctgaacaatcttaaatgcctaatgtaaattgaagaattgcagttctgaaaagcaaaatacagtattgagattcaactgcatttttactttcctttatgccttaactgctgtacacagacattctgatgtataatgagaacaaaggattcaaaagcattcacttagaaatcctcccgtttttttagttgcaaccctaaatctgtgtattgttttcagactacttaggccaaaaacaattagaaattcatcaatggaaaatatttagaggtcacttaaaaaaataaactaaatgcttaaatggttctgcattttacaatcggttcgtttcaaacagcagtttaatgttttgtcccttctaaatatattaattgagaaatatgatgggatttcccagaagaatacattgtattagctttaaatcagtccttccccctttggtaattttatgtagttatcttagtaaatattatataattatttttagatgagagaagtatcacatttttaaatgtttgttgaatgatctagtgcatttttttagtacatctagctatgcactccaaaaccaatttgtgagatcaactaccagttgagaaagcacttatggtaatttttgtggttattcatttagctttgctggactgaaacttttatatggatagcaaaaaaggaaaacaatgttaattccttttagaaaatacccttgtgttataacttaatgt

SEQ ID NO: 115359 - DNA, 1020 bp, Homo sapiens
gatgactttattatttgtatttgatccttgtccatttttctctagatctggtactaatttcatgtggaaaataaatcgttaggaggttttcattttgtacgttttggctgcaaacaaccacaacccagtctttaggttttcactgagggatttttgttttagcccaattattgtatgacatgtatctgctccagaggttcttataggtgaaatgagatttttatgtatctgtattcaaacacatagatagatagatagatagatagatagatagatagatagatagcgaaacatatagacatacctctgaaaatacaaccagccatataatgtaagcctgttgtgtgttaatgaatgatagggtaataatacattatgttcctgtcctgtagaggagttcgagtattcaatacagaggaccagaatgattggtcccagaaaaagtgctccttaagctggatcttgaatactgaggatttatataggcatctaatagggaagaggtggtattccaggggctggataaggcagggtaggatggggtattcatgtggattcgctttattgtatgtttgctggagaggagggtagtgggcattctggaggagtgagcctctctggaacagaggatgtgattataggaccagtggcaggtgtgagaaatgtagattgaggccatactgcagactgtcttaaatgccaggtcaagccatttgcacattgtcctataattcatgaagaacccttacatttgactataaggaaaatattatgaagaaactaaaataaggtgactttagaaggttatatctggtggtagtgtgcaggatagattatatcaaggggaaattgtactgaaagcaagaagaaaccgttagggaattaggtgtaagagtgataagggcctgaaataggatagtgatgaaaagagaggaatgagtaggagaaagattgcacagagaagggtgacagcatacataagacttggcaggaccacagccagaagaaagcatgaaattc

SEQ ID NO: 115360 - DNA, 1088 bp, Homo sapiens
gtggtggggacatatgataggtactgtggcctatccttaggagggatgaggaatggaactatttttaaacataaaaggtcaactttatatgctgccatataagtaacccagtgcaattggagcttgaatcaacagggctgggagaaagcttacagagtgtgcctttgaaatcccaatacccagtcatggtgatttatgagaccttaccagcttgcatatgtgatggcccactgagtttgtttactttagttttagctcagttacccagcactctatgatagcctattttttatttacactctcactaactcctttattatgatttctttgaaagaatatgaagacagccataaaaaagactcttattgaagttgagagggtctcctgtaggtcttcacttcactgtgtctaaacattggtctgttgcttgtgctttgcttttctctcaccctggatgaccttcaaggctcttccaaatgatttctctgattccctgaaatactgaaattgtgattaacagaagtttcaagtgttaatcaatatcaagatagtagttgtctcttcctggggaaactagaaatgaaaaccaaacataggcctctgtaatcattgcacagattaaaaatgaaaatgcagctgagaaacagaggaatgaatgagaaaaccctaaacctagttctagccccaggatgaggtctttgtcatgagtctgacgctagccacagccggtaagagaaggaattccctagtagtgtagttgttacaagggaatgagtcattttgcaggtaattgttcttcttccattttccacttgctgtcagccactttacagaggagtcggactttgttctgcttaagagaagtctctttccttttattgtttaaaaaaaaaaaaaaattccagaagcccttagaaagagatttgtgagatcaactggtttaccttcttcattcagatgaagtaacaaagcacagaaaagttattttgtcaaggtttctgtcttgtagcaaatacaaactttctggtgttaaacatatgaccctgatttgggtctttactgacatcatcacttttttttttttaatt

SEQ ID NO: 115361 - DNA, 1011 bp, Homo sapiens
aatgaatccctgttcattccttgaaattcttttttctttctaactaccctaaaaactgttccaggtaactattaagtttctggaccccgaggttatacctaggtattagttgataggctcactaaaattaatagaatgtttgcatttaagttagagacttgagtccaggagaaagtgaagatacaatggaggaggaagggaaaagaatctattaggcaatcaatgcaagattatttaactcacaacctctcacttgaactaaaataacttacaaggctcttgttattatctccaatctataggtgaaataaggccctagaaagattagtagctgaattgcctggaattgcttgtatgaagtggaatagagattggaatctttctccactcttccagtttctttcaaagaataatatcactcacagttgcacacatgtcacatgaagcccccaacctagatgcctaattaaacttagctcaaactccaattttttggacaaaaggcctccttattcttataaaagctttctcctctttctttgactcttctcttatgtcagctcagagagacatttctgcttgggccaatctggccttcaagctcagtcccttcaatgaataaaacaaaacaaaacaagtcgggattttgtaccttcagtaaccttattgacgattgggagaaagggaaaatgcacgggttggagttaccctttagaccaagctgactcctttctcttatatgcacacacacacacacacacacacacatcttcaataaccttattgatgattgggagaaaggaaaaatgtacaaattggagttaccctttagaccaagctgactcctttctcttacacacacatacacacacacacacacacacacattctctctctctctctcactctttcatgcccttacatacatgcacacacagagaccaagctgactcctttctcttacacacacacacatgcatgtgcacaaacacacattctctcgctctctca

SEQ ID NO: 115362 - DNA, 1047 bp, Homo sapiens
taccaagcttctcgtattactggtggggttcaacaagtatttgttgagaagtgatgaatcaagctaaagtttaagtaggcaaagatgaatcacgtcataacctctggtttcccaactttgtctatagaaaaggctccttgctaggtaaaacaaaaacagaagaagtatgtggattctcttcaactttgggactcatcaccctgaatctctcagttatctcaagactgattccctccaccctggagggcctccctgcccctcctttgtacagcagtgaaaggcagaaattgaatagaaggagggaaagagggaaaaaggtctagatgatcaagtggcaaaaacaaataacccagcatgaacaagtatgcagagagggaactctgaggaaacttgctgacaaaagatagagatggaggtgaggtcaaccacaggggaataatgggggcagacaagtctaaggaggtagattttatagggacttcgaatagatgaactgaagtttggggaagacctaaaggcattaaaaatccagtataagttcttgattaaggacagatatcataataattattattataatacaaggggtgctttgggaacataggctatgtaggagggattgacagaggaagggaggaaagatctaggaaaatgagggccaaacggaaaggtgtccttctcctgttcatttgccaatgaaatgcctaggatatatggtggtctgctcctaccctccacagttctagccactgcaaccaggatgcccagcaaccatgtcattcattcattcatatggtctatctgtctcctataggcatttcagtgagtggccgctgctttatgtgttctgttggtaaacttgtagtaccctgagaaaactcacacattatggagaaattacttcaaaaaatatgcacagtagttaactgaaatctttttatgtgttctactctcacgtgaagtagagaagtagagggagagttttttaattataaaaagggaggaagagggaagagggaaacaaaactaacatttattaagcaaggt

SEQ ID NO: 115363 - DNA, 2358 bp, Homo sapiens
gatgacaaatcatggaaataattatgaaaagaccatccagtttttaatgactttacaagaatagtgttcttgtgagactattgaataagaagaaatatatgaacatttgtatcattcaactgtctaactgataccaacaccaataaatatatgaacatccttattattcaagtgtctaatgagtgagggacagtgcctgtaggaaggagagcctcccaacaatggaagcagtgttattcttcatggtagggagaccattttttggttcctcacaatgacttccaggctggaatgatttccaagtagggcagggaagacaaatatctgaagcctaagggaagctccagggtgattcttgtagttttgtttggcagactttctaaaaagcattgtcagatagttttggagcaagcagtttagccatctactaccacacaatatattcaaatcagagtaagctggaagaaagtcatccaacatccaagtctcagcctggcctatgtgaacatacttcttcttaagactaagctgtaggggtactatgcttattacctcggtgtgaaataatctgtacaccagcaccccatgacatgcaatttacctatatgactaacctgcacatatacccctgaacgtaaaatttaaaaaatttttatagatatgttaaatttgagatgtttattgaacatcaaagcaaaaatggtgaatgaacagatatatgacacaaaaaagactaaggtataatcctatatcatgagtgaataggaattttttgttattggtgtttgcgttagttgagattttattcagcagtaaatagagagatttaaaatagaagtggcttaaggaagacagatatttctccttcatgtaaaatctgaaagttggcagtccgaggttaatatggcacctctatccagtacagtcttcaaggacacgtgctctttccatcttattgcactgtgaggtgtagcctctgttgctaaattcaactcaccatccaatatggctgctccgactccagccatcaacttcacattctagccagtaggaaagagaaaacaataaatacaggcagataaaaagatagatgacaaatttctcttaagggaagtttctagcacatcatataatatctacataacgcttctactaccaactcattcaccaaaacttagttatatggcaacacctggcaaccaaggaggctgtgaattttctctattttgggcagtcacatgcttacatgaaaacaggtatttgaaaacaagtgatgaagaaaagcatcaatattaggggacatttagcagtctctgccacaatgttgcctattaataatcctgcatacattttaaatatttaatatcagtctgcaacactctatttgcaaggtaatgtatagtataatctttaccatatgaacttagtagccatggtgttcaggaaagttgtgttattttgtgctagaatattttacctgccctaggtaagggcctaaagataaaatgtgctagactaattaattttaatggcatatagcaagagatttccagcgttaaagattgcatctccacctgcaatttgggaaaggaaaaactgatagcacaaaataaaagtagtgggtgtcctgaaaactgtctgatgctcttcatgttcttaccaactcatatcctcatctaaatttgaatcacaggtacattctgaccttgtcgtagagagagtcctaaagtctcacgagagaattaccgtgcttgttctaacaagactgtgttccagcaggcatgccaaaatttgatagctacaaatagggagatttgaaaggaaagaggtgggagaggtaatttcttttaactcaactgcatctggtggattaaggtagacaatattaccattttgctgacagaaggcagacatggcactaaagagggagaatgagcaaccacagagctgatttaatttccagtggggtttatggaagcaccaaaacatgatgtagccaaatgttcctaaaagtatgaagtaatttaatttgttccatcattacaagaaattaaagccaagcacaattacatcccagtagtaaaaggaacccgctgaattgccattgttattgactaaatgaagtgagatttctgattaccttgtccagcacattttaatttctgtctgtccatttattccaaatcacattacagggccttaactgatcttgacaaaataagctacattattaaggtgcagtttaacctgagaagctttaattactagattagagttttcaaatgggcatgtcttctagacttcagtacatttagggatgtaattattagagattctttgtttctgatgtgcaaaaga

SEQ ID NO: 115364 - DNA, 1023 bp, Homo sapiens
ttgcagtatcactctatgtgcacatacacacaaatatacatacacacacattgtctttttttctctgaaccacctgagagaaaactgcacacatcatagccctctatccctaaactcctcgatgtattcctcccaagaacaaggacacttttctgtataactatagtctcaaacatctgattgcctttgaattttatagcatgacttatttatacctttttacttcgagttctaactcagatactgagctatagaggaacagctcaactattagttgagggatagctcagatgtctgatggaaaaaagtcacatcagtaacattttgaattctgcaaatatacacaatatgccaatgtatgggagataactaaatactggttttagagaaaatagatgagttaatacaaatagagattccccttaattaatagatcttatatgtttggttatatgtcttatccatgctattatagctagctagcattcattaggacagccagagaatcttgtctttctgtatttttatactgtttttcttcttctgatcagccgattccaggttttgaaagaatgaagtagttcctacttagataatgctattgccttgctccttaacagtaagcagtggagaagcagagtggacgctggtgatgctgcctttagtcctggagggagtgtcaaccagtgggtaatcattctgaccctgcaacacaaccatcccttcactatttcagtgaaggtctctacttcggtggtaggtctctactcaacatggtacttatagccgttttatacttgctatcttaaaaaaatatgcaggctttcactgctgtgaacagataattgatatttatgtttcataatctgtgaagatagctaacacatttctgacagttgcaattttttttcccaaaacgagtttgagcatgcctatccctctctacccaagtatatttaacagcatttctatctattggggaatctgagtgaggatgacaacgtgtcagggattagaatggac

SEQ ID NO: 115365 - DNA, 1056 bp, Homo sapiens
taataagcctaaaaataagaagatactcctctactttgtcatacaagatcgttgaatggtgggtcattagttgatagcaaaaagtcactcattcttagttatgtttctgatgacttgaaaaattgagtggcagtatacaaagtctgagcaaaactgacttcagaatgagtatttggctttgatttctcatggcatcttgcccattgagccatcttttcagaggtctcagctgtatgaaaaaatagtacttttttttttccagaaacatgaagtctggcaatctttataactttgtgcagcttgttgattcccggattcaatggtgttagtgaaaaagaagtctcaggagctccagagtctcagaagaatgacaagaagacccctaattcttgcctgtctctatatttagtatccaagttggggataaaagctagtttttaagattttctgttcagaaatcttttctatatactattcagaggcagccctttgtttaaacctttttttgtctcaggcatggattaactgcaattggattctatgttaaaaatgtatttttttgaacattttgtaggcatcactccagtattttctattggtgaaatcctgatctttttctgtgtagaaatttttgtgaccttcttttctttactgaagttcccacatttcatgatcaattgtcttggtctgcatttttatccattgccctgggcacgcaatagaccttttcactccagagatatgagtccttcagttctgaaatgtttgctcttattcattgataattttatgccctctattttctctgttctttcttccttgaattctcattatcttagttggatctcctagatcatatcctttaatttcttaattgttttcttccttttttgtctttttgttttttggtcttctagaagatttgttcacacacatttttattttccaaccttactattaaaatgtttattttggtcatgatttaaaaataatttagcactctcattctctcctttttttttttttttttttttttttttttgagacggagtcttg

SEQ ID NO: 115366 - DNA, 1484 bp, Homo sapiens
agggcatttcagacaaagggaactacatgtacaaagtcacaggcatgtagaaaaagatgaatgtttcggagtaacttacagtatgtagggcgcaaacagaggaaatggcaaggaataagactatgtgagaaagcaagttagggcgaccttattaaaaagtttatagacagtggcgcaccgccaaagatgtagaaatgtggcttgctgtgttctgtattttggagcaatcactcgggtaccctgtgttgtgagtaggggtgaaagaagagaatcagtggaaccatgggaagcagtttgggagataggttggaaaaatattggaatgttctaagcatgacattgtgaaagaatgctagaatctttttcatatgaggggtgttatggaaaataaagaaagtattggccctgccctcaagaagcttggaacataaaagaagtaaaacatgagagcagggcctaataatgtatctcaaagtgctgaaggaagcatatgcattatagaagttctcatcctggactgtggtttgttgagaatgcagctgggtggagtctgaggaagtaagtgatggccataatcgaagaagagataagaggtaagagcaatggcttaaaagcaaaaaagcctcaaaacattcaaacttcctttgtataatagtggatgttattttgagaatgtcagtttcaggagataccataatcatgtgtttgtctgtatttaaaaagccaccaccataaaagatctagagtcactcatgaagttcaagtaccaatttttacccatgagtgtggaacattctgctcttttacaaacagtaactcgtactgtcacattttgcggcgcatctctcattttgttggttatttagtggccatgtaaacatgtacatgacttgtggtgaatatggtgattctcactttataaccaaagagggtggatgttacagcatatgagcagttatgactgtaaagcctgaagtgtgagtcacagggtctgacccaggtagtaagatgtgttatttgttcatgttggttagctgaatttcctgggctgacctcactgaagtttgctccagtaaagaaccggatctttactgatagatcaaggatctgaattctgcacctagttctttggctaaccagttgtgtcctttgggggaaatttcttaatctttctgctctccatttccctttctgtaagtaagggattagaccaaattccatccaggattgagaaattctatggtgtgacaaagactgctggtgctgactgaatatccttacagatttgttcatttagtaaccaatataataaagatgactgactgaatcttaattatattgggtgacatctgcctagtcaaaagattgcatttctcaggctttctaagagattgatgcagccaactacatgttagcagagggagctcctgcctagaagcactcacttttactcctcctcccgtttgtgtagtagtgatttggtg

SEQ ID NO: 115367 - DNA, 1055 bp, Homo sapiens
tttaagcctcccttccccaattcttagtggaaaagacactactggtactgtgtcctatggctgactttgtcgtctaattgaaatatcttattattgtatgcatcctctcctacttaaatgtgaccctgaaatgccagatctttcctttggaatgaatcttttttgtcttattggactggtagggctatgcacttaaaaaaaaaaaaaagttgattattagactcactgtttccttggccagtcaggaaaagatatttaggacaagagtttctcaattgtcctcatccagttttgcctttatagtgaatttcaataaatattaccatgcctatgtaagagggtgactggagaggcagaaattctatctgactgtccacttctaactctactattggaaaacctgctaggggtttttgtatttattatttttggaaaaatcattaagtggattcccttagctatataaacataaggcctgtcatctttttctttggagaaagagtgtgacaaaatttcccccttcttattaaaagctacccctcctcttggtacagtttgaggatagcgtggaccaaactacctaagaattcaggagtctaccaggagaaaagagactttctcactttgtcccacaattagaagtactgaggaaacccatgagaatggatgaaaaagggcagtcccatggtgtattgtcgggagagaatgctgatacggcgggccctagagggattaatgtatctgtgtagaggaaggggaaacctaagctgcctgctcaagaagagcatcttagattgttgagtgagggctgatctttactaaatgagttaaatcaaagagccaaactcttggagtccaaggctgggcatggagacccaaaccagcaaggacacaggtctggacaggaccattgttcactgtgataccacatggcagtggcagaagccttcataccaattgccgtcctctctacacctgaagtttagaagcacgactctgctttagactgaataatccctgaggttcttgggttatttgaaagaggggtagttttc

SEQ ID NO: 115368 - DNA, 1057 bp, Homo sapiens
tagctccaggacattttctgcctgtctccttccctccctcctttctttcttttcctctctccttccctctttcctttgttccttctttcctccctccccttccctccttttcttcctagttccccctttctttcctttcttctattgaataaaacgcaaagtaattctttttctacttactttgattcttatcagctttcttaagcagtttccttgccgctgttgtgaattacatggggctgtggtaaaatgtggcacatttcaaggctatgtatccctttagattctggttcagtaagcttggaaataaataggagagcttacgcttttaactactagcctgcgattcgtataatcatgttagtttgagaaacactacagtaatcacacatgtaagggctttggagtaagatggaccttggttatccaacgcttactgtgtgactttggtaaattacctaaacttttctagccttggattttaatgtgtaaaagatagataatactaactcagtaattctttatgggttccatgagacaatgtatttaaagcacccagcatactatctggttcatagtttacagtcaataaatgttaattccattatttgatcacaatgtaagactattgaggtttaattttgattgttttttcaaaagtttgtaatctgttaggaacaatttctaaagtaaaattcagaaaacaaaaccatcaaaatttaattcagctaacatttttgaggttctatatagtctcgaacatatattatctaattcgattatcactataaaccctgtgtatagtagatattatcattcccattagtggatatgcaaaccacggctgtgggatagttttacatttagtaagtggcagatccaagtctagacagcccaggctggttctctttatactctgcctggcaacatttgccttcatcactgtctgttttcaaaagtaactaacctctacatccctgctcacacatacaaatagctctaaaggtacaaaataaagctaattttctgagcaattcattttattcaaatcagtcta

SEQ ID NO: 115369 - DNA, 1004 bp, Homo sapiens
ttgtcctctgctagcccttggcagatcagaaatgttctaaagattgacctctattactttgggctttccttaacttggcatccatgaaaagatccacttaaatgctccagattcagtgaagtctccttatcagagcttcttatagcacccatacttttctttctcagcatttattatgaatgtaatcaaatcatactttgtgcatgttttgttgtggttgctgtttaatgactattttgtccatgaaagaaggaactgtgtttgttttatcactggtttatccaagggactagaacaatgtatggcacatacaggatttaacgaattttttttaatgattaatgcccctttagatagtgtttttcatctgagtgcctcaacttctatgtgcattatgaaactgatatagtgggtcacaactatcagtaagaaaaaaagaactggaatagagtagaaaaagatgagaatgtatcacgcatagggaataacttttataaatctgtttcagtatggataggcaggcctacaccacacacacacacacacacacacacacacacacacacacacacacacattgagttcctatgaatttgttttttttaatttctttcttttttttttttgagaaggaatctcactctgtcacccaggctggagtgcagtggtgcgatctccactcactactgcaacctctgcctccctggttcaagtgattctcctgcctcagactcccgagtagctgagattacaggcacctgccaccatgcctggctaattttttgtcgttgttgtatttttagtagagatggggttttgccatgttggccaggctggtctagaactcctgacctcaagtgatcggcccgccttggcctctcaaaatgctgggactacgggcgtgagccaccgcacctggccaatattttttaaggtaagaattttgagaaacactgtcctaggttccctctaaaaccgaagatatcaccctatgttcagccttt

SEQ ID NO: 115370 - DNA, 1036 bp, Homo sapiens
gttctgttacacagatgatttggcttctttggtttcccattaagagccttgttttctttgccaaataattgaaagtttcactcagaagataaggaacatcaaagacctcaagctttgtggtcttggaaagctgtggctttggtctctgtctcattccccttgggatttagaatagaaaaatgcaggtggagaacacattcaaacatcccacactttatcagtattttaaaagaaagaaagtatggctttttttttctcaaaacaatgtcttagttataaactgaatttgtataaatggccagttgtacattagggcagttgcacaatagaaagcatccagggaacaatcataacctcaagagcctattggaaagtgggatcctaaatagctttctatgatctccctagaaaactgtagaatttccccagagaataagccagcattttgttgaccattctgcaattccaggatcatgcttgcatagtcatagcttggaaggaggcaaattgaaacaagttgaaaatctgcaggaactatccccagtgagaccacagaaaagccagaagaagaaaaggtgggatttggggtagagaacgagccacttctcactagtttgcatgaagcattgaatatcccaagggagaaaacattgaagttctatgagacaccaagaaaagtgtatagattatcacagcatatggatagaggtcatttgttccctccctccctttaaagaaaagtagctttgcaagccacagtttaggaacaaatggactttttgacatagttcaaatcctcctgggtgtggaggcattgacaggagcaatgtcataaattggttaaaggttgcagtctggaatcaggctgccctgaatcccagccctgccatttactagctgtgagaccttgtgcttcctaacctcagttttcttttcttttcttttttgagactgggtctagctctgatgcccagtctggggtgtagtggcaccatctcagctcactgcagcctctgcctcctggactcaagcgatc

SEQ ID NO: 115371 - DNA, 1672 bp, Homo sapiens
gacaggtagcgatagatcagcagtagtaaagtaactgatatgggtaggttaatagaatgacccttttaagaagggatctcaaagagggaggctaggtaagctacaaaattatcagggcgaaatgcagtgaggtagaagtgaaagcagcttagagtcagcctgggctaagataaatgaggagtggagctgcagctggaggagcaagagaatatggtctactcgagtataaatcaagcttgctggtgagcagtttaggactagctcctggttttacagcaagactttttatgtgatcttgaccaaaccactgcacttgattgctcctttctactccttggtcctcacgtgtcaaataaaacccctgaattgcagagccaaaatgcaaacaaatagaactcctcactcaacctccctcagtttataagtaaggaaatgaagacctagtaaaacattataacttacagatacctgtcagggcagaaccagaagctggacttgggctaggaaaagttgttcccccctgattacattttccaaaggttataccttttccacagtttctaaggtaacatgttgattgacttgacagttgtagaaatattaggaagtggtataaagccaagaccatgtttactaaacagtgctgctcttttttttacatcatacagatgagaaagctggtgctcagggaatttaagcaacttgcccagagtcacgtagcttagaagtgttagagccaagatttggaccccagtctttctcactttcacagacttgcttttaaccactgtgttatgctatgctgcctcagtataagctcctttcaaacaaaccacttccagtctctgacatgcaagcccagaagttttcagatttacaatggcatactttttttctatctgctaagtgttagatgtcacggtgtctgcaatggagtagagctttagaaatgaggataaaacatttggtttgatgttagtattaagaactccaatatccaaggcaggaaacttggtaattaatattttaaatggactggaggggtcacaggtattaaaatcaatattttgatggcaagataacaatgtaggaacaaataattggagatgtttagcaaaattatgaattaagtagatgtataaacggcagattatgaaagggaaacaaagattacctgggaagagttttgtgttttagtcaactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactgaaaaaaccaaaaccaaagaaaaaaaaaaacaaaaaaaacagagaatgcagaatgccattttaaaaaccctaagaggctgtgtctgatgttacaggactctttgactccattagtctcaattctaatatttaagttaagt

SEQ ID NO: 115372 - DNA, 1179 bp, Homo sapiens
acggttacctggactggaaaatgtcttggaggttacgaagtctttgaattctttagtgtaaattgtctccgctttgaaattccacaattgatcgaatcctttcattctctttcccactcctaattgttccactctaactctccacccaccgccaggaatatgaaaacaacatagagtagaactgatgatatcagctgtataacacgctttattttacggcattaatgggcagctttccaagtccataaaaatcttttgctgatctgattttaatatccatattcttcagttatactagaaagaatgatttccgagatgtggaaatgttagccgggaaacaaaaggacataggcacataaagcaaaatctggcaggaaatgtgggtttaataaattgaattatgtgaaactcctatttcaaatggactgatactagaggagcagccctcgagagatatgcacagtaatgattcttcgttttcaaagacctgtttctttttgaaaaggaagaagccctgaacagcattcctttcaaatacacaaaggtagctaaagtacaaccttctcctctttcctatttgttctttaaaaaattgtaaaaattatattaagtgtgcttcttgtgatagagtcaataaagggagaaggagtttagcaaagcacatttactatatactcttaacccgtcttgcttactgtaataatcgaaagaaagatggctaattgtcttgcaggaatttgggttatcctctgaaaggatacaagtaaatttgtaacttgggtcgtattggctattttttgttctcttttgctttcatttttgttttgtctgaggtttataaatggaacccttctttcctttcttccttttttccttccttccttcttcccttccttttttcctttcttccttgctttctctctctctctctctctctctttttttttttttacaattgtacttaaaagaataaaggattctgaaaatcagttccaggatccaataagggcctagattgtatatcacaggatcagagccccttgctctcaaatttatgattgtgaggatgtattattgtatttgggggatcaataagcagagccagagccttcacacaaggctccttgtgccccctcccccgctccatcccatgaggttaaaaagcactgactttgactt

SEQ ID NO: 115373 - DNA, 1039 bp, Homo sapiens
taataggtggatgaccttgagtaaagcatgacgcagcctttgggcatcagtttcctcacttaaaggtagaagggttgaaccaggtgtaagctgctgttcttccatgttatgattctaaatagttctagatggaattatgttgcacatttcatatgttgttaaacagcttctctctggaacagttgctcctaatctcctaataagcttactatgggtcactcagcaatcttcaagagaaacaaacattatttggttggtggataccaagacaattctgatgtgtttgtgtcaaagattggtcagatgaaatctaactagacatgtatcattccatcatcaagcgaaatgaccttgactctaaacatcttaatttgaactgtagacatttcccaaatgctttagggtagatttggaccataatacactccactgtaaatggagaaagttcatcatccccataataattgcccccaaactgctaggtaggaatgcatactgggtttagtatgtattaactcccttgtgaattcagcttttgagagcagacctcttaacaagtcatgagtatttagagtgaaatatttaattcttagtgatactattttcctattctgctattattattcagctatgattattttccttctcctcccaacctcctatttctttttctttattaaaaaaaggagaggaggtgcatgctgccatctggggtgaatatgggcttcacgtggggacctgggcgctggttctgatccagagagtgagctaggagcacttacacaagagggtcttagccactgtgtcgggggaatagccttatatcaaagactgaagccttttagtaaaacctgaagaataatcagaagcagcattgactagtctctaaccttggttgagggacacacacacacacacacacacacacacacacacacacggctctgaaagctcagacacggaggacacgctgtgatccacttagccctctcttctccttcagggggtccttgcaggacagaacgctaaggaacaaagt

SEQ ID NO: 115374 - DNA, 1920 bp, Homo sapiens
tttacatgtatactgaatcacgtaaaagttatttaggtcagtacttccccacatttgttccttcatgacatacgctgataactatatttctacgaaaactgcagtaaataaaggatgtggcttgtgttcagtctcccacccactagcgacaagagccaagggaaatcaatagcttggctcacctgtcatctccactctttggcacaccattgagaagtctaatatgtgcaaagaaaagttaattttactttcaagggttatacctttgcttattccaaagaacggtgggggagtgtaccagggccattattataatgtatattattaaactttttacattttaactgatttctcttatagtaaaattaattatatattagctttggggtatacaaaattgcactttgataataatatttaggaattggcaactttgtgggcaaagttgtgggaactatcagaaaagtaaaaaataaaggtgggacccgaaagaaggaaggattgtaggttggagccatacgcgactagaaactaagacatgtatccttaaaaaccctcaaatctgtgttctgatgggaaaaccctgctaagtcaatggttcccagactttggaatttcaaaacaaaaaactgtgaggcccaacatacaattaccaactcttcatttttgccaaacaaaactattttcaacagaacacactaacatatactggaaccatgatttcatattatgacatttattttccacattctatatacttttaatatgcaaaacaaggacaaaaagggcagtcatctcccatggggggcttagaaatctctcattaatgtgtgtgtgtgtgtgtgtgtgtgtgtgtgtgtgtgtgtgtgtgtgtgttttaaattggccttattatttctttaaatttaaccaagggccagtaaaactcccttttggaataccacacgcccgtgctgttcaggaatgattatgataaagtcattcatgaggacatagagttatttcatatgctctcaaaaatgacttgcagtgcgaaacacagctactattggacaagacaacaacccaactttatataacaattttttaattcactagtacttgtgtatcagtcaataaagtacctggtacttgtgtactaggcactgggatggagttggggatacgaaagtgaaaaatatagtcacaatttctaccttatactctagtaggggaaagaaaaacaaaatgtatgattgaactgccttaagcaccatgaaggcaacatacaaattgctgtgagagcatataaccaactcagaaatcagccttaaactgagacctaaaaaggactccccctgtgccttttgtatatttaaggcatcttttttatattctagaaatacaatatcattgagcagatagattccaaagggccatcttctagctggatgaaatagaaaagggcaccccttcctcaggctaacagccctgcctgctgagggcatagttaggtgaatggatcatcactaatgaatggatggttttaaagaagggaataacatgaccaaatttgcatttaactttactcaatagtctggagtatttaaatatgattaaaccttttctttccattcacttgaatgaggcagaagggctattcaggaatttaaagttgactaaggtattgattgggtacaaaatttttactaggtaggtaagggcaggatgattccattagaaacaagaactttttctccagtgctctgggaagaattgattggttcagggctaaatcaccaagatgaataccttcttttgattcacacacccttttgacatctgggtttccctgaatcatatgcaatctaggacttacgcagaccactccagtttcacttacgaaatttgggttagccaacttaaacagtcatggctgta

SEQ ID NO: 115375 - DNA, 1044 bp, Homo sapiens
aaaattaatgatggtttgttctcaaaggcccattgtcccgttgattttatcagttattctttgttaataaggtggtaatgtggtcttaagagcttccactactgagagaatccaaggaatcatagataagtaaattgatgtcaaatattatgactttttctctttcattcttgtactgtatctagttgcctcatctttttttctaaatctcacagtttttgatcaaattccctagggacagcttacatgctagctttatgagggaggtgagtcatgcaatcccaagaaagcaaaagtggagttgagggggtgaaaggaacagcagtagggaagaagagaaaccatgtacaaggtaatgcattactaagcttgtcagagcttcccaacaacaacaacaacaacaacaacaacaaaactagttgctaagttacaagggacattgcctgtgaggctgtgtcgtaaaacattccacatggagaagaaagggtgagcaatttttctgtgcataggtcttttgtctctcattggtcaaagtttgctccatggtacccttggccctcccagagtccctggggaatacagagcctttgtccatctcacgtgtagctggatggttcctgtcaagtcagaggccattgcccacgctaagcccgcaaggatggggaggtggaaaacatgaggcaattgcagtgataaccgctgctttactggggctgctgtggcatgcctgggaaactgggagagtggcttatgcccaaggggtagggtgggcagagctgacctggggaggccacaaacaggacctagtgtacttttctacagtatactagcagaattagaatgaatcagacaagagatttattaaattaagcttttgtaatgtcctgatgtagtgcactgtattttaatgctgtgtcttctgttgcttgagttcctaatttgtaccaggtgttgtgccaaatgcttcaaataaattaccttgtgaaatcctcacgactctatggactccaatttacaaatgagaaaactaagacttaacttgct

SEQ ID NO: 115376 - DNA, 1472 bp, Homo sapiens
aaagagcttggaccagcacatttctcagagagagctctacttacagtaaatgttatgtgacagagcaggatagcaaatagatgttacctggggcaactctaattgcttggtcatgactgtcgggagtaaagtgttaatagtttcttgcatatcctccaagagagtattacaaatactattctgcaccaagctctttgtaatttaatagtgtatcttggggcccttttgtatggacttatacagatcatgatctagagataatgatcattcttatttgacacatagtattgcattatgttatgtctaaaaacccatttaactctattgatagtcttgtgggtcatttccagtttttactacaattaatacaaataacactgcaggcatccttgtgcctgaacatctttgtgagtttacccattgaataaagtcttagctgtgaaactgaatttaaaattttcataaatattgccaagctgtcttctaaaaagaatatattaagttacaatcccaccatcatcacaagaaatgcttgtatttctatacacactgaccctgagattcacaaaaaacatattttccccatctaatttaattgcaaagaaaattagtcacctttcatacatttatgggccagttccctcctacctccaaagactcattgaatcaattatcttgaggagtttattttttatggatatgttaatgttttgagtatattaagaaaatgaactctcctcatttgtgtaaacttttcaaaaaattttaatttgtttagggttttttttttttatcatttagtcttttaaaatatttgagtagtcaaattcatcctttcagatggtttctggacaccctgtatcttttatgcttgtttttcctggcattcggtgcagtacctatcacaaaatagattctcaataaatgttttttaaataaatggacaacgaatgcatgaataagtgaaggatataatttattcttttcattcctcctcatgctatgtagagatttgcaaaatgaatgccaaaacatatctttgaacagaatttcatggcccagtatcttcaggcagtggtttttctgttttgttcaaaatgatgtccctatcatctgcatagtgctggcgtatgggagatatacgtattgaatgaatacataaatatagagaataatgagataaatagaacgtggattatttggagttcatcctcctgagctaatgatgggcatttctggaagtgctgggttgcaaataagtccagaccagagaggattgtgtttaaaggcccagaatctcaactgataatcctcagaagctcagatttacttttttcattccaagtaaattaaactggagtggtaagaaaaagaaaaatggttatgaccatcaaccccagaaacagggaccacatttaattgaatttataatgtccctaacatctctgctgtgtttgaaaggttaaaaattt

SEQ ID NO: 115377 - DNA, 1004 bp, Homo sapiens
ttttagaaaagtggcatggctgctgatctatcagtgcaaaaaggagcacacccacccactacatggccaaaaatgttgaaggcaagagactagatggcttgtgaataatatcaaatgaagttgtctttctgtaggaagtcttagacaatgtaatcttgggaggcgggtggatcacaaggtcaggagttcgagactagcctgactaatatggtgaaaccccatctctactcaaaatacaaaaatagccaggtgtggtggcatgcacctgtagtcccagctactcaggaggctgaggcaggagaatcacttgagcccaggaggcagaggttgcagtgagctgagctcgtgccactgcactccagcctgggcaacacagcgagattccgtctaaaaaaaacaaaccaaaaaaagaaaatgtaatcaagctaaaatggctttggctttccttcagtaaatggttactgtgggaatatatgtgaaatgaatatcaatactatgatgagaaacacatgcactaaacagctatacttctgatgccattctcaaatctgaaactttgcccaatttcagggacaaaagtgaagtaatatgtatccccagtgtttagcttttctcttgccatggatactaacagtgagattcctcagggactgttcctttaacctcgttagggttgctaggggctattgtgcctttcacaacacagcacctgcaactgggaataattgaaattttctgccattagctattcccagcagagtattctgagtcacatagaaagtgtcagaagcatataaattactgatacattttttaatcccatattccctcagggttggcgtttttctctcttgaaagtttcccccttaaggctgggcgtggtggcttacgcctgtaatcccagcactttgggaggccgaggcaggcagatcaagaagtcaggagatccagaccatcctggttaatacggtgaaaccctgtctctactaaaaatacaaaaaatt

SEQ ID NO: 115378 - DNA, 1122 bp, Homo sapiens
aacaaatttttctctgaaatattgttattaaattttcttaaaaattgtttctaaccttctttactagagctcactataaggtagtctttagtttaagaacttcaacactctctgattttggtttaccattttcatttgtgcaaaatgaatgtgtacataagaatctgtatttccaacccaaagaggcattataatgaccgttaaattttccatccaagaaataaactaactccaccatccctgagtgtataccctgcccttctcactcttgtgttctttaattagacccaatgtgcaggacatgacttgactgaaatttatagccacattgagacatgcagctaaagaaagctcttagaccaggcatcatctcaaacttttaaagcaataggatcatttgacagaagtgtgactcgctatagtaattacacaggtgcaagttataactacttaatctgctcccagcatctctgttgcccttgagaagtatgatgtcctctagccaacatggctgttcatatgggactgaatctgcacatatttgaattgagtttttcaagtttagaaatgtgatactattttacccttatgtgccttccacaatcctactcctctcttaggtggatcagagtttctggaatccatcatctttagttctgcaatttacatctcagacttacatgtttctaggcataaatgcaagaatgacaacatcaaggcctatgaaacttagacttgtatgtatgtgatggtagacattgaagtttgttgcaggaaaatgtttctctgtcatcctaggaaaagcccccagtttctcagttcctcctcctccacacgacagttttttagtttttttagttttttagtttttttctaaaatggagttaagtccaggtgcaatagctcacacctgtaatcctagtattttgggaggctgagatgggcagattgcttgagcccaggagtttgagaccagcctggacaacatggcaaaaccccatctctaccaaaaataaaaataaaaaaaataaaaaaattggcatggcagtaggttccagtagtcccagctacttgggaggcagagcctgggaggttgagactgcagtgagccgtgattgctcc

SEQ ID NO: 115379 - DNA, 2085 bp, Homo sapiens
ttcaatttttaaaatttaaatggaactgccatgtattcttgagtgttgtagctatacagcagtggtccccaacctttttggcaccagggactggcttcatggaagacaatttttccatggatggtggggagaggggttggttttgggatgaaaccacctcagatcatcaggcattagattctcataaggagtgcacaacctagatgcctcgcatgcacagttcacaataggattcacagtcccactgatctgacaggagataaagctcaggtggtaatgctcgcttgcctgctgctcacttcctgctgtgccaccaggttcctaacaggccatggaccggaagcagtctgtggcttggaggttggggatccctgctatatgggccagaaatgtgaaagaggtgttcagtggggagtatacttctaacttgaatacattcttttcagcatttctacttattttatcaaaaggtaattttttttctcaggaaataaagcaataggcaattgttttttatagtttttctgtacagagccttattcaattatactaccaatgtaatcctattgcactgctcaacagaatcagaataagaagaacttccaagtacaatttgaaaataaaagtatctttcaagaatttgcactgtactgcattatttgatttggaaaaaaaaaaaaatcagaccacttccatttcttgatgaaacaactaactcatttgctaactttcaactggctctcttcagtggctttgagaatgtggcacttccatcataccttgcctgtagtaccaccctagaactttttttaattgaaaatattttaaaagataattgattcgtatgcttcaaaattcaaaacgtgccctagaaaggatcgattattaacagcttcttgtgtattatgtaaacaaatcttatgcatatacaagcaaaatacatattggctagcactcttaaaaacataggaagggttgaatctgaccaagttaatatttcaaaggtgtctatcagaaaggaaaaggaaagcttcctacagttatgtgtatatttttttttagtttaaaaagaataagaacaagatattgggtgtgtatgtatatatgtatctatttatttattggagacggaatcttgctctgtcacccaggctggagtgcagtggcaggatctcagctcactgcaacctccacctcccaggttcaagcgattctcctgccttagcctcccgagtagctgggactacaggcgtatgtcatcacgcccagctaatttttgtatttttagtagggacagggtttcaccatgttggccaggctggtttcaaactcctgaactcgggtgatccacccacctcagcctcacaaagtgctgggattacaggcatgagccactgcgcccagccagattttgggtttttaaacctattgaacttatctttggatacatattttaagttttccttaactgtaaatgtgtttatgttcactagaaacaccacatgatttcgcagacatggaattatgtaggtgaaatcagcggctttcaattagggctcgataatattagatatagtataacttttatggcattcacacatactcttcagggataccctttgcaattccggaatagtgtttttcttgcttacttcagtcgatttcttatatctttaggaaagatctgcacattcattctaggtgaatgtaaaattgcattttaaatccattcattgggaatctcacttcttaaaaatcatgcggaaagatagatgtacatttttagtaaccgagctgttcagtaaatttcttaagattattttctcataacctctgtacatcaaaagtgaaaagaacctgtccccttctctctgtatgcaaaattccagagaagcaccaagaaccagaagaagatgaaagattcggaagagcacacattttccagcctgccagcctgggtttaatttcactttcccaaatatttacttggtaaattcagaaaaatcactggacctccaggaacctcatttccattactgtcatgtgggatagtgataacactatggatcattacaaatattaaat

SEQ ID NO: 115380 - DNA, 1092 bp, Homo sapiens
atgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggaaaaagataatgcctccttctatggtcactaccaggaagtgagctccatgcagcagacagaaaccaaccagataactgtgagatcccagccaagcacaatttctacatgttagtcaattgcaagaaacactgagatgtaatgtagtactttggactcatattactcaggtgactatgttttcaagcagccagtacaggacagaagagattcatttccttgaatcaaagctatttggtgacttttcctggaaacactctgaggcttacaggaagggattccagattcccaagctactggcacagagtaagcatcttttctttacatagtaattcacaaacgtccctcatcaccatatgacaatatcctcactggatcagctcggttaccagaaataactagatcaaaataaatgtcattctcacatggacacaggtggactagggtttagaagttttgggaaccatcacagttctaggcacctgaaacttcttcttttgcttgtagtaaatatggtgtctttctcaggactctgccctttgtttatttatatatctggtctggtttttgttttctagagatagttctctactctccatagtgtctgctttctcattgcctgagtttgtacatggcttgccatagcttctctaggcccaattttaggccatcagtagatttaaaaatttttttttctcttgacaccaattaccttagttgcaatttcccatttataattgcaacttgagcctacaaatttacaaatacaatgaggtaactttccactgtggttaaatattatagattattggctgct

SEQ ID NO: 115381 - DNA, 1332 bp, Homo sapiens
aacagtagaaaccagcatggaaaactttttctcctatttgagaaagtgggatgaaaatgtgtctcttaatccctttggcagaagggagtaacttgaaagaagtggatgatggatgatcttctccactctgtcagccctctgagcagaatgaggaaaatgtgagaagcgataccattgctatatttgtttcattgaccattattttaaataacttacatggtcctgaacaaggacatgtttttgtgaaaaggacaacatttcttttggtgtgtccgagtagcatttaagaaaagccttatagtggtcaatgaaggttggcctttcacccgctgctactggagagtctgtgagaacactatttattcagcctcatggaaacactagggagtcatgcctgggatctgacaactgtgcagcaccatgccaggtgcacagagagttgttgtgatgaatgtcgagagaggtggtgggggatttttgttgtttttgctccttccattttctttccctctgacttgggctgtggtttcattcattctacctccccacccctatgcaagaatagatctctgatctctttctcatactttatctgccctaacttccactttccttttcttgagaggagaagaacaactccacagtgctttccttttatgttttgggctaattttgttgtgttgttttatggtcttgaactgagagctgcctcagcactcaacaccagcccctggactgtgagactaatgagaaaagcaaaatgacttcaagtaaaaggaagtggtttgtgttgtggagagaaacttggaaagaaacaccaccaagaacactaggggctttattttccctaaagcctacagttgggttaacacatttcaaaataaccggtcaatttagttaatcccatcaaacgacctagtcaatacagtaaagaggtagggcaaataaacaaaccgttttttggatgaccggtttagcttcatgtatccttcgtcttactcatttctagggaataatttcaactcaaggaaatgtgaacatctgttttgcaaactattacaggctggtttaatacaaaaatacctttaaaaaaggtatgttcatactcaacatgtttttccagctgttattaaagcaggtagaaacaatatagtaggcatagaaatcttgattataatgtggaaaaactaaggttaaaattattagcagaaatacatttcttttccatccttccactgtctgaacatctctctttcctacttcctccattttattattttctttgctttgtttctctcttttaacctcaataataacaattctgtgtgccaa

SEQ ID NO: 115382 - DNA, 1099 bp, Homo sapiens
acaccatcacacccagctaatttttgtatttttagtagagacagcgtttcactatgttggccaggctggtctcgaattcttggcctcaagtgatcctcctgccttggcctccaaagtgctgaggttacaggtgtgagccaccatgctcggccccaaatgaatacaatttttattttattttataactattgatcaaatccatgctctcttctctaacctgctaatatttccctagttcaagcactcaccaactctcccctgaattatagtactagtacctgaaatagtgtttttgaaactgtcagttgcatttagcattttattttaaaaatatgatacagaattgcgtaaaaaataagagtataaaaccacatctataatatcaaagataaatatggttttataaaattattgatacacccacagacatgcaaacacacacagacattttgccatgaaaatgtatttcttactataatttttaaaattagagaactactttcttaaatggtcgatctctgttgcacctcttcttagctctggccttccatgatgccagcaaatttatgtagttgaaaaattaatctgcaaatgtcactcttcttaaaaccttttcaagccttcccatcatccatgataaaatcagatctctttcgtgtggtacccaaagcccctatccagatatgtattgtacctcctctccagcccagcccctggctgactctttcagcagcaaactttttccacccacgtgcaccatgtttcacaactgtcttcatttacttgtactcttctcaccatctaaaactcgcttctctctcataattgcctggttcactttatctcattttagaggacacctaaaattcaagcccagtccccttcctcaggccgagtcaggctcttctcccaaacctacctctagcataacctaatgaaattgctctaaaaattatggtctatgcctctttattaaaaaaaaacaacaacaacaaaaaaaaaaaccctgcccaccagtatagcaattcttttgttataaccacacatagtactagtgtgtggttctggggcactgtcatgccaacttacctgtgttcaa

SEQ ID NO: 115383 - DNA, 2246 bp, Homo sapiens
aattgcctttatcttctttagtcatatttccctaagaagtgaataaaagataccaaggcaatgtgtgaattccactttttccaatctggatgtttaggggatatccttgacaccatttgctattttgagttttcaacaaagagttaaaagaaaattctggcactcctatctagtcatcctctccagttggcagaagtcttcatgtggacttgatggttgcccagagcaacaaaatattagggacagaaacatgttcagggactcgattgtataagtgactcagagctgagagaccttttccagcttgactgcagcccatacttagctaaagtgggtatttgtctattcctgtctgcatactgtgacttggagatgcctattattttgcttgctaaaatatggaagccaaccttgaaactggcagagaagagttaaatgatcagaaggcaatcgtcttcattcagcacgtctgacacatgaaagatcattaggactagcaaatataaacaagatcagggagtggtcttgggctttgaagagcacataccaagaacatcaagagaactcaatataaattcaatataaaagctactattcaaggccaattatctcttttgagttagaagagcccaatggagagccactcacgcaaatcaataccctttccttctctcagttggagccagacatctctaactatcctctgaattaaactggatttttaaaatgtttttctgtccctaaactctttaaatcctgaggtcatcctttctttgttccatcagtctggctccatgataccaattactccagcttgttaaagcagttattggcatatggtagtcatgtcttttgtttctatgcaatgtttcctggagcaagaattggagggagaagtattagccaagtcttgttgctttaagtctcctctcttcaactgtttaactaggttccatcctaattatgtgtttggttggttttattttgatacccaatatacattcttctcatttgtacatgaacaatgtcattatggtaataataacaattatacaatattactttctgtcctcattgaatgtcattatgatcaggagctggtcctcttggtttggacattataatttgaaatgaatattctttttaaatgattggaaacttagtcgtaaattcaagtggtttacaatagtaactcttatcccagtaaccacagcacctgtttagaaaaatgtcttcggatcacttgtttgcaaatgtctttttccttaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgaccttacgggaaaaaacaacatacatgtggctttattttgcctttttttttttttaattaatgaagaaatccaagatttgacttttgtttcttctctacccaaatcaaaagcagtctataatctcctgcaaagatcaaagctttttgcttactataaagtatgtgccctgcttaggcattacatggtagaaagatagcattctgttccaagaaatctctattcgttctctagttgctgtgtatatattctcttttagctagaatatggttagtaaatgagtcctgaaaatttcgctgtatataccaaaacatgttgtataccataaatatataaaatatttttatttcaattttttaaaattgtgcttcaatcaagacagaagttgatttctttttccagaaattcagagtgagcagtccagggctgctgtggctgctctaaaatcaccaagggcccagagcttctttcagataatttttttaacatttctagattataggctttgtcttcatggtctgagatgactacaagagccctagccatcacaactaagtggccagcagcaagaaggaggaaaaaagaaggaatagtacacccactccttttagaaaaggcttctgagaaatcccacataatgcttctacttacatctccttggctcaaatttagtgtctgccacaaaa

SEQ ID NO: 115384 - DNA, 1120 bp, Homo sapiens
atccacccatctcggcctcccaaagtgctgggattacaggcgtgagccaccacacccggccaaaaacaactatttttaaagagcatctaagctcagaaatcacaggcatattacgcctgccactaagggagttagttccattgaaggatataattaagagtgaaatgaatggtgtgctaagcacttagggatagtggttcacaaatttgtctgttccttaaaatcaccttggggggcaggcgtggtgcctcacacctgtaatcccagcactttagcaggtcaaggccagaggatcacttgaggccaagagttccagactagcctgggcagcgcagtgagatcctgtttctacagaagataataataatcacctggaaatttcttttttttaatgcagctaatgaaggaaaaaaaaatccgaggttttgaaaccaactcaaagacaacagcgatattcaagcataagatgtaataaaggttgtacactagatagctagatagccagaataaaaaggaagagatagttacaaaaaatataaggaggataaatgtataggatttcataactgctaatcatatgattttactgagtaggtgtaaaatgcttctgataatgtgtgaaaatttataatccttcgtattatatgtaggataaacataggttaagacctggattctaaggctgaatttaaggctagtttatctccatccttagatttcctacatttcatttaagagaaaatgtcctgtatattgaatattcatgaaaatctctgaaaggtgttatgcttattcttaacctcttaaaggtgtacactgaatgtaattaaatcatttttgctggctctggttcctcatgaacatctgcttttgtacttccctgtcattcacaaatgcacttaggagctaatgatctatgaggacttttttttcccctacagtaacgagcagcaaatctggctgcactttaatttctcatctgctgtcccatattgtctggtggtcagttcatgatgttactaagcttggctttattggcatcttttgtgagctgctgctgctttttccttggcaaacctgattaccaagctattgcattgagcataaaataaaggtaaat

SEQ ID NO: 115385 - DNA, 1541 bp, Homo sapiens
tatgcttggttctatacaagacgccgtgacgtgtggcccctgtaggaagtcctggcctctgtctctaaatctgtcatctcagcccaacccctattcagattatctgtgccctctgcgtagccattcacttcgcctgggtgcaatcatgccttccttacccaacgtttaacaagtccagcctagcaacctacatcatgccatccaacagaaggaaggcattattgactcagaacaaagtataggcgctcttagaataagtttattaaatcatttttttaaaaaaaagatatgtgctttttcccaggggagcagtgaggcattgtcagagggtggattcattaaatcaatacagagaatcctggctgcactatttgttagctatttgactttgggaaagttattctctgagccttgatttctcattagaagacgggaataatagcaaacctatctcagagcattaagtaagaattaaatgaagtgaattaagcacgaaacctagcatctgacgcatagtaggaactaaaaaagaaatactagttcttgaataaacatttttttcttgactgtactgtgatacttccatcagtgagtttccaaggcaaatgaatcatctttagaattggaagctcaatgtaagcaacaatgaagtaaagaaaacaactgaatttctcttgaaattattttcctttactgacttgtctttattgtctgtgttcacaagaaactagctctgactgcaaaaatgtctgcctgtttctatggccagttcttttctacatgtttaaattcctaattgtgcacacaatcttagtcacaatattttcatgtgcaagcaattaagactcatttaacagccctccctctggaaggttttgttctccatctgccacaaatcagattccttaggaagatatttgattttgaaacaatgttaaagtactgttcattttgttcaaatttcatttatgtaccattttttaaagtgatgtaaatggacagccacaaaaagctcagcagctggtcaaaacaaaacatcaaagtcaccattgaaatggggcaaaaaaattaaaaactaatatgctgggacaatgccaaataaaaacgatagtctgataaacattcctcagacacattttgctcataacaactatttcctttacagcagatttaaaatatgggaaaataggaatataccccagttgccactctgaatcttagctgtcctgagttcactgcaatgtatataataaggaagtcagaaggtggaaaagaggaaaagattaaatttgtaagttttttgaaagatatatggtaaaaagtagaggtatccaacagatttgtacgatagattgttcatttaaggaccaggagcggtggctcacgcctgttatccagcattttgggaggccaaggaggggcggatcacctgaggtcaggagttcgagaccagcctggccaacatggagaaaccccgtctctattaaaaatacaaaattagccaggcgtggtggcacatgcctgtaatcccggctactcgg

SEQ ID NO: 115386 - DNA, 1434 bp, Homo sapiens
atgagtggagggtaggacaagaggagggataagatctgtggatgcacagaaactctttgggaaaccctaaaaactctctatagttatataagctaaggaaaggattcctgccagggggtataggattcttcaattcccacacttctcttcctgactcttctgaagtgcccgttgtcaccagagtgcccaggggcagagcattgacaaggaaaggcccaggtgtgtgtgagaagtcaggcagatggggtgtttcggaggaaccagggtaacgcagtgcttcagcgttagcactcaccttgcttctgggaccacttaccacgaaggcctgaaagggcaggccccaactactgggaatattaatcttctctttgggtgaagtctcttcatgccattatcatctcttagctaccattgctaggcaaaagtttcctagctcaccatgtcctgaatgcacttccttgagatatttctgatgcttaaatatccagtgctttctagtgtgccgtcttccttctgtatttttgttttgttttgttttgtttttttgtggttccttttcagcactgttggtcctgtggaagtatttctaattgactgtattctatatgccacacaaaacagatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaataaagaagagagaaaggaagggagagaggaagaatggagcagatgcaggtgagattgtttttctaaagagctaagaagctgcctacagtgttagcttagagactgaaaatggtttgggaaaataattcagaaatttagggaatacttcacagcatgagaaagtggagggctgagattggtaaaagaagacatgtttcaaaatagccaaaaggaaaatagaaaagaactggtcgtgaaaccgagacctcagagttgaatgacaagtaagatacctctgaagtcactgacagtggactgactgttatttgactaatattgcttctacagagacagacctaggttttatcctcccatagaaaaaaatctcaaacattggtaggttttgtttttgtgttttgacatacaagtcaaaatctatgtgaaggaggaggaacaagactcaggggtcagaaaattggggtttcgtggctggctgtcctgctcacccactttacgtg

SEQ ID NO: 115387 - DNA, 1045 bp, Homo sapiens
ctgtagttctttttttcctttaatagaataaagattgtggccacactttaataattgccagaaatatgtgttcattaagctttttaagaaatgtgatcgaaaaatgctgatgatacattgtgtttaatagctttaataaaaaactgataaagcatctaatacatctaatgactgtcggatttcctaaatcttttaagctgaaggagtttacttttacaaaaatcctcattgaaaaagaatcttccggtaaaaacattgaactgaaagatttgcataaatgcatggagtattactatttattagttaaacttatgatcttttagagcagtaaaagtcagttctctttcttacaaatgaatttgttttggccttttatgcttttatttaatgagtagagccatacctattaatatataaaaagatcagatctgacaccgtggctttttgaccaggaattgattgaagttagacttgttttaagaatagtgaaaacaagggctatgtcctaattatgaggggaaataatttaattgtgtctctcttgtctgaatatctgatttggatgctttgttataactttaattgaaataattaaatggggctcatgttcatttagcctagcaaaaaggtgatgagctagcatatatgttaaaaacccagctttcctcttagtagttgtctaattttggtcaatgtacttaaattctccaagttttgggggtattctttatcagtaaattctaattcagtgcttaacatagtacttggtactcagaatgtattcaacaaatgttacttatcattattgctataatattattattattattatctgcttggtcaacagtattttccatgcaccttatatatggcatgcatacgctctggaggtaaaatgtgactactggttcaagaaatttacaaagtaagggagaaggaattataaatagttaagtactagctaaatgccatgattgaagcctttatattttttattttaattaattaattaatttttagaaatagggcctcactctgttgccca

SEQ ID NO: 115388 - DNA, 1040 bp, Homo sapiens
aattgtctatcaaccttttctggtgtacaaaccagcaatttcatagggtttaaacaaaacataacctggaaagaggttttcttttcataaaaatgacctttctattttgtaaataagcataacttgactccagctttttccggaggtaaaaccgaagtaatgaatctctcccagtgcgggtcgccgcttcctccgccgccagtggcacctcaacctcatggtctgtgttttaccgccatctagtggtaacaagtgtatatggttatgaaaaacaatcctcgaaaccatttattttcctctttttttttaggctatgatgttcagctgtttaagtgttaaatgataaccgtattttcctgctattttcagtgattcttattgtttaataaatgtttagaagcacctaagaagatccgagagtagtgtacgtaaataacattgaatccttccccatgggctaatacatgaaccatctttgtctaaaatttttctgtaaaactaccagtatttccttcctaaggaatatatatttctcatcattcccaatgtaattttgacattgactggctatacttctgcttggtggggcagaagagaaagaaatgaccttaattttctaaccattgagctctgtggaagaaacgtcagggatctttttggttagcaagcattaaggagtaaggacaactgtaaaaggagccttaaagctttgactacagttcttaaagagtcgaattcaggggaagtgagggctgccctgaacaaaagcaaagaacaatggaactttaacttaggggcttcagtaaaactgtttatagttctccccacagcctgcagtaacagatgctccctctttgtgccctgcaatgcaaagtgaaagcttaaaagactaacacagtgataacagtgatgacgacaccaagagtcagtcagcgaggcccaagacaacacccccttataagatttgtctagaaatgttatttacacttctgccaatagcatacatgtcatactgtagaagataatagttaacaccaaac

SEQ ID NO: 115389 - DNA, 1027 bp, Homo sapiens
ttgattaagaataaaataaaagctcaaggaggtacaaagtaaatatgcagccaactcttagagaatgtatacaagtatatagcactaggctaaattcagaatctaaaaaattagctcatataaggcagaagagaagttcctgaccacttctgctcagagaccgtcacacaatttgttaaatatagatgatgcagtagcaacttaattcttaagaaaagtaagaaaaagaaaaatgttaagtattagcatgagtctagtaaataaatacatgaaaataaacttgcattaccattaatagtaaaaattttttataacagtagaaacaactagataacaaaaggctggttgcccaagtggtgtcatgaagtaacatgaagaaaattacagcgtaaatagacaatatttttgtcatcttaatatttcagcatctgaataacaatcacttctgtgttttcacatcatccagtaatatagtatctgtatttggaaacacataaagttatgatacattgcaaagattaagaggagaattagcaatgacaagataagtagaattaagtcacaaaactatgaatttattaagtataagttacctgtcaaactacttaagttttaagaaatactcaattcacctggataactaatcctctattccccatcctctgttaaattaacaccaacacatagaatgcaaagatgatccaatcggctcttcactcacattcatatacattgcttctacacacagaatatggggtggggtgaatgcattcagagggccagtgacgaggaagtgagtagatttgatataccataaaaagctggggcatatttgggaatctagctaagttatccccaggcactatacagatatctcagacctcactgatcaggccttcggggtgccccattggggcattttctcagctagtagataatactctccctacctcccatgtcaaactactgtcctttctttagcaattaacaagtccctcaccacttcttgggcctctaatgtgtgttt

SEQ ID NO: 115390 - DNA, 1002 bp, Homo sapiens
gtgcagtgacacgatcagtcactgtaaccttgaactcctggtctgaagcgatcctcccacgtgtgcctctaaagtgtcgggattacaggcatgagctactgtgctcagcctctactctgttttctaccttttatttgttgcaaaagcaacatgtttattttaacaaatactggtcttcctcatcttactcccctgagatttcaatgttaaaagttgatttgtgtgtttccacgtaagtctttataacaagcttctgctgacactccttggcccagctttccataaacacatccatccctacctattaggttgaactgtacaaaattgccatttttataggtccccactattctttaataccaagcctcaaatttagccagacactaaatgtcctgttttatatacacgccttattcattccttcttggttttgtttttgtggcttcacttttgctggatggcctccacccccaaccccagctctactctggctggacattttttaactctccttcaaaggtgtacatcctgcaacttcttaaattccctttacattcattgtctacatcacatagtctgattgcctatataatacaatttcgtgttttagtatttatatgctatttaatacagatgccacctgttttgctgcttttattttctctggttgcttgatgttctattaccttaactagactttagtgctttctagaaaaggacaatgtgtagtatatctgtacttattcaagtgctgatctaaggacataggatgtaatgtaaaagtttattcaatgactatttcaaaatacaaagtctctctttgtataaagtcattcactaatactgacattggctgatacttcagactggagattctcggtaatattactttttcttgataattaattttgattataagaggatttaatatcatggaaataaattatgcaaatgaactcagaccctaggttcacttcccagaacaaaccgtattctgagaat

SEQ ID NO: 115391 - DNA, 1034 bp, Homo sapiens
aatttcaggcaagttacttctcttagcaccattgctttatccggcatagtaataaaaatcaaatgagacaatggatatgaaatgctaaaaatagtacattctctgttgttattatctattgtgattattgtgttacccttggaaaaaggcctgtagaatagtggcagctgggtcccctggacagtgaactaccaacctaaaaactgtctgggcaggcttgcctttgggagttcttgtatatcagctctaattctgtccaggaattcagaggcagagagcagggttgaggagaatttcacaggtggtaagatctccggtgaggaggcatttcagcaacgtgatcagtgttgccaaagctatgaaagatgttgaagaacacactttctacctgagatatcaactaaagtttgaagcttcaggagaaggcatagttctatcaacagacagcagtacagcaccaatagttaaaccctatatggtagatttaaatgctgagccttcaaaatcatttgcctgttttactttagctccagcaaagggatagagaaacccttcttctgtcatccctctcccatgtttgctgttgcttaagcagtatttattttggtaacaagaatacctggccttgccacttaatctccaccattccaaagaaaacctttctgagatcatcttaacgttgtctctaggcaataaatatctctggtttctagttattcccaaggacactgacctcacatttcttactgtcttaaagtcaaaagtacctttgtccttaactcacaccaatatgtatgagactaggatatgagagagattgttacatcttgcttgatgttttgacattataggtagtgtaggttttgttattacagtttgacttttgaaatgcgtatgagatttctcaggtgaaatagagcctttgatgtggtactcaaaagggataactatgactcagaggaaccatttctaaaagatggcactctttctccttccagttctttctgttcaatagtagggctggggaaaggcag

SEQ ID NO: 115392 - DNA, 1017 bp, Homo sapiens
aagcctacattctatttccatttttaaaaagttcaccagtaaacaattgtacagcaaattttatcaatgtaaaaagccattgtactctatccagtcaaaccatattcacctctcctaaagtgcccattacggaggctctgggaaattgaagttgcccttaatcttgagttacaatgggcagggcctctttttttctctaaattttactcaataaatgcaggcttcctatgcattaaatggtgcccacaaacattgaaactactagctcacctcctgaaattcagcactttactatgtgtctttcaatgtaagagcattcactaatttaacaagcattacataacatgtgtcattaatgagttcagttagctaggccatggaatagatattcctgtaaatcaactcctttacagttactaactgacttagtttcatggcagaggcatttatttcaattagactgtggttcctgttgagataaaatgagatcaactatgtgacatgattttgaaaaccatattatattggtgcatgaatgtatatgtgtgtgggtgtaggtagtttacagacagaatgtgtaacataggcatgtggcttgtaactgaaacttttacaaaacctagttcattctcattctataaaagtgtgtacacacatgtgcatatacacacacacactgtgataatgtatctgtgtatttgagggttataaatatttagttgtagagttctgacaaagtagtaaaatagtctcacttcatctggataaagatcaccatctggaactataaaaattgcaatgattccaaattgttgaatagttggattgcatatttacttttcagtagtatgttggcatgcatgtagatccagccttcctttcaacaaagaacagtggtggaagattcccttaaatggttactctttcctcaataagagcaaccatataaaaattatagaactattagtcatcatagttgaaagtatcgcataagattaacagagtccccatctggtg

SEQ ID NO: 115393 - DNA, 1024 bp, Homo sapiens
cattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttggtaacgttcttttctctcatgcttttccccttttctcttttaagattgacgtactccttgagtatttagtaagttgtgtgatgtcgaggctttgtgaaagaaggcagtattggcggctcttttattctttattttgttcccaaactcatgtgctttaaccaaatgggtgctgattttttttttaattcctcttggactgtaacaatttatctgatgataatttttaaaggaggaaagaaacttgcagatatgttgggagttttgaaaatgaaaacttgtcatttttcagtgtttgattcagttgcttgttttcttatcttctttgcttgctgcaagcaggctggtggttgacaggctttgcccttgtctttaaaagcaataccctcacttttagcacagatgtgttagaaattaataatgttatttatatttaatcatacacatgaaacaaacttgaatttaactatgtggctaaatgtatatcaagttgcttatcattcattcatctcttatgttttattttattagaaat

SEQ ID NO: 115394 - DNA, 1033 bp, Homo sapiens
aaacctctagaaattgcctcaaaattcccctccagataaggaaaataacacaatatttctcaataatgaggaactgctacaggagttcagtgtcttattctcattaacgttagagtacaatagagaatagcaggaaactgtaaaaactgcagtcccctggtctttttttctaaaaagttagtttgacatatctggagtactgaatttcagcatatttgagaggcctgaatatttagttgatatataatatggctctaagaaatatgctcatgatagattggaaagtatagaatatctattgtaatctgaaaataggaatttagagaacagaagatttgatagtaggcagagtatttgaaaatagtaatacttgagaaaacctgagttgtatagtaaaattactccgtaacacctcattcagttggcttcatttaatgtttaatgtttaatccatggataaatgtcataagtctcacaagtcacgctcaccattggatgataagagaaagggagatcacattttaggtgcgcacaatctacctgtatgcaattgacgctttccatgtaagtgttgccaagttgtatcggggcaccattagtggtatgagacagactttaggagttattttggactcctttttttctattaatatatcttatattttgggggcaaattataccagtatattaaatctatttacagaataaatataaagttaccttttatattcagtttaagtttttttaaaaagtgagtcaattaagaaaaatatcaaatcatggtatagatggaatgctaatatggaaagaattatgaaggtggtgttatgactgaagtttcagaaacatcaaatgacatagtcatttgattcaacaaaacatctacagatggatgacccaatggatgtatacatctatggtacagtctattgaaatgtggtaacaaccagaaagtaaaaggtccatacattatacaattcagtacaacagggaaatactgagaaataatcgcagcttctggatcaaaagcatg

SEQ ID NO: 115395 - DNA, 1035 bp, Homo sapiens
acttaaccctattgcatatattctgtaagtagctgtccttcatgaaacagacaactttttcttttaaaaatcaaggagattgtacagaactttgtgattttaattactgcatggcaaactaattcagtctcatatcctttccatttaatagggatttgtccctagctatgtgacctaagcaagctctttaactgtactccacctcaatttgcttatctgtaaaacatggataatattatttttagtctaaaacttcctctggtatgacagaaaagaccaatgtgaaacaattccctgaatttgtcaataaaccatgttacatttataaaaatgcctccagtgtacccagaccagaggaatctgtggcttatactaaaacgtgtattatgtattcattctcaaggtatatgccaacagttaagttagaaatccatccctttctctgtcacttgtccaaagtcaattactccatgcttcttttacataaggaaaactatcttaaaaggaggaagtaagatcacggacaaacaaaagttcataaggtctttcattttactgcctttcaaaaggttaagatcagagaacttagacatgcataagctttggtttgaggaacaattgagtcaaccatcgtaacagagggcctgaaagtatctgaaggtagaatgaatagtttatagtaagccagtccactctcagctctgagaacatccagctgcataacctcaagggaactgcgtggaaaaaattaagggaaattctttgggctttagagcttttcatttcctatgaacaaggcatctcctgcccttgtctcacccatatctccattgtcctcatgtagtcttctgctggttcactgtgtgcctggcaagtcaggttcttacgcgagggaaagagctgttttaagttgtttatgaatagagaaagcagattcagtcagacgtaatctgactctgtatgcctgcaggggttgtggcctttgttagtttattatgcctgtaatttgggaagtcatgctgcagagatgtaaag

SEQ ID NO: 115396 - DNA, 1057 bp, Homo sapiens
tttaaaagcctagagttattaacaaattatgccctcaatcagattttatataacttttttcaatcttgtcatatattaatgtgctgtattcatgaaatgattttgagattttaaagcaatgattgacaatatagtagttcatttaaagtttttacaagttgctgctgacaaaatatgggtaatgaattacatcaaataagtataaatataagtacacgctttgaagttaaaactcagtaagttgttatgattaaaattgttcactttattttcctcctgtgtatgggtttctcataaatggtaacttatacctatgaaaatacagggttctataaagtctgaaaacatagttattatatatcttaacggaccgaagatgtccttcctgatattatgtatagcctgtgtttccagactaagtgccaggcactattctaagttaggcacgattctaagtgttttactgttcatttaggctgtctggctagtgtttttctcaccttatcagcatcccatttttattaagtgaatttgcctaaacacacctgcacacgcacatgcatgcgcgtgcacacacacacactttttgcatttggaagcctggctattatggaactctagaacatgagagctcagggtcaaccaccaagactcaataaggtatggctggggatgtgaccaagactatcctagcatctatggctgtggactgggtgtcttctccactgacccttgaaggtagttttgcttcactgctttagaaatggtgcagagacttaatcttatttcacttttcggtgtttgtcttggttcctgtagaactggcttgaggcttagaagatgtcctcccacctgcatttggaaaaatacatttctaacacttctcctcatatggaaatttttaagtcattgaaaaactcatactgcagcatttgtagaaacaatttcagaacagagtaccttattgcttttcctaaaagaattttaactgtgcatgtataagtattataaatgcataaaatatatagttaatccaaaagacataactatatcatgc

SEQ ID NO: 115397 - DNA, 2389 bp, Homo sapiens
atgccatgtttacaagataaaaacaagaataaataataattgtttgaaatattttcatcatattgcctctgaaatgattgatgtcatactgcctggatttagtcaactcagtgaatgatttatcagtagccatgctctaaggagctctctattcatagatacttatgatttggtgaactgggaaacccacagagaaaggtaaatgaaataggagagccaggtaaatgggccatggatctaagaaccaggaatcatgattgtttggaagaacatatctcagactgagaaaagctggcgctaaagtaagctagcatttgattagaatgttgaaggataatttcattcttggagacagaaaacctaagtagaagcaaaagaagtaggaaatagaagcctgtgtttgagagattcagagtgactgtgttttattagaattgcaagaaagggaacttgaaaacataaatttaacatggggcaacaggccttggattctgaacagagggactttgtttaaggatggctctgtggctgtggaacagtttttctatagattatcaaaatgattctggaaaagaaatgtcattctggactgagagcacataccatagggaaaacatgaggcttatgggctgaattgtgtcacacccaaagtcatatgctgaagtcctaacctaggacctcagaatgtggctttatttgaagattgagcctgtaaataggtgattttgataaaatgagatcattagggtagacccgaatccaacaaggctggtgtctttataagaaaaggagattaagatgcacgcgcacacgcagagaagactacgtggagatgaggagaagatggccatctacaagccaagaggagaggtctcccgaagaaaccaaccccactgacatcttgacctcagtcctctggcctccggaactgttttaaaacataagtttctattgttaaagccacctaagtctgtggtattttgtaatggcagccctagggaaaaactacaatgagcaagtattatttgtattttaagaaataatattataaactaaattcatggaggggaaaatagaaaaagaggtcatttctgaaaacattgtataggtgtaacatagttgacactatcaactactacaatgggatcaggagacagagggtcagtgataacggagctctcaagactggaaactgggcgatccagaaggacaggcggttgatgaaagaaaatgatgagtgtggttgaggctgcgtttcccttgaggaggtgctggtgctcagggtagaggcatccatcacgatgtcagaaatgtgtgtcagacacgaaggcaggaatgaggctgtcgaggaagccatggcaacataaacagagaagtgccacagcgagacaaccagccaatgagttgtgtagtttcttgtaagtagctgaaacaacataaccaaattgttcaatttagtctacatatgaaatttcaatgtcagagaaaggcctttaatctcaaaacgaaataaactaaaagacattattttcctgacagctaagtcttaaaatttcttttgagaaataaaaaaaatggttttctcttttaacatagaggcaaaccagtaagtcagatacttcaggggaaggtagcttggtgatttgaatgtatgtgagtgtgaatacgtgagattagaatcttacctgagaacaaattttcatgagcatcattggagagtgggagagcatgaagacttttacccttctctctgcaggagagaattgtgcaggaggaggtggggagaatgccaccaagaacaggttgcctggggctagtttagcgatggggtccaaacgatctcactaatgtgaaaggatcatagttaccttaccaagggaaagttggcttcaactatatatttcacttctgtaccaggttttgcttaaatgctactctttggagaatatcaagaaatttagatgagtttaccaaatccaagattgtgttccctgcttttaactcttgttactgaaatagccccctgatccccaagagtaatgcttgactgaggtgtttgcatgaattgtttatatcattcattaattaacgtgatgaacatattaaagataggactcccagttttcatcccaagggcttacatataatagtaacaacctttagaaaagtactgcattgtttatttatagaatggctttgactcacttaataatgctccataattaatttgtaaattactttttgactttgcacaattataatttaatgtcatatatctgcaaaagaaaacacttttatgttgctaatattaatttcccttcataaatttgagactgttttgactatagataaatgtaaaatgtcaatgtggtgagaatgactcagcttc

SEQ ID NO: 115398 - DNA, 1017 bp, Homo sapiens
gctgattttaattgctctgataatgaactggagagagacacactaagcttcctggatttctgttggaaatgaatgggattcttgccaactatggatcacagttatgaggtattctgcacagggaaaatcaaaagaaagcagatggaccttgacatgctatgccatcctatgccttcttccttcccaagaagcatgttacaataactttaagtgaaggttgtcacaactttaagtgaaaagtctcccctttctgtctaatttttaatgtaacttcccccttctcgatatatccagaaaatagttaataacaatccctgagggaaaagaaaaatgctgcccttcatattaaaaaaaagaagataacagagatccccttagtggtgagtgatttatagtgaaaacagccaactcattctcttttgcctccttttgacctagagaactggattcgcggatttgtaactggattttgattatagagtatgttctatggctacaaaagagttttcctttgaggaaaactcaaactgccaacagatatgcttggtatatcagttttcaatgctttcaattgtaaataacagaaacctggactcacaatagcttgaacaaataggaattacttttaagtaggtggcaccggaggtgtttcagctgttgcatgatgttatcaccatttgcaaagaggcagcatctccacaattttcttggcctgttcctcttgatggcaaatggctactgcacgtccagatgatcatgtctgtgtcacagatagtgagagggaaggaggaaggatgagagaggatggccagctaaagttgtatctaccccacttataagaaacacaaagcccttccccagagcttacagccctttagccagaactatgacacatggtcatcttgagtgcagaaagatggaagttaacatttggttttctggtctttttaataaagatagcaaggatgaagaagtttggaaaagactgtgggctagccaatcaaattgtcgaccaca

SEQ ID NO: 115399 - DNA, 1372 bp, Homo sapiens
tgagttcacccaggagaggcatcaaactctgcaatcagaacatatcaacacatggcctattagctgattctgccacttggtagctgtatattctctctctgtttagtgtccttatctgtaaattgaaataataataatagctcataaggctttgtggggattaagtgagataatcatgtacagtgcccagcacagtgtctactgcatggtaaatactgcaaaaatgttagctgttgactgctcctatttatgaccttcattattaaaaaggggaacttaggctgacgcaggagaatggcgtgaaccccgggggacggagcctgcagtgagccgagatcacaccactgccctccagcctgggcgacagcgagactccgtgtcaaaaaaaaaaaaaaggtgggggggggggaacttatgaatgcctttcacttataccagcatcattaaaaatttaagttttttaagaaccatgaaaagctaaccattgacaatttaagaagcatgcaagcttggtttacaaaagaactggacaagctcagaatgggctagttcagtggagtgactgctgcaggagctcaggttttgagaccttcctgtcttcttccttcatccttctcctctttttgtgttctctccacacacttttcctcatcaaagccaaaacctttgttcttgctatattctctttttagagcctgctcacagtaaaattttaaaaaaatgaagaagtgctgaaagtgtagataagcaattagacatgagttaatgttttttatttgcaagagcatttgcattctaatatgaactgaacattgagtaaatagattcctgactccctaacagggctatgtcttgtgtcaggaagccagcgcactgggcttcttggtaggcaggagacccaagtcatcatctgctactaaggctgggtcttggaagatggagaaggccgtagaagaaaggaaagccaaaaaaagaaaggaatgagattttgatatattaattagctcatactataagcctggacttttgctaggcattttccatggtaatttggttatacctcaaaacaattctcaacattattatcactgccaccacttctgttagcagctgtgagaacagaggtcatgtgagtaagcagtttgctaagggttgcatagcttaaaaagtagtcaataagctaaagtttgaaccctgagatgcctggccttcacagctaaacttttattaattacacctgcttctaacaacaacaaccatggctaaagtttcattaacctaccagtttctaacaacattaacaaaaacattttcaaaaatataataatagtcatcaataggaataaagggaaacaatccaaaaatagctctg

SEQ ID NO: 115400 - DNA, 1011 bp, Homo sapiens
aagggcagcagccggctgaactagatttccacttttgtcttggctcattaaacaacaatggacaagttaccttaacttcatgggtcctcaaccttctcattcgaaattgagtgtatggactgtatattacaatatccttttaagcttacagaaataacattatggaggtatgagaaaattgtaaatgatccaagatatgtgcctaaatatttcttcatacatcaagcatgcattcatgaaatcaacaccaagcccaggaaatatcaaagaatagctcaatgtccctgtgaacttatatccaattcaataattcatccaacaaatgtatattgagtatataatctgctagacttatgaagccttaaactttatgctgtacattctgatatatgttgttttaaccaggggttggtcagctttcaaaagtgacccttttgctaacattgttcttctggctgaaagctagtaagtataagcaaaaggagagatgtatatgatctcacttctatgtggaatctaaaaaagtcaaactcacagaggcagataatagaagggggttaccagggggtgatgggaacaggagggattggggaaatggtggtcagaggatataaaatttcagttagacaagaggaataagttcaagagatctactgtacaacatggtgactatcattaagaacaatgtattgtaaaccaaatattatatgtggtcacttataagtgtgacctaaataatgagaccacatggatacataggggggaacaacagacacaggagcataccagagaggggagggtgggagaagggagagaatcaggaaaaataactaatggatactaggcttaatacccccatgacacgaatttaccattgtaacaaacctgcacatatatccctgaactttaaataataacaaaaccaaaaaaaaaaaagaaaatttctaagagagtagattttaaatgttctcaccacaaaaaagtatgtgagttaatgcatatgttaattag

SEQ ID NO: 115401 - DNA, 1006 bp, Homo sapiens
tactatgtaactgtgaattaagtgactaaaataagaaacgatctgatatgcagaaatagagttttccctgtttgatccatatgcagcttaaatatgtgatgttattctacattttatccagattcatttttcaaaccaatagtaatcattgttagcaaaaaccaataaataatcttttattctgttttaaaatttccatgtcgtactttgagttcttgctatatatcccgtgctcactttaaatcaggttttccttcccgtacattatttcttggaaaatatgttttggacttttcctaaaccaccttaacctgttgaaaaacactagtaaatgcataggcagtgtaagtcacgctaaaataaatgtgtattgctttttcaagattttgtttacccatgcatttaaagaaggtttttttccctttattttctttcttttttgtcattatagtcattatgtctttttaatgttaagattccggtaatatatattcctcatttttatgtcatctccaaagctccccataactgattgatgatatcaatccggcttctggcatataaagtttgttgacctggttcagtttgtaccatgtcaaaatgtgatcattaattattagatgatgtcaggaaaaatttagtatgtgtgataactgtgggtcccatttcttaaagctttcaaaatccaatcttaaggctctctactttgtggcatatgagggaacataagtaaacattagagcaatatcaaacgtattctaagggtttcatgatgtgaaacaatatatcactttattaccagacagatacttcacatcgtgaaatttgaaaaagcatacgaggtggggcacagtggtttaccctataatcctagtgctttgggagggtgaggtgggaggatcgcctgagtccaagagtttgacaccagcctgtgctacagagtgagaccccatttctacaaaaaatttaaaaattagtagggtgtgatggtgcctgcctgtagtct

SEQ ID NO: 115402 - DNA, 1048 bp, Homo sapiens
acctttacaaagaaattgataatttatttgcatataagttcaagcatatccattccatacatctgtgagtacatttgtagttctaggcctgaaactcagaactgcacaaggtcaatggaaccatataaatattgacctcattactgacttgttttcagtctccagtctcttgagtgaatttacctttgcttctttgttattataaaaatacagtgagggaaagtaaaacaaggaggaagatgaaaagaagatgtagggggaagaggagcagtttacaatatactttctattacattgtttcacactatctcaaaactttttatacgtagaaaatactaaagcaaagaaaaatggaagttaaaaatcggtagcagtagtaatagtcctatagtaggaaccttgttttgtttgaaatatgtgtctgtgtctgcctacaaaacataaacaccttaagctaagaataactgtgagattaattttttattttcaaagaaataatacaaattttaaatcttgcattaaaaggaaagctagctggacgaaacttttctgacacacagattttgagaatagcacccataaatatgcttccaatgcttgtcacttgatccctttttggcaattaacttgcctttaattgatttgtggattacccactggaagttgctatggataaaggaatgtaatggcagagtttgtttatatagggtaacaaaatagactggctgggaggagggatttaactgcaaaatatccttgattttcaggaatttttcttttcacataatggcagtgtttagataaagaatggaaagttaatgaatcagatttgtgttcccatccaaagggaagatttatgtcctgtttaagaatcacattaatttgatgacgttagtacattctctagtgaaagagtggccactttagtggaggaaaaaaacaagcaacaaaactccttctgccatcttcaggttgtacctgacgaaaagcttttatttgtgggttctatgaagtatcactgccctgatctcagatgaactaaaagatg

SEQ ID NO: 115403 - DNA, 1050 bp, Homo sapiens
tgtgggtaaaatacatttttataagaaaagattaatatatagcttattaagtttgattgaggcagaaagaaggattgaaagagaaaagaagagggagagggaaggaaaggcaggggagaggaggggagcagggccgtggaaggaggagtgaggaagagaaaaagagagaaagcagagggttacataataaggaaggtactttttctctgtgagcccagaagagattgccaaccatgttttcagtaatgggatcagtgttagcattagggcaccacttacaaagatgagtactaattttgagggcaaggtgctgatttatctgcctaggttctggcacacatgtttaaagattcacctaattactttagagcaacgcccctcccaagtattatagagaagaaagaggagaatgatgtgctcaagaaaacaatgtggagaagtttatattggttgtttaaacatagtacctaaaaaaaaaaaaatggggaaaaacgatctgggaagtaaagaaagaatcaaggagcaaagatttagcaagcctgtggaccctgacaactccaataagagaacactagggaattttgtgatttaaaatatattattgcttaaaactacagtagtgttcaaggaaactttaaatagaaaattactcttcttgagatgattctgtcttccaaagagaacaaatcacaaggatgttaaaaggaacattttatgtgacaagtttggggtaggtactatgtaaatagaagagaaagtcactcaaggtacatttgaatgtagggcagagattattccatagcattccacaggccagaaacagaaagtgtcttctagttttcttgccctttatagtaataggggtcatgggatagaaattctcagaaaatctccaaatctcatttttgccaattgtttcaacatcttttccttcccagcattttagcagagctgccaaacaggtgattaattaaatacatatgtgcatgcttgtacctcgtgtagaaggtctaatgagtaaatttatttgatatgacatagactgaacag

SEQ ID NO: 115404 - DNA, 1038 bp, Homo sapiens
tctttgttgtcagagtcatgcattgtaattcactctctaaggtgacgcagcatctccttgagggcaaagctgccaaaagttctgaaagtgatctgcctgtttttttttctcacactgacttttagagaggcgctggtattttcaagacgagtaaatcctgtttacatcctgtggaaggttggctaagaattatatccatctctttttaagagaagttgaaataaggaaaattatagttggcagttagctgtgtgaaatttagtaatctttgtcagatgacccagtcataggcatgtattttttaaaattttttaacgaagccctgtgggtttacattttttaaagttcacactgatataaaggtttacccacttcaatcacaccttttgttgtgtgtgcatgcgtgtgtgtgtgttgtgcttttcaggagtggcatgtgactatgctgtttaatcagggctatatttaaaaacaaattttcgagggagtgtttctcacgttaattatgagataaggcctgagtgaagcaaactctgtcgcaaaggccaagtgtcatgcagcaggaagtcctggccatcccttccagccctgcctcagccagcctgccatctctctgtcagcgcataccactgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacaggtattactcttttccttttgtagctaggaagaattgtttaactgccttaggccccttgcaaataagcctttgccctatgttgaccttctaactcctaatgcttgttaaattgacaatatattaaataagagccaagaagatgatgtaaaccttgaaataggggtatgtaggtacgtgcagaagttgaaggaa

SEQ ID NO: 115405 - DNA, 1031 bp, Homo sapiens
tgtatactgtgtattttaggtataaataactactagctatacctattttttgcctagagttccattctctcctcattttgtgatgaatcccatcattccacagatctttcctagaagacctttcataattttctatttccaaatggaagtgcctccttaactagctgtttttcttttcttctgtgtctgttactgcactatcataataaatcttaatttatatattttctatctttcctcctccctaagagtggcatgatggaaagagttgtttcagaaaaaatttggcaatggaatgctgcattaattggaatggaaaagaatgaatccctacaccaacagaaggaagcagtgtgaaatcctgacagggacaatttcattacaattacaaaatacataaatatgtgattacaattgtgagaactgctcaaaaggaaacaaggacccagtgagagtataaaaataagtacctaacatagtctgagtgtttggagaatgcttccctggggatgatgaggcctgaggatgagtaacaacatactctgctgagaaccacatgaatgaagccctgatgtgttaaactaaaaggataaggtgtctgaagtgtaatgaggcagagaggagagtggcaaaaataaactggagaagatgagtaggggagactactgttttcttacatgctaattaacccaataattctttatttcattttggagagaaacaagtgattatttattaatttattcattggcaatgcaatttaaaaacatattctttgtgtcttatttatcattgaggtttttaaaacattgaaataaacaataggtaatattttccaactgagatttaaaaaagaaaaaggtcagttttcaaatctattcccaactgctagagtttaataaaaactgtcataaatgttgacctttgttctgcaatcagttcagcatttatccatcacccaaccatgcagcctctcgcttgccaaaaggagtggaatgagaattgttagagtacttggaatgtttactgtc

SEQ ID NO: 115406 - DNA, 1107 bp, Homo sapiens
atcagagaaggctgtcattggtttatttgttatattcctagctcatggtgattgtatgttagccaaatatcttgcatttgattttaaaacaaatcagaagtagatgactcagaaatgttgacaataaaattatggacaagccccttgctacagcagctcttattaattaaatatctgagacagcagaattaaaagagaagaaagtgatatacaatttggaaggtttggaaagctggccataaaattatttctttcagctggagataccttacctacttataatatataaaatttttgaagaaataagaataggtcttattttactttgcagtgaaggcttgaaatatttgaaagttcactttattgcaataggattaagtacatcaaacttcatccattcttatctctctcaaatattaggagtataactttcaactgaacttctttgcctgctgtaatatactgttctatagtgatattttaaaatgaatactttgtgaacatagtactagaaaaaggatagtgttttgaatattttaatagccttacagggttaaaaaaggatcttataaaaagtatgtttagtaccattcaatttttacaaatttatgcatttgcttattcatatatgtaaatttaaaatttacatataagcttatactcagaaaaagataaatgttgtaaacacacttgcatgcacacacacaccataacaaccaccatgccattcagtggttatttcagggtaagtaggattgcagaaacttttacatattcacgttttgcctatattttctgttataagcttttattttggcatgagaagaaaaaaattttaaaatttcccaaaaacattctttgtaatagtcaaaaattaaaatgaacagtgtctatcaataggagaatggctacaccaacaaaaaaagtcaagtaagaaataaaattggccaggcctggtggctcatgcctgtaatcccagcactttgggaggccaaggctggtggattgcttgagcccaggagtttgagaccagcctgggcaatatggcaaaacaccatatgtacaaaaaatacaaaaaaaatagccaagcatggtggcatgcacatg

SEQ ID NO: 115407 - DNA, 1066 bp, Homo sapiens
ctatttctgtttgcccagtgaaacagaacaaatatgcccagttccctcagagagctagcagaaaaaagttctagtggggtgtcatgggagtttctctcttgtgtaactaggtgaactcctgtaaggaaaatttgccatgcaccctgcagagctgagacttactattctctgttgtaggacccatactttccccagtaaggaactccattttttttcaggcctttgctcaaatatcactttcttaataagacctttcatgaccatctgtttttaaaaacaactaatcaaaacctatcctcaagtgcagactttctgtatcctcattcctgcattatttttctctgtagcacatgtagctattcagcacacttagatttttatttatttattaattaagggttgactccatcccaccagatcgtaagctttatgaaggtagaacatttgtctattctgttgagttatgaatctttagaacctaggtgggtgcctggtacctaatgggtgtgaaataagcatttgttgaatgaatgagcgaaggaatgaatgaataaataaattttccccagtggagcaacaagcaacagttggagtcccttgttgtcaatcaaatataaagatagcaaagagtaagtaagcaagagtgaacttgcatcatatcaagatttcttttatattccttaacattgaaaatattcatgtggtgaaatacagtattagagttttctcctttagttgcaaataatagaaactgaatttaagccgacttaaacaaaatagcagtttgcaggatcttgaaactcaaaaattcaaaggatacagctagttttaatggttgtgaggattgctgcaggccctctcatgatttgattgagcgtttgtctctgtctttctctttctctccttctgtctcactgtgtttctaagactttctctatgtggtagcaaagaaagctcagacagcacaaggctgcctgtagtaattcttgtgacatgagagcatacatctcccagtagttccaaggaaaacccagggctgacttgaaacgtgtgcacttggattaca

SEQ ID NO: 115408 - DNA, 1050 bp, Homo sapiens
gtcctgttttgcttaaaaacaaactctaaggaatttttctaaaacatgactcaacctaactaggtatatatactgtactttaaagtgaacatatttgaaataattgtgagtgacaaagagacggaaaaacatagattttgaaactagcattattctaatgatttttatcccagtggtttatttggaaatgaatttccattcacaacatcttcatttgtcttctaattttcatgcaatttgaaagggttagtttccttacccacaggatcatcctggtcaaatctcaaaagattggctagggcattctgattttacaggcaaatttatattttgccgtttcaggaaataattccttcatggttatcttttataaagagcttatttgtataatatatacacatagtatatatcaaataaaagatctggtgttataaacataagaataagcaatttcccttttgtgataggaatatgaaattccttctggtagaggacgtttaagagcatgtccaaagaatggctaatcaatgaattctctcattttgtaaggagacacttagatgcatttctgaaaaaaacaaaacaaaacaaaacaaaacaaaaaacactttgggctttctctgtattcttcaagcatttctaaacatttattgacatatgcagtagagaaaaactggtatcaggaggaaggcagtaagtagccagcagtcacaaggtacaaagaataaaatgcatgcaaacatgtacagtattcactttcaggagttaatctacattttatttaatttttttttttttttttgacagcgtttcactcttgttgcccaggctggagtgcagtggtgcgatctcagctcactgcaacatctgcctcccgggttcaagcaattctccggcctcagcctcccaaatagctgggattacaggcatatgccaccatgcctggctaatttttttgaatttttagtagagacgggtttttgccatgttggtcaggctggtctcaaactcctgaccacaggtgatctgcctgcctcggctgcccaaagt

SEQ ID NO: 115409 - DNA, 1034 bp, Homo sapiens
ccccacaagcaaacatgttttttttttcttagtccagaaagaagaaatacagtgtgaacataatacttagggtagacaaaatggccaaaatagattaagttggcatcctttttagctgcagcttccttaaccttgtaccacaccctgacatcatcttcctacatggccacacctcatccccccatagccaaacattatttgcattcatcactcattcgtagatgccaaatcagacatggttcttgcccctatggagtttatgattaactggggaagacatgcattaatcaaattctctttctctctctctctcattctctcacacacacacacacacacacacacacacacacacacacacacacacacatgaaactgtgactggatcagatgctacgggagaaagacacacagggttcaaaaatctgtgaagggtttttttatctgttcagggaaaatcaggaatgtcttctctgaggatgagtagttcaggctgtgatttgcaggatcagtaagaattaaccaggaaaagaaggcaagagagagaaccttatgtggtgaatgaacaaatgtttaatataaaggcagcagaagagccagggtggaggcaggcacagaggtgggagataaggctctggtggccatgctaaagatccttacttcaccctgacagtgatggatcatcacaacatttccaagatcaagaatgcacttcccatctgtgtttcctctaaagtcaaaatatggcccatctttcaaaaggaaaattcaaatgttacccattcagtcttctaacactttcatttcctaatctaattagaaaagatcattctggctaagaggtggtatagtagtttaacccacccactcatatgcatgtgtttgtatttatatataaaattttattttcacatttctttttcctagtggcattagcaaaagcactcccagtttcattgagtctcttttaagttttgcttcccctctcctcctctcttcactatgctctgctgtcttggtgtctccccactact

SEQ ID NO: 115410 - DNA, 1031 bp, Homo sapiens
cacctgtcactcagtaagtatccaataaatattgttatagtacagattaggcaactagctgtgaatggttaaccaggttgcctagggtaatcagtggcaggccacttccaacctagatcttacccattaactataggttgcttggaggtctaaactgcctcttctatatcacattcttgttcagtaaatacagggacaataccttgggttaagtttgaattatgagggataatttatacctcctcatctctcaagcctcagcaagaatcgactgatgtgccctcccatgttgagtcagtgcctaccttatacaggatggattttctgtttatgactgtcttactcaggccctgcttcattagattctctgttcttagcacagtgcctgacacatagtaggtgctcaataaaatgattttagagtaaacattacttttccagaattgtgtcctgggaatttacggcttttaatattaatttcaggtttttaggatatagcccatgtttttggggggatagatactgtttctataaaaattgtcatcttgagcataaataattcccacatatcttgatttctgtcacttgggagagtttaactggatttgtagaagcaaccatcctgccgaactgggtgtatctgtaaaatctaaatgctattgctacaaatcaccttatctaagacaccatttcttcaaaactaataactagctcattcactttcatataggaatctttctttccttgaagatatgtatgttttatcttgctggtgagataaaagtctgtaaattatctccacagctggctctgatgcttgattatgcccctttctgcatctataacattgatgtttcattttaattacttttcatcacagtacatgatgtggtcttcagacatagaccagcctctacgtgtggctcttcgttctttttatacatctttcactgtcaaactaagctctaaaaatcatctccctaatatctcttcacttgccaagaaaatgtactagctttgtattatatgta

SEQ ID NO: 115411 - DNA, 1035 bp, Homo sapiens
aaggtctcgccaaattgctcttttcatctccaaagactccccctatcctcattctcacatttagagccttttcttcgtgaagggaccgatcagaagttggcaacaggccagtgctaaggaataataaacattgtaaaagacatatgtgctttggtttcacgagccctagctcatctctagaaaggctctgtaccctttggagaggcgggacttggcatgtgctggtcctctttctgtcctgctttttgagaagcaagaatgagaaaaagctgagacacaggaggtctagggtagtcttcaaattttaccagaagtagtaattgaaatagaagcctgtgcacagagttcctacttgtactctcatccacctgccctagggctggtgtgttgattattgagcaatagtattacaaattcactctttatcagttatgagttaaagttaataagtggtcctattacttggtttaatagaacactaccccttccgtgctaaaagagtggtatgaagaatgtgtgtttcttctttgaagctacattagaaatattagctggaggattttattgcgaaggcttctttccattacacttttcagtctttttactgccaagccaaacaaagataagggtttgcctcactggatagataagtactatatagctcttcttatttttccttctggctagttgttagaatggagagatagcctggcattcaggaacaagtatggcatggttgaaagaagggaaatgcaagtcagctttctaggaatttaaatttcatgtagcagcagttaagaggacctttagaagcattatgacctggaatcacatgccagggtctaacatgaatgacctaacacagtgtgactaacatgttcagctttttgcctgacttaaaagatatataacaactttttataatcttatttgtaaaaatactataatttcatgccagaaacatcaaggctatgttgaatgcaattgaatttcatagctaaacaatttaggagggcattttatttaaataccttt

SEQ ID NO: 115412 - DNA, 1013 bp, Homo sapiens
aatgctaaaatgtgttggtgcctcacagttaaggatattttagctattcaagaaatatttctaccagaatgaaccagtagaattctagtagaattctaacatatgaatcaggaagtgctcaggctctcatagaacttgcttagtgccttgatatttggtcatctattaaggttcaatgcaatgcattcaggtccctggacatgtgatatcatgtgccatttcttgctggagtttatgactaaatgtgtgtaggaactcattgctgagggtatttataagagcaaaaggtcattattttaaaattgcttgtttttgccatacctttagggtcagctggattctgactttcatagcagaaactttgtgaatgcataataaaggcacatgttaaggcttagtgtctgctaacatgggttgttttggaaatgcagtttgtctgattttgaaagtatatctttcaggtaaatgttctggctggactctggatgaataatagatacctaaatataggtttcggagggctttccagctgcttttatgacaatgtctcaaatgaaagctccctgagagcttaaggtaccaccaaaatcacctgctggtttgttacagagttttcggctttcagctaaaaaatccattgcagagaaggatgggaggcatcctctcccactctaggcaggtgcttattttctaacaacaccagatccatccagagtcgatgctgtggcgtatctaccttttttgctgaccagagctactatccccagtctctagaatgcttgggtgacatgcctgcaaacctcggtggcccacttccaactgcatcaccagagtttcctagtcagggggagccttggtgccattgccttgcttgttctgttggtgagggtcaggcatcagcaataaggtcctcattattcttacagacaaatttacatcaatagtctttaatcttgagattaaaagatcctggaaacagttcctggcacgtagtaggcatttgtcaattattt

SEQ ID NO: 115413 - DNA, 1039 bp, Homo sapiens
aaatattctcaagattcttttatgctgtagtggcatctttctgaacctacaagttcacattgcttttaaggaatcacccagttcttcttcctcctaggaatcctccttttaggatcatcttttgatcaaaatgaaaattctccaaattatggtggtttttaagattagttttctttatactaggttttgaatttatgggacatgccctccacccaatcttgggtaatattttctgcaatgacaggacctcactggggaaatcctaaatgaagataatagcatgttatattaaatgttgccggtattccatttaatatcaagcaattgcgtaaaagcctttttaaatacctaagttaaaagtggtatattaatgttgagtgtacttctactgcaaagtccattctcccactgatttcaaacaaataccatttaagtgccaacctactattacaagagtttactattttattcttgctccaaaatggcatcaacagtgatggggtgcttttgggggattattgaacagaatttttgcaacaaaggagcaagcatgaagaaatgcaaaacatcagtgatagggattgcaacgttttatctcagcattcctcatatctacacaccccctaatcaaacaagcagttttatggcatgcgcaattgcaattgaagtacaactgacttctgcagaaccggcttccataggatttcctgtccaaaaatcaccatgtggtcatctgcagctaaatggttacaaatcatcaagtaaacaaggcttccccaccccggtgctttttttttaaggagtgaaatccaccaaactctatcatttgcaaattatctctggacttcttttatttctttttttttcactgggtaagaaggaaaacgagcaaacaaaaaatcctccctccgtatttgtttaaggcgtaatttccctgtgaggtgttttacaggcttctccttgtttagcttttcttgcctggtaattactgaaagaagtctgctcttccagggcgagctattcctttaaccccttttgc

SEQ ID NO: 115414 - DNA, 1044 bp, Homo sapiens
aagttttggttgagcacgaaaggagagggagtgagactaatgataagaaggttaaagtaatcactggattgatttgggatgggcagtctcaaaagtgctgaggattcagttcctatttcagtgagctggaacacacaaacatagaggaaaaagaaagacagttcaagtataaatttgaatatacctaaatgtgtgtaaattacggaagaaacaacttcaaaagaaaataacaacaatgacatgggctacagaacagttaagattaatgatccctcattatagggtgccattcagacataggagttaaaaaaaaaaaaagcaaaccagaaccacacactgcagcagctccccagttgcaagcacactgaaataacagaggcctgccttcacgggaagaggattagttctactgtgacctgtttatataaaaacaatgttgtgggtagcaagattactagaaatgacttcttggattataaaggacaattatgatagcttaggccactagctttcagtacattccatctggtacgttacaaattagctcattattctgctgttcttacgaatgtgttagtctgcaaacatatcattgtcacaaattagtcacctagtgtttctctgaaagtgatttaatataagcacacccacatcataggatggaacagtaaaatgggtccttgctagatcctccaaacagaattcagcataaagcacaattcaatttccaaaggtttttggcacatacatcatcttctgattttctaagatgaaatgtgattgttgccctggatattggtaatacattgtaatattagaaacctcttgggtctccccatgaactctagagatccaagcctactgagaaatgatgggtccacaaattgagcatagcttttatttgtttttatttacatttgttatcgcaggtgctatcacaactgttgtttcaataatagcaatttcaatttgaaaattaacttaaagatcttattttgaagtgtgttttgtagcagatgagctcacccaccagctacttggaaa

SEQ ID NO: 115415 - DNA, 1026 bp, Homo sapiens
gaattagaaatagaggcaaagtggcagaaaccccacattaaaatccatccttgtcagcactctctgatttcacataccagggttcttttcggattaatcaaaaaattgttgaaacgtgttaaaggagaaatgcaattctgtaaggggaacacagttcctatttggagggaaggaatatgtatggccactataataacaaattaggggaaggcatgtgtgaatttttatgcactcatcgtcctattgagcacaagtagagaggtttattttcttttcttcattaattgttcttacagaaataaaccacactgtgtaggaaactaggcactcttccctacctactcctgctattgaaagagccttatctatggaaatcctcaaatcagcttcttcttattgtaccagtgatgtctcttggattaattcagacaaactgtgcagtgtaaccaatgcagacagtatgttagaagcgcatggatagcttgcttccttttcattccttcttccttcctttattgtttccgcattgtggttccttgtatcctaccatcttgaatctcttgtacctctaattatagtatgctcactatatgcaaggtttctcctcccacctaccccctgctgcctcctctactgacatctcacttcattcccaagaaaaacattgccctcccctccaagctcactgtgtttgcatttctctgctcttttccgctctcctccttggcatgctggtttaatcaattttaccaaatgactttcctggcagctgtaaaaagaaaaccccagagcaagttaatagcaatctaatactgcactttctgtcatttctctaaaacgtacagaactatttggtcattggattgatttttaatgatctaaatgatcagatgtttcaacgctgcactgcagcagcctgataataaataggaaaggggaggggcatggatgctgggcactcagtcagtgctagatgaataatcctaaaacagcagccaaggagacaagataaaatgtcagcctttg

SEQ ID NO: 115416 - DNA, 1107 bp, Homo sapiens
ttatggaaaatacgtttactttttctagactcctagaaggccattttgaggacttctgtaataattcactaaatagatagaaaactgcctagacctatacttcgctgtaagatagtcctcttttggtctaaccctcatttctatttagctaactagctagtcaggagtgtaaggtaggcagtataaagaattttaaacttactagggtcacattcaaagtaagcctagagtaaaatcaggagatcagattaccccagctactgagactgaaatgtgaactgtattgttgaagagcttttcttcctcacaattgaagaagacataaagactggtgatataagagcaaatgcagacacttttggtcactgttagcttgttttgaatgtgctgactgtgtctgtgtccatcttgaaaatattgaggagtcagcaaaacatatttgactctttacccactttttcttaaatgtttcatagtcatgagtatttcgtgggggaatttaatctatgtgcctatgattcatttacactagtctcatcaaaatggcatagggagatattgaatggctaagaatccttaaagtttaagaggccatttaaggcttttatctctgaaccagaaagtcatagtgtaccaggactactcccaattcaaacataccagggttcaattttgttttgtctaatatatcccaggaaaccttactgtttgattcatgatttctaacctcaaaatgctggtctaacatatgtatatatatattaatgaagtccaggtaagaagcgcatggctagaatgggaatgttcaacataaaaatatcccagccaggcgtggtggctcatgcctgtaatcccagcagtttgggaggtcgaggcctgcagatcgcttgagctcaagagtttgagaccagcctgagcaacatggcaaaaccctgtctctacaaaaaatacaaaaattagctgggtgtggtagtgcgtgcctgtagtctcagctactcaggaggctgaggcctgagaattgcttgagcctgagaggtggaggttgcagaaccgagactgtgccactgcactcaggtctagatgatagagagagaccctaccaccaaa

SEQ ID NO: 115417 - DNA, 1019 bp, Homo sapiens
tctgaagtccatggtgccagggccctacttgtcttggaggttgttctattctgggcttggagaacagtgcctggtacaaaatagatccttaacctctggcttgaggttagggctcaataagtaataggtggtataagtatctaaaaaagaatctcattctctatccaaattggtattcactagccatatgtgaaagaaactaaattttcaattttattttaataaatctaaatttaaatatccattagtggctattatattggacagcacagatatagaacatttctgctactgcaggaagttctatgggacatttctagacatagaagcatagatgaggatataatagtgataattcagttcagacccggtgctgcctgccaaattccacaacactgccctgcattgctgccctctcatgacaccacacagctcccagttgatttgttcttctttatggtaccaggtgtattgggtgtattgcaagcattttcttcttccattattaagttaaaaataccccttgaagttttgaaaagctgtaaaggggttgtcttgagagtcccattaacatttatagtgaattctgtggcagcaattttttattttaattgttgttgtctttgctattcagataagtaagcagtaggcatagataattaatgtacagattctgttttacacaactttaagaatgactctttgagaaacatgtctttaaggacaatgaactgagatatcccttacttgaggataaaatatgggtgcaggtacaaggagtcagcaggtgtcacgtgtgggctcatttcttccctcaaccctggaaagtatatagattctcaccatccttgttcagcctctgccttagggataagcagtgctggggtgattttatgctcaggaagtaaccaaaggctagcaaacatctctcattgttggcagtaaaaaccattgctatgaataacaatctatattttataaaactattttggcttcacataaaaatctgatgcttcaag

SEQ ID NO: 115418 - DNA, 1019 bp, Homo sapiens
aacatttttgccaattgaagtgtttcttttcactaattgagcaaacaaatcatgggctatccactcacaagggctttccaccacccatattttcaggaaggcaggtgttgagcttatattttcagaatatatttccagcttcatacactcttaagagaacattgaagcctctttgatgaaggtgagggtctataaacatgcttgtattcattataaggggattgtgattgtcctcatagaaaaatgactttaagaaatagatgtatcctgaagcaagataatatgagtgtcaggctggacacgtaaaatacaagggaaggtagtggggaaaaggctgagaaaagagtactgtagactttacatcacaatgcttaaattaatctaaaatgtaagctataaaatagactaaaattatatatagacgtatgtgcgtatgtgtgcatatgcataaaagtgtatgtatctccatacttcaaaggctaatattcacagatagattcaacaatcaaatacggagttagttttgaaggaaaagccaaataagacacctttgctagactttaaaattttattttaactgaaactacggtatagacataaccatataaactaatctatttacttgtaaaattaattgtttcattgtcattgaatcagatgtgagtgtatttagataagtcaaggtagtaaaagagtataataagaaacactgagacccagggatcatgctaactcagacttctgtcttgagtctgccacataagagcaatatttcctcaggcaaattattttcatagttttgaacttgaaattctcatctgataaatggacacaccaatgcctaacacatagggtagctgtgaggattaaatgacatgcgcaatttgcatggcttcctcatcaagttgccacttgtattagtcggctagggctgctatagaaaataccacaagcttggtgccttaagcaacagaaatttattatctcaccgttctggaggctaggagtctgagatcaag

SEQ ID NO: 115419 - DNA, 1081 bp, Homo sapiens
tccttatcttgaaggccattcaccactctgccctgctgacgtgtttttcttatcacccaagattcctcccccggctcacacttctgcatgcaagcacgttcccaaagtatgaaaatgctttggatttatatcatgctgttgccttgaagagttttattctcttcctcatatcttctcagagaagaaagtaatttggctgtggttcaaaattcaccaaggcagtaaaatcttgtgttttgtacacaacttcctttctaatgacctctccctttcttcacctcacattgggcattcactcataactatttaagggccttctcttaggcggctgccctgttttcaggttgtgccctatgtggtcacaagtggctattcttaataaatcatagaatcgtagaatttaagtactgacagggatttcctatatataagaatccaacttcctactctgcagaaatccatctcagaacattctcaatgcttaaaattgccttttcgggagagaacatcaactcgtaagacaagctctttccttgttgcctaggactcatttttagaaaaatattctttgtaatgaattgtttccctgccacttcctccctttggtatgaggcatgttgccagaaagatacaaaataattctaataatctttcttagccttgataatgcaagagaatacagcaataatttcctccattaaaccttatttttttttttttttgaggttagatgcctaaattacttcaaggattcttcttgtggaagcatttttgagaattttcttgtctttctgcacctctgatttggtaacttgaccagcagacttcacaagaagcttgctgtcagtgttagtccaaacacaacctatcagttagtgtgtttagtcattaatatttaagagtgttttcataacctttaaattaataattagtcatctttattctttaatgactacagaagctcacattcatagtattttggtaactaaggtatccataggctcaaaaactcttcaaaattattgtgtaatgaaaatgttaaccatatttaagagagtgacttggaaaaaggccttgtttt

SEQ ID NO: 115420 - DNA, 1220 bp, Homo sapiens
aaactgggcaaatgcagaattgggacaaatcctatgtgcaataattgctaataggaagtgttctgaagtatgaattctctcctcctttcttgtttgacttgtcactgaatctccagtcctacagagtactatgtcctgcttattgtttatttataccacaccccacttctacgtataaacatcactttcactacggtggattcaaatgatctcttaggaatttagttacattacagtctcacataaaattactgcccttaaaaacatttgtttgctgggcagggagtggcgaaaccccatctctactaaaaatacaaaaattagccaggcgtggtggcgggcgcctgtagtcccagctactctggaggctaaggcataattgctttaacctgggaggtgcagcttgcagtgagcagagattgtgccactgcactccagccttggcaacagagtgaaactctgtctaaaaaaaaaaaaaaaaatttttttttttgctaacattatttgaagaatagtcagttcagtatgcatctatgtagacctaaccaatagttgtattttacaagtttcagttttgaaatgttggatgatatctttcagtttaaaaaattagtatttctataaagtgtctttttttggatggaaatgtttctggaatgtgacacttaaattttaattactattattaaatatcaatggatttgttttgcataaccaaacagttggataagttcagtttatgtgctgtgcaatactaagatatttacttggcatggagagaatcactggcttactaaataaaagaattcagcattttgtttgtcaatcctatgttaattgcatttatatttctgacagtttccttgatggaattaaaaaaaaaaaacatgcaataagatctgaattgagtgttgaaatgagtgtttcctgagctccaattagtgaaagtattgagatttgaagaatggttgaggagacaaggttttataattgcccttctgggaaaaagaatgagtaaacaataaagtcttgagatctctcaaacaaatatacagtcataaggaaagtttaaaagccacagtgaaatgcacacctcttaattatgttaacattgatatctattttaaattgatatcaatattagctgtgaaagtttcgtatattttgcagggacaaattctcttagtgtactccaaatgcttattgttacacatcctgag

SEQ ID NO: 115421 - DNA, 1071 bp, Homo sapiens
ggtgagggccaggtttctggttcattaatggtgtcttcttgctgtgtcctcacttggaagaaggggcaagggagctataacttggaagaaggggcctctttaatatgtgcattaatcctgttcacaaggctggaggcctaatgacctaattacctcccaaaggccctacctcctaacactattgcattggtgattagatttcaacatttgaattttgggagggtgccaatgttcagatcatagctggtcatttcagcttatttgtactctctaagttatgctgcaataattgttggcttctgtacatgggcaatatggaaattaaagcaatcataacattttggtagaggacctgaggagagattattctgaatgtgatgaagttatagtctttttcctcaggtggattagatcactttttggatagaaattttatgttgggaaaaataaaaatggttcagtgacctgaggcagaaaaagtctgttcacaggaatataagataattactccatcaactcacagttgtttggaatgtcaggatcaataatagtcctcagaacattgtaaccttactccagcaactatgctaacataaagcagagaagtctgaagtctgtccattagtattggtgacaaggtcatggttgcttttaaactttgcttgccaaaatacctggagggaactcaatgtgcatactcaagtttctgctgtggcaaattgactgttgctaccccaggagaccctaggaagacaatcagttcatgtctgactggagacattgcaactttatttgtatgaactatttgggtcaaatttcagggggacatgtcactacagaggggcagagggtcatgataatgaaaagaatcattacgttatattggtaattagatgtatgactctacaaacttgtttttccttgggtgttagtaacattctttttggagatagatggcattttacaaagtctatccacagaaaactggaagtatctaaagataatgataatgacgagaatatattcattgtaatctggcatacagaattttctctgccatttaagaagctg

SEQ ID NO: 115422 - DNA, 1235 bp, Homo sapiens
tcatatataaatgtgtgcatatatatgcatacccacacatacctatatccatgggtatattcagatatttgtatacattaaacctaggatttcacaatgataatccatcattgcagtgctcattctgttcttctccattttcgtatctgtaactctgtgagaagttacggtgagaagcctggctcccattattcacaatatattatatattgcataggattttcttacctgtggaatgtggtttcaaaaattactttcagaattacccactcacgcctctatggaaaaagagaagtaaggcaaagaaaagtatttcagtaagtagacttttagcattatttatgttttatatgcctaattctgtactcaaaattcacttggttagttcttttctcacagccacttccactcacttcacggttctgttacttattttaaatatggatcagttaatttgttttaatatataaatttgttttcatctagagttgaatcgattaatctggaatgatattttctgtttctatgtttaaaatatcaactaataatttcctttccttaataataagaaatctctagcaccatttaagactcagttaactgaggtgtaggtatccatgttttcctagagtatagagctgtgatctaaatcagaaaatctgaacaagtttgtcttggaccaaacttcaggataatctggaaacaacgggacaaatgttagtgcatgagtattttcaaacatagttctgagtaaattccaaatgcatatgtgggtttgtggctcttcatatctggttatttgtacatgatcacatctttattgtagataataaaagttgggtataaaagcaatgccattaattatgtattttttatgctttttgtttcaaaaaaggaattaagcaatcctaactttaaaaatggataaaatgcctatgtaaagctaagttagaaacacaaatgtaaaagtgtatttcgtacttggagttaagtttaggtcttaaaatattaatagcttcctcaaagatacagcaaatagagaaacctgataatatttatgtcttgagagaaaattatctttctataattaattataagacttttcattagggtctttgtgtaaagtaaagcaataatatgtttaatagtatttttatgtgagttacatacatgtacattattaatcatgaataaatagtgatgttcttatacttagtcttgttataagtcaaaat

SEQ ID NO: 115423 - DNA, 1093 bp, Homo sapiens
ttatcgtggtcagaaaatgcctttattttattcaagcagagatctggaaaggtaacagaatttcccacacatgctttccatctctgtttcaaatctttggcagaaaaaaaaaatctgttatttttaattagataaaatgctatgttaaataattgaagatttaatttcttactctgtcaatagaaggcagagtagtttaaaagacttgagaaaagaaaaacaattgtttgcttcctattagaaatcacaaaatcctctctgaagtaaacatacaaatctttgtttttctgctttcaaacagggaaaattttttcagtgcctaacaaacaggtgtttcatgattagattattaatgagaaataattttgtatcaaatagaaaaagtgacaaatggccctgcaagaccatgtgtgcataatattgtagaaggaattcctgttatgactaagagttgatgtagttaatttagtatgtctaaagttggctgtaatctatcaccacagaagagctggaagaaatgatcttaaatcacaaaggatttagtaaagacctacgtgagctgtgaaagatgattaaactatgaaatagttctcaaaaggaagttataaattccttgccacttgtgaaatctaaaaactacatagacagttatgttcgtattagaaaataaagatttatcctgccttggcacaatgtattgaattggcatgttgttctcagtaacaaagtcccaatttgcttcatcagctttaattccctatttactccatacatactctatactctatgtgttagtctgagtcttgcaagaagcccatgccaaaatgggattagaaatgcaagaattttaggaaatgcccttgtagaggaatataaggagggagccagttaaggctgagggaaacgtcaaagcatgatccaagtttgactctgagtaaagaagggagagagaattggtgagagcatccttgattgggctagccaaaggcatatgggagtcctcaagccaaaatcagccatcagaggaatcctgtttcccaggaatgtgtctgccacaacatgccctctgtgctcagtaaataccaggaagcag

SEQ ID NO: 115424 - DNA, 1037 bp, Homo sapiens
tgttatgttgattatatatagtatgtatgtgaatgtgcataactatatggattcatatatgcacatatatacacattcatttatactcatgaaaatggtaaaaatccagctaatgatttaaacattgggtcaatagcaatatataaaaataatattaaacattcagatctttgcaaaatctaaatgggcttgtttttaattttcatgtggacatttgaaattttatagataagactaacaatatgttttactgtactgtgagaatttaagattaatgaaatattatgttattaatttcttacatttgtaaagttgtttttcacaataccgtggcctattagattgctaagaaattatgtatgtcaactctttctttatacaaatattgaaaatgatagtaagattaaggaacttgcccaggtcacaatttttttctttcaaatttcatggctgatttctaggcaaaaatttcaggggcctgtccaatacgcatgaattaccctactataaacaaagctagggaatttaatacataccgaaaggcattttgtaatatatcagaaactatacaaaaccaagaatagtcataaaataacattttaacatttttaaaaaaagattattccaaatgccctcacttccaggaatgcgactttaaaagcctaggctttatgttatgtcatcaaagtcattgtactcaattagacaatagtgctataattaattaaatgttattatgtaaatgcagaattaccaaagagaatttcaaagagtataacagtattaagtcgtttccttagtaatttctcattgctgtgaaaaacatctgtaacctaatacatttatattcatttttcatattatattatgcacatattatttttaaatatttgttaacaggtaattttctgattaccaaagtaatacttttgtattaaatgtttgaagactgcctccaaaaattgcaaagaagaaaattttaaaaccgttataatcctacctttgaaataattattcttcaaatgttagatatttgg

SEQ ID NO: 115425 - DNA, 1866 bp, Homo sapiens
ctcaggccagtagttacaaattcaaagtcatcatggttgtgtttttcctcaactatcattgactgcttaggccacaacaagcacggtttgaaaaaggttggtttaacagagatgagatatttcagtgaagtctgagttttaaaaggatatgcaaagaagtgattatgctgccatatttactctaagctcactaaggaaaaggggacataagtttggtgagggtcagaacaacttctaaggtcaatgcactggaggactcattgggtttggaagatttttggagtcagaatactggaggggatgagctagaaagagagaaggtagggagagacgcttaacagtggttatggggcaccgttatctgtcatggcaaggccttgcttatggtaaggaaaggaggtttcaggtaagattatctgaagggagatccagaaactgggagaccgtgggaggaaaagataattatgagttatgtaagagtttgcgctggagagagacagggctaaaatgtttaaagactgagaggagagacctttaggtcagtagaaaactggattaggaggggagcagattaatgatgtgagttacaaagacattttagggcaaggaagagatcatggtctggaagcagcagagaagaatgagaaagactcctacttcactaggggcagaggtacaaacatgtggaaggaaaaatagccactgcatcagagggctgaagtaaatccgtattctcggtgggcagccagtagtgtcagagcaagatggtgcaggaaagtcagagaacatgctgaagatacaggagcataaggagattttgctgatgacagactgaacgctaggagtcacgctggcgagtttgcaggaattggggaaggctggggatttcaaagtaggggatttacagagccatctggtgatgagcaatgacctggcagtcttggactttgtgtggtgacggttgtgtattcaagacaaggaccttggttttaagaccatgtagtcagacaagcacaaactcctctgctgggatggccggtttctttggtctatttaattagttccagaaacagtaattcatcctcactgcatttatagaaattgaggggagaggtggtgggtaccagactggccaggtctgcccagtcatcttcacttcaacattcctgtctggtaaagtcatattattctcacatcttggccgtgtgtgtatgctccaagaatgagacagatgacagaagatacagaaaaacaattgggaaattgctagtttgcagatgtatagccctggcacagattttctaatatgaaattgccattttttccatgatttggacacaaaatcctgttcttgaatatgatgttcagcctagatattgaagaactgaaaaatatttttgaaaaaatatatatattgcatttgtcacaacagtttatacacataattatcacaatgatattgcttttcttaaataaataggttttatgtgttggcatgaaatacttttacaagatgatgccaggttttaacatttatacaggaatattttcattatcataattgttaataaaacaaatatgaaatgtatagctttctctttggagtttgaattgttggttcttactgcctgcttgcatatttatattagttgtactggctggcagttattaggaaatacgatcttctgtgtcttaggagtgcgccctgcaagcaacatgtgcaaacatttttttctttctttctttttttttgccctaaggaaaagggtaagctctggcaccttttaacctgtaaggattatgtggctcttgctgtgattgattggttggcttctcctcaagaaatgctcctggtgcgtattttat

SEQ ID NO: 115426 - DNA, 1673 bp, Homo sapiens
ggaggttaagaacatccctggccactgcccactagatgacattaatttccaccatgaggtgaaaattcaaaatgtctccaagcactgccagttttcccttgtaggggacgagggattgttttcagttaagaactactgccctagggagtaaattttgtgaaggggagaaccagttctacctcattcacaggtgtatccctagcacctagcacagtcttgtgatatacaaagaggttcaggaatctattgcatagtccaactctgctactcactgtgggatcctagggttatttaaattccacaaatcacaattaagttcatctgtaagtggaactattactaattcatacatgtttcataaaattatttagaagttcaaatgatatatttaacaaaaagacctcttgaaagacagtagtactttcaaataaaaggtaaacatacaattgatagaacactgaaggtgatctgagcctattgaaatctagaagcttaatttgactcacatactctgtctacactgtacaaattactatatgggatgttattggggcattgtctttgttctcaaggattatgacctaacaggtgttagaatatgattactcaaccataaaacaatagttgccataactaagcataaagagtggttggaatttatgggagggagacattgtatctggtactaggaatcacttaagacctcatgagtgagatgaaatagtcacagagaagtcccaggcaccctactgagcattgtcttagatgatctcattgaatattcactgcaacttgattaggtttaggttttattatcacatttcacaaagagagaggggcctaggaaggaatttgatatgaatgtgaagcatgggagatttcagcagggagagaactgcagtgaagtgtggaaggaggggaagtgacaggaggtgttttctcaccaagggaatagtgtgaacaaatatggggattacatggggtttaggtgagtttgagtgcctctagggaaggtaggttggaatcagattttgaaggattgctaacatctctctctctcttgctctcgcttgctcgctcgctcgctctcacatcacacacacacacacacacacacacacacacacacaccagggatttatatgtataaaagaaacatgatgatgttatctttcctaacagcttcactccacataacaggaagtgacattttgagttcttaccccatgctaagcttgctaagccacaagtatgtgcactgaacactttcaatagttggactttgagactcagttcaattagaccaatctataccatctttcagctagctactgctcttctacttttcccaagataatccttctgaaatagatacacaatgctgttttcattcaaatcagatgtgttaattctactagtggcacttgtgttctgatgcatagaacagaggcattatttacgtgaggactgtgccttccttcttactgaattgcaaaagtatacaattcttagaacacatctagcagttctgaggggctggacacagaaaaccatcttactctgaaggtaattttctctattttatcactagctcaccaaggtgagagtcaggagtgaaatatcctattttcttttcatccattcaaaaaatagtttgagtgtttcctgtgtac

SEQ ID NO: 115427 - DNA, 1049 bp, Homo sapiens
ggaatgatggccggctagttcaagtcactaagcaacagaacagcaaactgcttggtaacaagatctggcctgactcacaggctctctttgagtgacctaggtggccagatagaggaggaccaagacccatcttacctcaaaacaatatccttccatttccactttgccagccttcatgccaaattccacattatagaatagtctctttgacttgagatatttccttttagaatggaaatatctctgggactagaagctaatattgttgtctttcttctcagaaatagtgtttcagagattgttttctgtgattcaatatattatttaaaaagtgtaagctttaataagagcaaacaaagtggaaacatttgagttggtggtctgacttttggttttcgtaagcaaatgtatacagggccaaaactacctaccttcattgggtgcaatctttctttccttgggctctcagactgaatgtgttgacatttatttgtcattttctatgttatgctgtcttctagttcatgtttgtatttcaagtatgtagctggactgtaagttcctaaaaagtaagaaccggccgggtgcggtagttcatgcctgtaatcccagcactttgggaggctgaggcacgtggatcacttgaggtcaggagttttagaccagcctgttcaacatggtgaaacctcgtctctactaaaaatataaaaattagctgggcatggtggtgcatgcctgtaatccgagctactcgggaggctgaggcaggagaatcgctggaacctaggaggcggaggttgctttgagccgagattgcaccattgcacaacagaggagataccatttcaaaaaaaaaaaaaaaaaagtaagaacctccacattcatcaatcattgtatccactgtgaaggtacaagtgccacctgtataatatacattcaataaatagttgttttttgatcgattgagaaacataccttctgttgctgtgtcttttatgctgaacacccagggggatccatacccttccagactagaagtcctggtgatg

SEQ ID NO: 115428 - DNA, 1084 bp, Homo sapiens
taaaagccatgtcacacccaaagacatgaccaacctcaaaaatttggttttaagtagctagatctctgactgggaaagtgttattgtccccaggattttaacacctagatggcatttctgagtttggtagatgtaatggccataagaggagtgagacaaacattgactttttctgtcttaaagcagttattgggaaatgatggcttctctttgaggaagattttctttttggaaaaaattgtgagcaacaaacagtgaataaaagaaaggcatgaataaacactgggagatgcactgaaggagaaggttggctcaaggccaggcatcgggtgccagagcaggagagctggcatgagttcctacggagccaggaccagaatttccgtgtccagtgtcccttttggttgcgctgctttatcactgcagttcctaaattgcacccattgctgaatgagtggccctcaactcagctgtttgatttcagtctgagtggagcaacctagagttcagctggaggttatctgaactatttagacatgtcgggatgtaaggaaggcaggaaatcccatgaaaataggctttcttctgacatttctggcacttccttttctggtgctgtttggaaaaacttcatgagcacaatttctatcaatatttcattttagtgtatcaggtcacagcccagtaagaaaagcataaagagagcaatggaaaccagaaataaaaatcatggtatcgattttcagtaactcagaaggaagcagtttcccctatggactaaaactatcaggcaagggagttggaaagagtatctcaagttttccatattggttgaatgagccccaagacgttcataatatccacaggcatcttttgacaaaaatctcatttgtgctttcacagtttgtgctaagcactatggagaattttgaaaatatgtttcaaattgttctgacataaatataaatatatttgtatctaatttgttgctagtacagtgttctgcctcacagtttcctgctcctggtattcccctccattcgctatgcatacacttaatacctactgagtctaacatgtttat

SEQ ID NO: 115429 - DNA, 1036 bp, Homo sapiens
ggatttatggccaagtgatctcccttaaccataaatcccacaaatgtccaagtcagggcaagaatcctggagactggtactaggagtggttgaggtgggtggttctcaaagttcaattcctattgcaagttcctacaagaaaattggatgccagatgtcaaataagaatgcagttttattcccatacgtacgtagtggcgtttctttgattccttaaaccaatttccctgccagcttccccaacagctgaggaaagaaaggaccagaaatgaggggaggaaaatcatagtttgctctgttttctgcatgatccccacttggacagagacacatacagtgtgtgtgtaatggtggtgtgtcttcataaagcccttcctcactcctgactttgatatacagtattcataatcttaaacatgcctttccaaaggaaagaagaaagggattaggaattctacgcagaaagttgcaggctggtacttggtagtattgttgtgttctttgaatttggattgttagaacattttgccaatctttttattttctttgtgaatatttttatcttctttataatgggtgaatttgtttcatgcatatgcttccatgtatttttctggaggattcctcatcttttcctgctcttggaaaaaaaaaaaagaagaaaaacccaaatattaaaacagaccatcatgtgagcttatttggagtatttggagtttctgcctgagtagaggccattccaaactctgatcagtgagtccaagtactagggtctatgttacacacttagataatttcaggtagtagtaggttctatacattacatctacattttgataagatgagtataaattatgataaagaaaacataacaaaaaagaatgagtgtgttagttgagaaactgtatgactaaataattttttacagttttgccataactaactaaacagtatgtacgttagcaatgggagggaaaaaaaaagcagaaacaaggcttttaggaggaaagcagcaaaaagtaaaaggaattaaaac

SEQ ID NO: 115430 - DNA, 1034 bp, Homo sapiens
actgggttgtttaaaagcatgcccagatactgctgggtgcggtggctcacgcctgtaatcccagcactttgggaggccaaggtgggcagatcatgaggtcaggagatcgagaccattgtggctaacacggtgaaaccctgtctctactaaaaatacaaaaaattagccgggcgtggtggtgggggcgtgtaatcccagctactcgggaggtgaggcaggagaatggcgtcaaccccggaggcggagcttgcagttagccgagatggcgccactgcactacagactgggcgacagagcgagactccgtctcaaaacaacaaacaaacaaacgaacaaaaacaaaaaaaaagcatgcccagatacaatcctaaagtatgcccagatacaatcctaatgcaaaattttatcagatggaaaagtatcaaaagctggaataaatagaaaaaggagttcatgaaatgtattcaaagaaattttaaaaatagctcaggtacagaatctgttaaagcaacaaagcagacacatgactcttcttaatcttccacacttgactccacggcattaagttaacacttccttagtctcctctgagttgagacaaatttcctgaaaggaaggttgacattccctggacactttaaggatctgtttgtgcctcatgggtataggttgtaaaagttctttgcatagatatgtcagcattttagtgcattgtttggctccaagtgacctttcctccctgcatttcctcatttgccattcatcttcttgcttcccttcgtctgccataatagtccctggggtatagtataagtgcttctagggcactcctctaactgcacggttattgttactgcacaattaaaggacttagatattgaaaaatggtagtgtttggaattctgcaatctcattccttaggggcagggaacaattggaacacctaaaaaagggtcagagtccagaaccagattcaggagagagttcagctttcaattgggttggtccatttttcagtgctgcccgcacgagct

SEQ ID NO: 115431 - DNA, 1260 bp, Homo sapiens
agtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatgccatacctcgtgtttcttttttggcatttatttagatcagttagagagcatcctcaaatgcctttgccaatggtcttcatcagtcatttatttctatgagaaaatgaaaagtaagatttgggcttttgtactgactggtctttaggtgagcactttgccaattttttagcattgctttgtccttttgtaaaattgtggtgcacttggattatggagcatctgaaagtcttcctctgagcgcaattacccagaaagctg

SEQ ID NO: 115432 - DNA, 1004 bp, Homo sapiens
aaataataatattttgaagttatggaaatacttttacttttcaatatagagtttcccccaatcaaattttgaggactaacatggcattgctacggtacaaggagatatcctgtatttgatctaaactaattcttataatttatttgaaaatatgctatattctttcactactaatccttttgcctcagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcaggtaaaaggatattctttataagccattttttctcctccctactgtttttatgtttttttttttattttaataggcttcatgtaaatctcatcttctgagccatagcagttttctaagtatattagttcatacattctagaagtctcactgatttacacacttgtggtcagtatcctagatctttattcttcagtgtaaatctgttaccattgccaaactcttcatttttggagctattctctaatatttgtcctttgttttggtatgtggcatgatgtgaattagcagagcatctgctttaatctcagagaagctatcagtgagggtggatttcttttcatgttttcaaaaggcaaatcagatggaattcacaggtgtaaaatgtttagagtttaaaagccgttggttttagatagccactatcaaattagtttcttgcctcaggtatcagtacaagtttttagttcctcttatgttagggaacacagcttagggttccagcgaatcgtttttaactcacaatatgttacttttgactattcataaaggttgatccatgatcaggtgagtggtttttgtttttaaagactgaactctacatagttggattcagggaacaccgtacatgtg

SEQ ID NO: 115433 - DNA, 6789 bp, Homo sapiens
ttcttaagggaaaacaatttttttttgttttgtttttttgcagagagtgcctagtttgtgtgcttgaccagacagagggcttttgcccatgttagtccaaagttcttgccaatggtgctatctgctctcagagcccagggcttatggccggagtttttttttttttttttctcttgagatggagtttcgctcttgttgcccaggctggagtgcaatggcgcaatctcagctcaccgcaacctccatcttctgggttcaagtgattcttttgcctcagcctcctgagtagctgggattacaggcatgcaccaccatgcccagctaattttgtattggctggagcttttaaagatgcagatgggccaaggtaaggatgttgaattacctcaaaacataatgactgttgctgcctaccaagattgtcagaataaagtggagttaggtactcattaaaggtggaaatttagggaaatgcctaggtattacctggctgtaactaaatacacaagctatttatttatttatttttatatttatttatttatttatttatttatttttttgagacagagtctcactgtgttgcccaggctggagtgcagtggcatgatctcggctcactgcaagctccctctcctgggttcacaccattctcctgcctcagcctctcgagtagctgggactacaggcacccaccaccatgcccagctaattttttgtatttttagtagaggcggggtttcaccgtgttagccaggatggtctcgatctcctaatctcgtgatccgcccgcctcggcctcccaaaatgctgggattacaggcatgagccactgtgcccggcctatttgtttttattttttaagagcatttggaatgatttatttccaagattcacgattgcagataatgtatggtcagcaagtggttgcaaaggaagtctgctgtatgtgtctgacttggaaggaaaaaacactgataagacagtgggttctttggcttcctcattcagaccatgcatgccagtgcttctgtttcctccttcttggcccttgcttggtgtctaggcagattaaattcttagaagggtactggtcacccagagattgcagatgtgcaaaagttggcttttaaagtttagcgtcccataattggatttttcactgctgcagactctactgcatgccactctctgccatttgcctatacctgtccatggttgcctcttctgcattttccttggtagtagctttaagtctctgtctcacacacccaacattgtgcttcctggatttgtgggtataatttgcgaatgtaaaggggtgccctgtactatctatttctgaggcatagtttcaaataaaatggtattttatagcctgcattaatgtgaaattactttcaattaggattctgagtaatttacacataatgtttgtaaagtgaaggaaaaatgtcaagcatttcactaacaaatgaaagcaaagctcacaagtctctgccagaaatgaattccaagaacactttctttatcatttctcttttcagctcacaaatctacaggctggtgatttagcctgggcagctcttcaggtctcagctgggctcactcccaggactgcaggctattggtaggggcctcccaggtctggaggttggctggggtgactcagttctgctccacatgtctccctccagcaggccaaccctggcatgttctcacggtgaaggcagagcttctattggagtacttgcctacagctactcttttttcccaagcctccagcatagctttcttgtgtgcttcccaagtctacttcacagtttctccacaagaatccagtcattttacatggagtagagagagagtcttgcagatcctctccttggccagaggaagtcaccagagtaaggaaggagagaagaggcaaggaaggcagcagggccagctcctcttgttaaagtgtgaacactaactgaacagtacctaccatagagaaggcaggagagtaacttcaggggtaaggagtccaggctctagagagaagcagacatggattccagtcctggcttctgcactcactgtgggcaagttatcccctagcctcagattcttcagaagtgaaatggcataatgctattaactattgccttaaggcctttgtgaagttcagatacacacaaagagcttggcacagcagctggcacacagcaggcactcaaggaaatgattgtggtagtacttaggtgagggcataatgcaggttttaaaaggaatctcccagcctgtggcttattctgctggcgtcaggacaaggacagggacagacatttcccctgacttctcttcacttccagaagtccactggcaacttgcctcagtctcctgtccccaacaccaccacagccacctaaaatcccagacctggatgctgcattatccccacagctgtggaggtctccattccccaggctggcttatataaagtggtaccagggacccagcctagagggacccctgctagtttgccagtggtccctggtggtcacatgtccaaggccctgggtgctgagcacttcggaggccatgggcccttgaagcaaggcctgtgctgggcactgcagaaggcagaggccaggtcggagtagccactgctgtccagctttggtcttgtgggggcagatgcacccatggctcttaggcaggagctggatattctgggcaaagttccgtgtggccgctgggcctgacttcgcagagggggcgctctggccagatgggtggaggttgcaggatttggggctgagtgggaccaggctccaatcaaggcaggtggcctggcttgctgctcagtttgcagcagccgcctttccccagcgtgcctgtggtggtggcatcaatgatcctagcacctgggatgatgcctggcagccgatttggggtgaggagtggcttccaggacacgggcatggagtgctccagccaagcattgccatcgccgtggccctgtgtgctctgagtggcctgggctgccccgacagatggccttttagtgcccctggtgccccaggttcaggcagagggcacagtgcccaggcatgcagtctcatagtgaattaatgaaacagcaacaaaatagacaaattgttccactggtcctttatataggttatttccaacagctttggagagtgagggtgtctcttcatcctcatcagcacaggacatcattcatgttgaacagttttgacattacgtacaccaggaatgggtttagtgtatggggagattcccaggatagccagaatggttagaaaaatggcaaagttcagatagtgtgccccacttattaacttaggacagccactagccaccaaccagttttctgttctgtggatgaactctgtgatcctatgaataaggctgaccacaatttcagtgagaccctagaaccctgtgttgattgactattttatagtagatggcaaggaggaaaatagctataattggaggccctgtactgagcaatttattctatgtaatagaagagtggcccatttggagatatctgtgctaataggacccatatgatgcaaatgagacttatcaggatgagaaataacctggagagtcctcctcatcacttatcctttccagaatccacttgctttccctggcagttgatgatatattgccagtgccttcttccttttcagatctggtttccacatggtccttgcagggagctggagagtcctccccatcacttatgctctccagaatccactctgggtcacatgaagttgacaacgtgtgggaacatgtcatttccctgagaagaaatcttcctcatttctgctgagaagatcctcaggagcagctgatgagtcttcgtcgttacagctgccctcatagatgatgtccaggggctaatcatattcattgattcttgaggctgccattgtctttcatgggaccttttccaatgcccagtaatgaggaagctgttccaatatttcctcaatgggaaggttttcacttgcttttgagtctaccttgacctcaaataaggtctcctcctctgacctgtcatctggaggctcctccaccaggtcttcagcctgagcttcaatgaattgttccccagggtgtattctgttatgtgaccagatgtggatttttttcacccactgcttggcgtgggcagcggatcttctggaccactgaagacacattctcatattctcaaggcaaaattctgaagaaatcataaaactgttcccaccacaaaatgttctttgtaggtggttcatgtctgatgcattcttctaacattatccacaatgtagaggtatttctggaggttcacaccctttcaataacaggagcacaatattctgctaggtacagatgtcttcagcagtaggagttcttgcgctcatttgtcttctgagaatattgttgaaaatttgaacatgtctttttgattctcaaagtcagcaagctgtggatcagctcctaagtgctaaagagcccacagttgcagagttcctgagtgggttgagtgcagtttcagtctgtggctggtttttatttgtgcttgcagaatttctttcatggcaaccagagttttggaaacttctaaaggcttttctgcttctttgttttgttttgttttggtttttggttagaaatgcctttctttccagaacagccatgcttttcagggcctgcacagtgcctgttgcagatgtgcaaggcatcccaagaggaagcaaagccctcactgcttggtggggccaggttgcctgctcttggtctccatgtcctccctttccccgtccaaggccgtcactggcttgggctgctccgttggtccttgcagccgtgccgagcgcacatctcctgatagctcctactctgggcaaggagctgactcggcagtggacaaattgaggcaaccaaataataaacacaaatggatagtcaacacattttttgaaagaacatctgaaagacaaaatggggaatggcgagtctgtctaataaaccattttgagaaaactggatattcatataaagaagtataaagaggactgttatgttgcacaatacacaaaaatcaactcaaaataaattaatgacctaaacttaatatcagaaatgatgaaacttttaaaagaaaacatagggtgaatgtatgtttagggaaactcaaatttatgttcacaggttgcaaaaagaaaaatatgagaaaaacatagaggaaaatgattctgccaataaagtgagttggaaataatttttctgttttcacaaaaatcattgctaacaaaagcaaaaacaagtgtgggactatagaaaactgatgagcttctgcataggaaagaaaagaatgaaccaatacagaaggcatccagtagattgggacaaaattatgggggattatatatctgaaagggttgttatctaacatgtataagaaattaccactactaagtaggaaaaacaacaacacaaaacaacaaataaccagatggaaattgggcaaagaacctgaatagatgtttctgaatagaagacatgaatttgactaccaggtaaaagaaaaggttctcaacatacctaatcatcaagaaaatgtacattaaaactcactgagatatcttctccactctaattggaattaatgttacaaaaaagaaacaaattttttacaatgaaatgatcagtgtggagttggatgaaggggtactattacactactacacagtgtagggtggaatttaagtcagtatacacactatgaaaaatagttggagtttgctcaaaaaataaaatacaactatcatttgctgtagtaatcccaccactgaatatacattttaagaaaatgaaatcagtatattgaagagatacgtgaaatcctacatttcttgacacattattcacagcactcaagatgtggaatcaacctacctgtccaggaacagatgaagagataaagaaaatgcagtgtgtatacacagtggaatgctcttcaccataaaaaattcacggaatcatgtcattgcagcaacatggtggacaatgtaagaaaagctccccggagaagctgtacagaagctgcctcctcagcagtcagggccaggtaccggagctgtttttaccccaggacagggccggccccaagtcatcccagagctgccatggcaccccctcagtcgggtcctgaggaatcctacacaagctacttatatcagtgatcactaggataatccatagaacttttgggaaagaagtttaagacctttctcccaccatttcagcaggataaattccaactggattagaaaatgaaatgttaataatgcaaataagtacatatttatatctgtatataaaatacagttgatatttgcctggtgtttaggtgtctaaaggactttctaagcataaaagcaaaaaaaagtcataaaaatgctatagcagtttgagactctatgcaggaaagggcatcatcacgtgcatggatgaatctgtatctaattttaaacaatttccaatggtgcctgtttccttttctttgaaaatctctggagaaatagttcctcttgctgtgtctttctttaggcaagaatttttactaattgatgtgtagtctgaatcctggctaagtataaaccttttattttttatacctgttcttagtgaaaatgaaactgtgactttttttttaattccttttgttggtcaaaaactacaattaactcttctgagtttcttctc

SEQ ID NO: 115434 - DNA, 1506 bp, Homo sapiens
ggattaggggaggtgctacacactttaaaataactagatcttgggagaactcacagttgcaacagtgtcaccaagggggatggtgctaagccattagaaactgcccccatgatccaatcacctcccaccatgccccacctcgaacactggagattacctttcaacatgagatttgggcggggatgcagatccaaaccataccagccacttactgcctttatgccactggcaaaataagagttttaaagattgtattaaaaataacttcttagatttcattctcattttctatttttataatgttctatagtaaaagtatctgttttggaaactttttcaaaaacaaattccaatttgtatcagttatatttacgatgtcactgctctattttatcacaattattcattttgatctcagctaggcatgaaagctgcttctaaattagtatcggagtcagctgccctctaatatatcatctttagtggcttcagggtggaaaaggatgggcagattgggggaatttattgcctttaggtatcagcaggaatgcactaatgcatatggatggtaatacattaaccttgcctcatccagtcctgttcaagtgaatatatttgagatatcttacatcgaaaactattttcttagatcctttcatagtggaagaagaaagaagaaggccttctagatacggaagaccacagtttatctgtttaacaaagtatctaacatagcaatcctgttagattctgtgggaaaaggtaaatatctacatatgtaggttggatcccagtggggctgacccatcctttaaaccttttacttactttgattggaataggatatcattaaagtattttaaagtaaataataagtctactttgcggagaagctaaaaattctacagtgttttcaatggaagtgatgttcagcttagttaataaacttcttttgaggtttcttcctttgcttgtggcacggttgggcttggtggcaaagctgtatgagagcagttagtcatcactgatacatgagataggacatctaaagattctttaaaaaagacttggcagttttggagatgaaagacttatttgttacttatattaaaaaaattatttaatttggcccagctgtctgacctgcaagtatgactccattgtagttgatcttcatttccaaaatagcaattccttgtagtgagatcagagctcagctgactcttgaatgtggtgattgagatagagtagcattctttactcacactccatacccaacctagagtctgttgagatgtgtagcatgcaataatttggcatattgaggaaaggagggaggcagataggaagcagaaaaggctacaggagcagggtagactgttttggaaaattgagtgacttgtaggctgtataatctgagaacccacactgttcatctgtaggccaaatatggcccacataaattcaccatgaaaacgtctgatttgacctgtgtttttaaaaaga

SEQ ID NO: 115435 - DNA, 1266 bp, Homo sapiens
aggatggtttggaaggagaagaacctgccatgtagagaaatgagaaagactgtttcagtaatttggatgttagatgagagggcctggaccagggtggtccctgtgaggatttttataggtatatgaaatccatttcataggcatgtgatttccatatcattgaatatcataggcactgtgaaggcattagttgttatagtatctcagaaacactaccattcttctgggaattttcacaagggttaacccaaagaagggattctaatgattaatggcttaacccaaacaaataattttgatggaaagagttctagttattttggctgactgataatagtgatatttggtctggagtgccttttgagtctcacagataccacaaggtagtagttcattttcatttcttttgtacggaactagcactacagatataggtgaaaattccctttaaattcgtgaattagtaaaccctaaaacatgggtttaactgaaattagttttgtttgattatagaatgaaactaaaataactcttaagcttaatgtggggaatcttagtagtagtatatggaacatgatcctatgattttgaatagccttttgaagatgaatgctattcattcattctatactatccttctgtatatgaatagtaaccattggtttgtgtgaagcccaaggttctctgagtttaactgttaacattttcattggtttttggttaaaatttggagcctctgagatgcagagtactatggtcttagcttggggaagtgcttttttttcttcctgctcaggcatttgaagtcaatgaaatttaaattacatccttgtctagggttgacaatgatgagatagagagtataaatgagaagttaaacttcccatttctgaactggcaaatcaaggttttagaagttcatcaggccaggtgcggtggctcacgcctgtaatcccggcactttgggaggtcgaggtgggtggatcacaaggtcaggagatggagaccatcctggctaacatggtgaaactccgtctctactaaaaatacaaaaaaaattagctgggcttggtggcgggcgcctgtagtcccagctacttgggaggctgaggcaggagaatggcatgaacccgagattgtgccactgcactccagcctgggtgacagagcaagactccgtctcaaaaaaaaaaaaaaaaagaagttgatcagctaggaatgaacataggaagctagtataaccaatctagtctgtaatatgttgta

SEQ ID NO: 115436 - DNA, 1026 bp, Homo sapiens
gagtggtaacttgccttgagatgttggttgttaagactagatttataaaagttgttgaaagctggggtatactattccctgaatttgtggagttgacaagctctcaaactaggaatgggagaggcccaccaaatgtttcctgtgaacataaggaagcacagtcagcttaagcattttatgcagctagtgcccagtcagcatttccccagtcacttgattaacacttcttttccggcttcttagctcagttttgtgtttttgggtctctgttaattagatcctcacatatgctgcttcttccagtgccccccgctcctcctcctctcctttctcaggcatcatggagttcctgttgtatgccaggcatggtgctaaacacttttgatgcatgcccctatctatagtttagttagaaagacaaacagataaattcgaatttattgtttcacatgctgcaatgtatgtgaattcattgttataggagggctgaggaattaactctgcttgaatcagtcagagaatagtttgctgtagaggtgacacttgagtcttgatgcatcaacaggtgtgtgtcagggaaggaagggagacaggttggtcagggtgatcaagggcgcgggaacccagtaaacaagttaggtattattacacaggcagttgtgggagataaggctgtgaaagaatttgccttttatctctgtgtcctcaacacccagcataatgcccagtatttattgacaaagaagttcaaaggttagtcagtgagttccctttcttactgtgaaggagttaaacaataatcaccctacctctgttccccagttaaggtcgctcagtcctccccatatcaggtgaactgcagttaagtataatgtgagcttagtatggaaggactataacaaacacaggtttagaatgaggcaggcctggggtctaatctcagctttcagttactaccattcatgtgatcttaagcaaaatgctgacactctctgaatctctgtgacctcatctacaaagtaagac

SEQ ID NO: 115437 - DNA, 1095 bp, Homo sapiens
tttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttct

SEQ ID NO: 115438 - DNA, 1057 bp, Homo sapiens
tacaaagcaaacacctctaccaatgatgttaggccaaatctgaagaagttgaaagggaaggacatcagactcaagaaactcagatgccttcttgtgtagtgattgtttgaaagtgctagttacttggcagcagtcagacactagcagagaccacttaagacccaacagaaggccaagtctcacaactttcattcgacacagtgcttgtttggggtagggtaaggtggagaattattcatcacaattccagtaaatagctcctggccacagagcgttacattagtcaaaaatgagtctgagcacaagagaatatgaggacactcactgacagtaggattttataaaacagaattagccatttctatgtcacgtgcccttattcatttggcaaaatctattgatttgttgttgttaactatttttctcattcgtgaaatatcttgtgcttttctgagtcttaattttcaagattttataacttaccaagttaacagtgtgattaagttatcttataagtcaagctagaggctagtctcagaaaagaatgttgcattttataatactatagtgtctaataattgttcttctcctttgtttcttttctttacacaatcagaatattattctgacaatgcctcataagcttttgtttttagaatttaattaattgtaaagttctaattttagctttaatagtaattaaaactagaaatttaaaatatggttcaatggcagaaaaggatataaccattatactgagagagaagatctcccagggggtatttggcatgtatgagaagaactgatcatattgtcagtgccctaaattaagccaacaatttcatatatgtgttaagttaaaatcagagcccttggcttttccttttcagatactgttttaaaagaagaccttcccaccatcagactgaaagaatgtcagtataatctttataatctttgaattacacttcagatttatcaacaataggctctttcttgtcacatcagccttggatcactttgtgggtgtgttggaattaaggcctgccagattgca

SEQ ID NO: 115439 - DNA, 1040 bp, Homo sapiens
atgactttatgaggcctgaagatgagctctaagtctaggatcagtttatcttctctgaaagtttgtgtatctcttgactttcttctccagggtttctgctttagctttgccacttcaagtgcagtccgttcctgaattatgttgtcagcataaaagggagctgctcctatgaaagttcttagagtcatttactgcttttgagtcttgtacatagaatattagtctttttcagtgatgttagcagtgtctctagaaggatggaaaacccgaaatgtctgcaactgcatcagggtttaaagtaatttacttatgcatttgccttcagtgggagtttgttgtcttgccagttattcatattaaatttttagcattttaaataatgtattactataagcttgactttatttgcatttatagattataaactcatttctgttttattttactgaagaacccattaaaagagccagtaaatcctgtggaaaatggccttcagtgatcttacatcgaggactgtgcatctttatgataattggatcaaagatgctggtgagtaaccacatttcctaattgaggttcatccttcctttttatgtcagattctcatatttaataggatttcactggaacagaatgagagactttgcaacttaacagtcccttattactagttaacgaagaggaagtgcacaggtttcattacagatatgtacaaagatggagctacacagatgttcattacaatgtttacagtaaggaaaatagcctagatatccagtgaagggaactgatcaataaatgatgactcattctaacttagtagccattaaaagtgattttggaaggacagtgctcttcagcctgattcttccctaatgctcctgagggaaattacagttaatgccaactcttttttttttttttaagacagagtctcactctgtcgcccaagctggagtgcagtggtgcaatctcggctcactgcaacctccgcctccctgcaacctccgcctccctggttcacgccattcttctgcctg

SEQ ID NO: 115440 - DNA, 1032 bp, Homo sapiens
ttcagcaacacttgaactggtctatgccttgttcaacaagcatcacatacttggatgtcacagcaatgtcaaattgctataaacatttctaaatgcttacacttgatttctggagttagctggtaccaatctagtaagaaaccatttgtgcgtcagcaccagtcacaggccactgtcctagagtgtttgctatagatgccatggtagaagaggggacagcttatgtcaggggctcagaagagactggacagtttgcctgggtggtttagctgtaaggggaacagaaagcatgttagaggaaggcagaattatgaaaagtgagctaggcttcccagccagccgaacaaggatttttagtcatgaagagaaactggagcatagatagagggggaaggaggagcacttgggcttgctgagttggaggatagaggggacatagtggaaaaggttgctgttaggcaagagatgaagctagagagtcacgtggggttgagatcattcgttcagcgaatactgtttggaagtcaaccatgtgccagaccctgcctaggaattggggttagaagtccagcagggacagttttgctctgctagagattagaagggtgctaagcgtcaccacagagttagactttttagtaactgtaggcagactttgaaggattttgaagtagagcatggtgtgactgctttaatccttgggaagatgactctggtggccttgtgtacagtggatggctgttcatttaggaaagttagttgaaaggtgatttcagtaatcttggccacacaaagacggaagtgaactaggcagtaattataattattactcaaatttaccgagaactttgtatagggcttaaagctacagcatactaaaaacagataattcactaggcagacaagagaacatcaacacaagacagacttatcagtagacaaacttattagttcacttccttctgtgtgtggccaagagatgataaagctcaggaagtagcagtcaggggttgaggggaggaagtggagttg

SEQ ID NO: 115441 - DNA, 1048 bp, Homo sapiens
taggctctggagaaggcttcctcccctttactaactcatctatttcacgcccttctttcccgttttccttctcggaggaggtatcacccttgctccagtggagggagaatgctgccttgcagggcttctgaccatccccctcattttctcctctagaccttcatgggttgttccttcttgtttctctctattacttcatcccctcactgtaaaaatactccaacagttatcaccttaagactaataaagcttgattttgcctctccttcttctcttctagacttcaccaccaggcttcgtgaacaagacctgttcaatgcctgctattaatcacctgcctttgcattttggcttcagccttatcattgcttaatttcttcttccttccagtcacagaggcttccaggttggctgaatttgctgaagaccattccactctatgcactgaacctctctgatgcatttgaccctattcatccctgcctccctcttcagaatttttcccacttttgttttcatgatcctgcacgtactgagttctcctcatgtctttttgactctttctttttttgtctcctttgtgagattccatcttttggccttccccttaagtgatggtattctccaggcgtttgtctttagaccactattgttctcatgcatctattactgtggttttcatcaccaactagatgtgaagttccaaaagctgtatccttagccttgaccttcctcccaagtgcctgctaaacatctccacctgaatgtcccctgggcttgtcacattgggatttactttaccaaactatctctgcccttgttcaggcctataatgatttctcattgggatgatggaattaaaccccactcggtcttcttgctcttaggctcacccatcacattcatcctttgcatagctgatttgcctatagctaaagcttgcactaaggggattcttctggtacaggcttggggttttcagtgggtagcactctggtgacctgtgtggttgagctcttttacatatcgagcttatgaataatatttc

SEQ ID NO: 115442 - DNA, 1036 bp, Homo sapiens
gatttatagacaactgggttcatgtgttcattaatatttttcatggtaaatataaaagatagagggatttatgatatagacagattttctgtacttgacatgcaaaaatcttccatgtaatgagaaaattcactcattttttgactatattaataatatatgctgactttagaaatatagagaacttctaacagaaaataacaaataaaaaaacttataacatcaaagaaaacagatatcccttataatcttaccaaccagaaataacaattgctaacattttgataaactgctttgcggcttcttgtagccttttaaaaaaggttgttaaagtttttctctaggaaaagaattgggaaatatttagatgaggaacaagaaccatctcctagtatgctttttttttgaaagctctaaacataaaatataaacctttccaacatgaacattttatttctttcttaaaaaactcttattatagaaatttctaaacatttataaaagtagaatgatgtaatgaactgatatactcatcactcagaattatggctaatcttatttcatctgtaaatattccagtatacctctaaaaataaggactttaaaaaattacagccataccattatcatgcctaagaagttaaaaataataacttaatgtcatcaaatagccaatcaatctgaacatttttaaaaaccaccactttgttatgactaaaagtagtgagagattcttgggtaataggatgatacggagtctaagtagcaaattatataaatatcacaagaaaagttttaaaacaatacgagtaacttatttagctgtgcttattgcttatagataactattaatacattagtaaacaatctgtcattttatattttaataactttgctatttctttattctcatggtttaaattcaaaatgcagtgttcacctatgcctaatgatttttttaaaactctcctatgcatttttgggcttagcgcagggaaaaagtatgatctggatacataaaagtcagcagtgtgac

SEQ ID NO: 115443 - DNA, 1014 bp, Homo sapiens
aaaagtattaaattcagggaagaaaactaacgaagtttaatcataaacattttttcttctttgcaaagaatatgtgtgtagttcttaatgtgctacctagaatcactgttgtaaacctcctgggtgcttagaattattacaaatcatttattataatacaaatttttctatcttgctagctctatcagcaacatcctcagatacagaaggcatacttcttttgctgccatgtggcttcttgttttttgtttttattaaaagtaatcacaaaaactgcaattacttttgcaccaacctaataattagacaattaaaatttcaaaggaagggggtaaaattaaagaactatgttgcgacctctcttagttctctgtgtgtaggacttttcaggtgcccaatgtcctcttgactgaccactcctcatgaagatactggtaaactttgtgctagtggattgataaccgctctccgagttcatgctcttctgaggtctagaaagaaatgggtgtctctgtcccaacctggttagttattctgtctctaaaaacacaattaagtcaatgttaagactaagttcattaagctgctcgtgtttttatgccttgacagtttgttaatggtggttgcataagttttacagaactagtttcgtcttgttgcccaggctggagggcaatggtgtgacctcagctcaccgcaacctccgcctcctgggttcaagcgattctcctgcctcagcctcccaagtagctgggattacaggcatgcgccaccatgcctggcttattttgtatttttagtagagacagggtttctccatgttggtctggctggtctcgaactcctgacctcaggtgatctgcccgccttgacctcccaaagtgcagggattacaggcatgagccaccgcggccagcctgtagtcagctctttaaggcaacaatttattggctcaggtgactggcacaagccagttttcttttgttcatttcatccattgtggcaaggattagc

SEQ ID NO: 115444 - DNA, 1025 bp, Homo sapiens
ttggataaagtctggtgttgtctgtttcaaatgaagttacattatcttatattgtatatgggttgtttcttatttttgttctgaaattaacagttatacattttcttccaaaataatgtaattgctatttatctgatatatttcataactttattgtgagcctaaaattatgaagtagaaaaaacagaatcttcctttttctttatcttttttttttttagactacaacaaaatcacaattaaatccggcctttgaagatgcctggagcagcagtgatgaagaaggatgaatatcatctttagtacctttttgtctctgctgaaactttttaaatgagactgtgtttttttcaactgtatggtctattcctgacagctaaattagccctaaatgtgggtaatatttttcctcatgttttaaaatgaggttaatatttgcataaaatcctaaaacagacttctgtatagtttatttagtcaaaatgtgttccttgatcccagatgttgtggcctgggaaagccctcattgctacagtacaagtaacacaagtcgttgtacctcagttgtgaccttcagcagattttatgaactataagatgcagtctcagaggatcagcaagtggaggccatcagtattgactttctcttacttgctgtactatcagcctgctcgtttccacctttaagaatgattttgccaagaatgattatatcaaaaatagtagttgaaatggtaacatcaaaattattttattctttcttcttcatgtattcacatttttcagtggtttcatttaattaaccatgctttatgttaaacattttggggctcaatgtctcctactatccaaaatgtgcatcacaggaggcttttaactttgtgaaaatcccatgtttgctttattttattttaatgtcagaaggcagtttgcgctaatgcttgaactctttttctgtgaaactcattaaggtatgaccaaatcctgcctcattaattcaagcagaaaatatcctggcagggaat

SEQ ID NO: 115445 - DNA, 1157 bp, Homo sapiens
tctgtctctagaagcctttaacttgcctttgataactaccaaaaatagccctgggaaaacacacacacacacacacacacacacacacacacatgtctgtaggtggataagccacatgagggccatgcttcctaatcctactatggaagcccagtgtgtaacctattaaaaattttaatttcagttgaaaactcaacagaaaagcaaaattatacttcatcataaattatttttgtatggtaagcaaagaaacaaaaataaatgaaaatcataatcagttgcatacaaattatttcacttttcagtgaaataatgatatatgaatgcattacagtattttagaaatacattttattgccaaaacaatcacaaataaatattatactggtagtatgataaagcagcagtaaaaatgttgtagatggatgtggtacacattaccatttgagacccactgatcaagtgtcactactattatttcagttttctctgcaacatctcctcctagtggacatgcagtctgtgcttgaacatattcatctatatctcaccaggttgtcaattctactgacagatagtgtcaatgttatagaaataatgaagcatgagtttagaggggacctagttatgagtttagagaaggaatagaaccaaacttaacatctacaaggatatttcttgataactttcaaatttctgactggtaattagtggcaactctcaggttgtcagcaagtgattatacattgacacaagtgatatgtaaaacagttatgtattgtgtgaatgtcaaaacaaagtaagattcttagtgagaggtcaggtttaaactggaataaacctgccctatagatctcaggcaggaaaaagtaattaggagttatagataggcttgtcttgaccagaccagcttttagaaaggagggtcaaaaggaagccagattcctcaaaatataataaaacagtctgccaactaaataaaaggatttatagttaaagaccataaatcctgtccctatcatccagtgttcttcctttctttagatagaattaaattcatcttctactttggatatcaggagaaacacccctaagggattacatcttgattgatggggaggtaactctcatctgaagaatgcatttgaaaggaaacc

SEQ ID NO: 115446 - DNA, 1049 bp, Homo sapiens
tgaatctgttactagtgattggaagtatatcattaacttggaaaaactaagctattaaaatacaatgatttgatgtgataaaatggaatagaactgtacatacatacatacacatttaccaatacaaatttcctgggtttgatactgtgttttagttacctcacacataatcgttggggaaacttagtgaagggtacacggttctctttatactagctttgcaactgcttgcaaatctataattatttcagaataaaaaataaatgtaataatagaggtctcttactactaaaatataactgtagttaaaataacttttctaaatgtaaacattaaaaatgacaatgtaattttggcatatatcttcatatttctgcatggatacagtgaaaatgtcatgattactaatgataatgtcttgtttccttttgatgatgacttatgataaaattatcttaaaccggttctgtttttacagttggtactagaggacccaaagtacaactttgtgacttgaagtctggatcctgttctcacattctacagggtatttttattttatttcaaacggcaactactttgagtaaacgattcaataaaaagaaacgttactaacagtgtattctttgtaagtgacatgactaatgtactttgtgctggttgttgagactcagcagggaaataaagatccttctgtgcattattcttataaaactgaaccattgaaaacacatttatatgaacaatgatcattggggaagctcaaacaatatgaaaaatagttctaactcaaaaccttgtgttatttctacattaaaaagactaatgcaactcacatcagtgtacttgtctcatatgtattatttaatattctggctaatgagtaaacattgttcttaatatttaggtacattttttctcagtaaaaatattttagaaaaatatattgaagtaattctttggtaaaggtgtatttaaattattcttgctacttttatcagtattagattgtctaattctaaacaatgaaaagatagaatataatttat

SEQ ID NO: 115447 - DNA, 1050 bp, Homo sapiens
ttaaatataaatgaaaataacagaacatatatagtaacataataaaatatcctattttaaaatttaaacttaaaatataagtgagcttttatttgttatcactacattaaaaatttgtttcatttaaaagtagtatcactggaaaaatctctgtagaagtcaatattcttaggagcaaaaggaaatcaatctgcttatcttaagcgaaatttattggaagaatatttagtatctcacataactgtcaggaagatgggagaatcagacttagaaaatgagcagaaaacaaaagaagtcaggatagagaacacagtcagggtcacaccacaggaacattagtttgggttttgctatatgtcaccaacgcagactctcaactcctcagctttgaataatggctaactctcctaggaaaagagaatgtctagagtcccttgctttctgtaagaagaggtagagctcttattttcagtaaaacaaagggcatttcctctaaataggagtttgaatgctcatcagccaagaaaaaaaggcacatgttccctacaatccacccatttggctgtccagcatgcgtatacacctttcttcccataattactgttttttaaaaaaatgttccagcctaacctaatgcaaatcttcactatacagccaaaaaggtgatcatcctcttccccaaagggtgatgatcctaagttgatttagttaccacacctggctccatttcaaggtcatgttcatttttccactagtttaatttatcctatatcagtattatacaatttgtggactcaatgatatagttaacctataaaaataataaaggtaagagaggaaagagaaaattagttaaaatatatgaatatttacagagaaaaaaaggaaatatgagtaggcactatagttcttgtatttttgcagctgttttaatgccagagctggcacttaagactttccttctttgtgttctcattccttcagatagcaccacaaatgttttaaggtcccaaaccttcatcttaaggaatccaaaagcatcacggttgt

SEQ ID NO: 115448 - DNA, 1040 bp, Homo sapiens
gtaaactctgcgaagacaggaaccatgcctgccttgttgacagttgttttagcagagtgtctaacattgtaggaacttaaagttgaatgaattgagtgaatgcattcataagagaaggaaggaatctaacatttattgagcccctattttttgccaggtactataaaaagaattttgcacttttattatcaacactgtgattcaggtaaaaatgtccccctcctttacaaatgttgagtcttagacaggtggtataacttgcccagagccaaatagcaagtgtcagtaatagttggtttgtctaattccttttttatttagcatagtcataattaggacatttaaaataactttgtaatattttactttcttaagaaatctcttttgccgtcttgtttctgtcaccctttctttttgaagttatggaagtaaacttgaaatgatcacagaatgaatttttttatattcattcttgtattaaatattaagaaattttagtttatgaagtctgtgttattgaggattaacttattataaattaatgtatccttaatacatttgagtgtttgcaaatcagtttttagaaatttgcaatcataaataaatggactaaataataaataaaatgataaattaatgtgaacttttttattatcagcatgttatcaggtggttcagatggtgtgattgtactttatgaccttgagaactccagcagacaatcttattacacatgtaaagcagtgtgttccattggcaggtatgtatttaaaatgtaaaaatttatgaatttgtaaatagttgagtattttttgcatcgaatgcaaaacatgaaaattgcagtcaagtgaatgggtcaagcgaatggttcacataacacatttgcatggctgttccttgacactttcttgaaaatagtaactgacattcaggtatagttttttaacatgtgtcttccccaaagcaacttcagtatcaattttcattagtattttatttttaaaaaacttgtgattatgtccttctttttctttacctac

SEQ ID NO: 115449 - DNA, 1042 bp, Homo sapiens
actaaaggaaacagtttttggtgttatggtatgtttagcatttcccccagaatttttattttatactgaaatattattattaatacattaagtcaagtcagaacagatttgataaacttccactttttacttccagcttccaccatggtctcatctactagtatatgagaaacatcttactttagcatgtggttaaatctaaaagatgagtaataattcttttctttttcctgaccttttccaggctcagtgtaacaccttctattcaaggacagctgggggggcactcacttatgaaacatgcagacatgagcagcaggagatagctgacttttgggtttggatgctggtcaggaaagtaatcaatactgttactccagccagccacttggtgtagtaatcagttgtgtggcctgtgatgtatgagaagccagtagactaccagttggcagagttggtgagaaatatgggaagttacagattatatgtgcatgaaatatatttgagaaatgcagatgaggcatcttttaatacagcacatagagaaaagtctgaagactcttgctacagtgattttccgctttattgcacggtaaaagtctacaactatttcattgtttgctaagacttgtattttgcattaaccccttttgatagcaacaagagatattaaaaggaaagcgtacattctgtggaaaactaaaaaaatcgatgtgtatataacttgttcaaaacacctgttaatatttaccatccaccatgagagctgtaaaggtgtcactgaaaatcagattggaaaccagacagaatacacaaatctggcagagattttcaaagtaaggtgttattttacaaaaagtatctgaaaattacagtttaacaggtgcaactgcagagggtgcatttgcgtatcactctgtgaagcttgaattttcttttataccttttaaattcttctaagttaatttcattcatctttaatactaagttttcttgtctatataaaaacatgaaaccatatctcttcatactctatcagcaa

SEQ ID NO: 115450 - DNA, 1042 bp, Homo sapiens
aaatatgaaacattttaacagaaatggaactaataatggatgagtgactaagctgggttatgtttctaagtgaggttgaaaatatttcatgtaagagaaaaagagttatttgtctccttttgttttgagggttttgtaattgctttatattaagaatagtagtgtcaataataacaataatgagaattagtatttcttaaatactgtgtataggcactatgcctagcatttgttgtgactcgctgtatttgttgaagaatataataaatgagggaaaataatatgtctagtgttgatttgtcaatatcacgtagctatgaaactcaatttgcattctttttgtgtaaaacccagtttctctgcatcagtgtaaatcacatgaaactattacttttcatactccctcacttttcaaagtactactcagttcagcagttcctttctgctgctgtttgaagactttgtaagtgtgacttactctgcaagagttgtaaaagtgagttgacaaggttgcttttgagatttttcaattgaattgggtttggtagagatagtatcttcagaactatatgtcagacttcactgtttgattgtttgaataaatttccattcttataaaatgaattggaaatgtacctgattttttttaaaattaggtttgttatttttacacttaaaaggctgtttttttgcttttatctttatttccgtttaggtgactggtgcctccatcttgtggtccaactcacaaattgcatcctttgctagagattgtgtttacactttttttcccctcagctgaataaatgacagaaaattattttctgttttatttattaaaaatataactccgattaagcatacattaccttcaaagaggacagaaagtgctcaaaagggaccacctaaagcaacctgttcaaggatgaagtcttgtaaaataaattattattgttgatggtagtggtgatggatgatggtggtggtagtggtggtggtggtggtgaatgagagagaggatgaagttcgatttgctctttat

SEQ ID NO: 115451 - DNA, 1030 bp, Homo sapiens
gaacccgggaggcggaggttgcagtgagccaagatcacaccgctgcactccagccaagtgacagagtgagactgcatcttaaaaaaaaaaaaatggagagactgacttataaacaaagagattgtcatttatttatttatttatttatttttgagacagagtcctgctctatagcccaggctggagtgcagtggcgcgatctcggctcactgcaacctgcgccttccaggttcaagtcattctcctgcctcagcttcccgagtagttggaactacaggcacgtgccaccatgcctggctaatttttgtatttttagtagaggcagggtttcaccatgttggtgaagctgggctcaaactcctgacctcgtgatccacctgccctggcctcccaaagtgctgagattacaggtgtgagccactgcacccagccaagattgccttttaaagatgaggtagagattctaatattgagtagatatctaaatgtcccctgatataagttacatagtgaagatttttatttaccttgaaactattgttttcctacacgtactaggaacttcagttactctgttaatgagtacacagtcagtgaggaattcttggatgtaaataagtctgcaacttgccttcccctcactggcaagatttttgaaaagggagtcaacctactgacttcatctctcatctagaattcatctttccataagtgttgtacattgtactgcatttcccatttggattataggcgattgcttgtatagctaggtccctgactctgtgttcttctggacattttctagattgtagcaggtattcagcaaaacttgttcatccatctgactgatatttattgtataccttgtaggccaggcacagttctaggcatttgagatactatattaataagcagaatactgaaaaatccgtggctttactgagcttacattgaagctgaaggaatcagatggttttaaaaactgtcatagttgttacagtgtggtaagtgtcaagagaaaagaaaaact

SEQ ID NO: 115452 - DNA, 1043 bp, Homo sapiens
acctttatctttactttcatcaaccatttgtggcacatattggctggttaatttagttaataagtgacagaacccgaatgtaaacatagatccttctcattccaaatcttatgtttgtttctttctattatctcttccatagaggcagatcattttaagctctgtagaagaaatattgactagggccttgaaggatgaggtttgcttttgtagcatccaaggctttttatgaactaaccgccttccttgtctgtcttatcagtttttcttcttttattatttattttcccaagtgtgtcttctatttgaggttcttaattcctgccgtttttgtctttgtacattatcatttctagggggcatgtaaatcttttactgtggtcttttctactaatccgtatctattattgttatcttcatagtttacagtgatttcctacatttttttaaaaaattgaaaatcgaaagacaacattctgatattttctacattttgtaaaaactctttaacagcgttttcagatcacagaatattttaggtgttataagttaaatgtattctgaagccaaataagttgagggaacaatttgttgaacagagttaaataggttatctaacaaaatgcagaacctattggagcatttaatttgctattgtgcactggaattctccaagagggaaagtagaggtataggggtatagtaggcaggatatggtatgtaacatctcctaatctcaccaaggaatcaaccccctccctcaagagcatctcaagagattaattcattggactgcccagatttatagcaatgatacttagaatactcttgacctgtgacatcagaattaaactaaatcaattaaatttaaagttactttttaaatttcaagattccttggacctaccagtcctactaaaacagaatctttgagaagtgaaataaaatgtcttgtagtttttctttttctatctctttagtaattgggctaattagagctctgttctcagctaattactagtcgtactgtacttcttcaagtc

SEQ ID NO: 115453 - DNA, 2599 bp, Homo sapiens
tgtggcatcattttcagtggtttcctttttcatttcatagcttctgaacctgtttcttcagcctcccaacaattatgtgagccatccaacatctccttttaggtttaaactaagcaaacgtttctattgcatgcagttaaaatcctctactgataacgttatcattggtcttccctggcaggttgtagatgctgtgagggctgtcttactcatcagtatatcctcagtgcctagcatctcgttatacccgaactcaatgcctggcacattaaataggtgtttagtatgttctcttttttaaaaaaaataaattagcagtccatgcctccaatatgaactttcttacctgctctagcatgcttctagctccattaatctactcatactgcttttgataagattactactggtaacctgtttgctgaattcagtgaatatttttcacaactcaattaacgtctttaaagctttgataatgctatttcttccttattctcattttaccattcacactgttttgttttgttttgttttttaggtttctcaaactattccttattatctgtcagctctcacatctttatgttcctccagatttctttcttcagctcacccatccctctggcttcagttgctgtatatgatgatgattttcagaccttatctccacccagacctctctcttgagctttaaatcagtgtatccaactgcctactcagtatttccaccaagatcttctacagaactctcaaattcaacattttttacatgtttaaaattaaatgaattttgttgtttcttcccaacagacaaatattgaagacatagctattacctaaatcatatggcttactctaattttcagccgattcactgaaattaagtaaatatgcatgtgtaaattcacaattaaaatttattctgttattttttccttttccaatctagtactttatgattttttaattagtgtacaattaaaactgcttataatttccaaaattctgcttagtgtcaagactttactattgaatatagacatgttgaataataatatatattagtatttcatgttgagtaaatgtaaattgtagaatacatttggatctatatttctctactttgaaaaatcatttaattaaattttaaacaattttattatttttgtttaatagaatttttagctttttctaactagaatgaatattttagctttcagaaaaatataaaacattttacaaagaaatggggcaaagtaaatgaaaaaatagtcaaacaaagtcacatttatttcttctatagtagtttcacctataatctcatttattcactttgacattttcaattaattgttttgaaaattgtaacaataatttggtttaatcaaatttgtatcttgcttgaactctctaagtagcaattgtgtgaatagcatgacagggcaatttcagttaaaaacttctccaacagtttggttaccttggaataaaaaaaaattatcttcatattggggtactattaagtcacataaacaaataaaaatgattgttagtgttgcaagcattcaaagagagaagttgagaaaattattgaaacttggagagtagcttttttaaaaaaaattaatcagccccagggaacagctgataaataaaaaatatggtagtacaattttgttcatttgaaaccctcaagcttaattaaatttttttttcaacacttaatttatggaagagcaattggagcttttggattttaattttgtttaatgtcttttgttcaaaggtacataaaaagaaatttttccctttataataatttctttcaactctcttaaggtattttaagattttttctgtgttatattgatttaatgctttgtgccttatttggattatattaaagctaatggatttatttctaactagttattcttttttattggacatctgcctgaatgtttgaagattttgaataaagccagttttaaaaaattcactgctctgaattatataacattgaatgtgcttctctagtcatgtattctctgtactgttggttgtgcatcactggagactcagccaagatatcttttggtcctaatgttcctaactttatctcctttttttttttttggtagagttaggaattcctagtttaggtgaaaaagaatgtgtgataataaaataagcattcaacatagtagtttagagaaaacaaagatagaaatttggaaatatactaggaaattcctgagaagtaatttatgtgtaggtcatgtgcaaagcacctttatagacacgctaacttatatacctgaccttggagtaattcctattggagattattgaatttgattgtaggtgtggtaccatgggaaatacatatttaatttttgtctccagtttctggcacacagctcctaaaacccttggaatctctggagtgatgagagtgtttcttgtatgctcatgagatggctggtggcaagtgtcccctagatagtttaagaatggggctggtccccagaaagaccaagacatgattaagatggttgagatttacagccttaccccctcaatctctggagaggggaga

SEQ ID NO: 115454 - DNA, 1067 bp, Homo sapiens
ttcttaaggtggagataaatgcttgagtaattactatgctgtcctccgctattgtggtaggagtctgtgaaacagttctctccccaaagcctgaggatcccagatcaagtgcctctgttttttaatcatctgaatgtcatgtaaagtggtcaaagcttgtagttttaggcatcaacatggcttataaatctcgataataattgagtctcagtttaaaggattggtaggttgttcgtgcctgtgtaaccttgacctctcattgtacccttgatgtatctgggatatccagcacctggtgcctggccacacttggtaagatcaggcctatcccgaagaaagtagtcatccttagtattctcaggggattggttccaggcttcacaaggattccaaaatctgaggatgctcaagtcccttactgtactcgttttctcttcttcatttttaaactcaacatttgcctcaaatcaaaagcatattcctttctctacttttcactcttgcttttttctattcgaatgagatagaggtaggcgtcaaacagcttacaataggtagtaagttctaaaataactgattatgtcctaataagatgattttggaataagacaaattcatactgatgttatgttgacagggtatattagggcaaaataaacacctcagactcagagaattaagcatgggagtcctttctgtattaatctaaatttaaaaatctttgtagaagctttgaactaaaaatgtaaacaaatagattattgattcgggttttctttgggcacacttttttttttaattaattgacttttgctaaattagataactttgtagaatgtttgagacaaaaaaatgaatgtatgattttatgtgaaatttcattatgtaaaatttcagaaagcaaaagtgtgggttttcagtggtgtggtggagccagcttgcaccagcccgttagaactgattggaaattttgtaaactagttgttaaatataaacattagtaaaaattgaagtagctgggcagggtggtatgtgcctatagtctcaactctgtgaaacacacaggc

SEQ ID NO: 115455 - DNA, 1038 bp, Homo sapiens
ttatatcctgttgagagatatccttgattattattatacctctgcttaaaatattttcccactgctttctggataatgtttaaataaacattttattatttaaaaaataaatgtttaaataagtatttaatattctagcctaccttattctatcatactacatatcagccttgttctctgtttccaattgctaacagttttccaaaggccctctatttcatgcttccatgtgtttaattgtattctcccctctgcctagaatgtctctccttctgcttctctcctggctaactcctatacgtccttagaaactacagctctttttgaaagcttctataactgcttattgatatagctgtccctctcttcagcgttcccctaaatttgtcctcccataatgtgtcagcttatagcatttattttactatgttttaatatttttttttctttttgcctctcaactaaactgccttctctgaggtaaaggactgtattctgcacatctccataaccccatgacctcataaacataactggcacataggagatgttcaatatatatttattgaatgaatcgataattgtgatttcattacttgttttacagatcatccgtaagatttgtctactgcattgtcttgttgaatttttaaataggactatgaattattttgttagtaatattaataaaagatgtttataaaaacaagttagtatcttggaatacaagttacttaatgaatttcttaagatatcttttttaaacatataacatttttgcttatttagttgtgaaagaatatggtttctataatagtgtgttatttaaaagcagttctatttagctatttagttgaaaatgattctttggtgaaaaattaactctgtaaatatgtattaagaggaatgcctgctctgttttgattctatgttttaatatttttactcttggcaatatttaatgaaaatgtgtctcattaaccttgaagttactagtcattattttgtgactgcttttgatttatttactgtcttgac

SEQ ID NO: 115456 - DNA, 1042 bp, Homo sapiens
agaacaagttaccttttcaaggaaattatttcattttcaagtgtggtgggttttttatttttagcaaaatgtacaaaaagttctttcttttgtttaatgcatatcttgtggagatttcatattatacatgattttaaaatattcatggattgtaggtgaactgaaggacttaggagtgtgttcattgttcctgcagagttctttgtctctgtgggcagtgtgtacttttaaccataacaggatgccctcagatagctttatttgaaaattagaattttcacaactatatgtaaaaatattatccttattaagaaaaattatatttaatttaatattagtttataaaaagtgagaacattacccagaaaacatgtaaattaaattaagtgttggtctttattttttcacatactcaattaagagtttaagaacatagtgtaactgattacagttgttttgttatgtttaattatatttgagaccatctaatttataaactattgtaattggaaaagaagagtatatatttctgctacctgtgcttaaaaggtacacgtggactttttttttttttttgagtttcagaattttctttaggtgttaaataagcataatcaggctagattacaagaatgtgcttattcttctaggagtctataaatgcttgctttgtcaacatcacttcctattgttttactttctgtatgttaataccaaaatctaccagttaaatatattttgactttttatacattggtttacaaaccaaagcaaaactgttttgtgagagaagtaccactgtgtccaacagataaagtttgtaagtatttggaaaaacgattttctcatttgtgctttcctttcacagcattactcaggcatacacattttaggtcattcatgtaatccagacttccctctctttctttcttccctccttgcccaccccacttgagaatttgctattttcaacattccaaaatatattagcttaactatttaatttactacttattaaaagcctcctttttttcttcttatc

SEQ ID NO: 115457 - DNA, 1080 bp, Homo sapiens
taatttgaggtcatactttagaaggtcataaggagaaatctcagggttcgtgctttttaaaaactgtcctaatgttctgggagaggttacaaggtgccatgtggtaaaagtgttctgcaatgaaataaatgtataaaatgcatactttccaacccttggatgtatgcaatgtgtattcaacatattaaaagctctgaaaaatcttgctataaagaaaccactttttccatttatctatacttggtgaaagaacccatcccctttcccctactcgcttttaaaaatcaaaacatggtgaaaatcatatgaaacttcagtattctataaaacatatctttggaaatggttctataaataatgggaagcctttgaatagttctgaaggatttatgacatgattagaggggtatttttagggtattattctgacaagatggattttagtgcacatgatcatttaagaacaattgttattgcagtaatacaggcacatggtgcaggtctgaagtgaagggtagtagttgagctgcaaaaaatgcagacttctgagggccattaggaaagacatgacagcatgacttggtggttgattgaatatgggtgatgggagggactgaatatgggtgatgagacggggggtgggagggagggaggcgggggaagagagagagagagagagagagagagagggagagagagaaagtcagcaatgttacaaactataactttaaggcctaaatcttccagttctgtgggagtttgttaaactgcaatctataatgtacatagatcatcaaaaataaaatactctaaaagacatttgagaagactaagtgaaagtataaaaaaggcaacataatgcctattctgcaaatgagtgtaaaagaatatatcctgcaaataattgtgcattattaccctggtattaaaattgattgtgattcagagacttagaagagctgtgttctgaccaaacaaggtttatggaccagaccactgggactgtagccagctcaaactgtactcattggtcacacctgtaaatgtagaacttttattaaccccaccccccagaaaaag

SEQ ID NO: 115458 - DNA, 1074 bp, Homo sapiens
tctgtagcccaagctggagtgcagtggctcgatctcggttcactgcagcctctgcctcccgggctcaagtgattctcgtgctttagcctcctgagtagagtagctgggactacaggtgtgtgccaccatgcctggctaattttttgtattttagtagagatggggtttcaccatgttgcccaggttgatcttgaactcctgagctcaggcgatccacccacctcggcctcccaaagtgctgggattacaggcgtgagccactgcggctggcctacctttaatttttgtaggctgtggtaaataattataaatttttacagtagtttagaatttgccttttgtaatatacctaattcaaaatggaaatctattctcgttttcctgttaatttaattcttttactatataaggggttatgcaatattcaaagattaattgtagaactactgtatcataggttcatttaaaaatgtattaatgacttttgtcttataggacaaactattcgagagaaaagaattgtagaagcagcaaataaaaaagaagtagactatgaagcaggggatattccaacagaatgggaaggtaagtttctgcttttagtagaatctcatgggaggtaagttatataacagtatacaaattcaataagagcatatatagttatatactgtttctctttgcaaaaaagttttagtgtctgaatgtttgaaactttgtttttttaacattgcatttctttgaaagttgtgaaggtgctgaattttagtaagcagatgcatgtatagcaaaaagaactattaagcattatcagagctgagactaaggtgaggcaagccaaaatcctaagatgcaaaatttaagcaggcactcactttcatgtagtgacccagcacttgcacaatcctaggatttgaatcctgtttctggcactcattacacacatgaacttgcaaagtaacttaaacttttagttttttcttttataaattatgcataatacttgctgtagataccatttggagtattttttcaactcacaataactctatgataactgactgcctgttaaga

SEQ ID NO: 115459 - DNA, 1018 bp, Homo sapiens
gttaaaagtataataatcaataatgatttttattttaaataatatgaaagtgtttttgcatcaaaatatgtatttttcgctaaagggattatacttaattgtagccctggcacaggagttggcaaactttttctttaaaggtccggatggtaaatattttaggttttttatgggccacttagtcagttacaattactcaactctaatgttgtagcacagaagcagccacaaataatatgtaaacaaatgtttgtctgtgttccaatcaaccttatttctagacactgaaattttgaattctctatgattttcatgtcatgaaatactgttcgtcttttgatgtttttgcaaccattaaaaaaatgtaaaaagtggtaggctaaacttggcttgcaggctatactttgctgacacctgtcctagaagttgatttttctaaagctagaattaacttctactctacattaaaactgaagatatattgctgaaaccttttatagatatatagttcatgttgagttattttaaaaggaagctgttttctagaaaaaaaatcataattatacataagtaactttatttttaaaaaaacttttattttaagttcaggggtacatatgcaggtttgttacataagtaaatgtgtgtctggagattttgatgtgcagattatttaatcacccaagtattcagcctagtaccccattagttatttttcctgatcctctccctcctcccatcctccaccctccaataggcttcagtgtgtgttgttcctctctaggtgtccatgtgttctcataatttagctcccacttataagtgagaacatgcattatttggttttctgttcctgtgttagtttgctaaggataatggcttctggctccatccatgtccctacaaaggcatgatcttgttcttttttatggctgcatgtattccatggtgtatatttaccacattttctttatccagtgtatcgctgatgaacattcaggttgattccatgtctttg

SEQ ID NO: 115460 - DNA, 1099 bp, Homo sapiens
tgaataatagtaataattatactaataacttagacttatgtgccaggcttcaaagtaaacatttatgtatattatcttatataattttcacaacaaccctgaagtgtagatacttttataatttccattttatagatgggaagcctgatgcttagaaaattaaataacttgctccaggtgacacagacagtaagtgatgaagctgggatttgaacccagaaaatctgactttagaatctcataagcactatactatactgtcttccatgtgattctgataacttccctaaaggcagctgccccactcccttcccattgctgcaaagcatccagcacagtacccaggccccagcagccacttaacaaatgtgggctctatctctgcagcccatctgccaagtgttagagctaaggcctgatgatatttttgcttgctggagcaaatcagaaaagaaacctctgtaaatgaaaaacttttctaagtcccttcctttataaattgaacagtaactaattcaaatttccagaataatataattttgatattgtcttgaagtttgctgtattttggtttggcttgtatgccataaatatacccagtcgaatttagatgattaggaggtatgattttaaacatatgaaactgtcccctctttatcttctctacactattatattctcttcatgacacatatcaccaccaaccatatgtttgtgtgtttattttctgcaaccccttcagtagtacatgtgctacagtagagaagggacttaatctgttttattccctgctgtatctccagtacctaaaataatatggagtaggtactcaaaaaaatttgttttatggataaaaatgtttgtgtaaattatgggaaactgacatttaaatattatttttctttctagcttggattagaagaacaagaaagactccacctactatggaggtaagactacacaaggaggatatcatttaggagtatatattcccaaggatatacgaagcttcagaaaaactatgatgtattttctcaaagtgttgattttattccatcacagaaaataacttaaaacattttataataaattaatatat

SEQ ID NO: 115461 - DNA, 1068 bp, Homo sapiens
tgtgttcttcagtgttgtataaggtgaattcacatttcacagagctaatgaggtagacttttcctagtcctaactctattccattagaagccacttatagcaaatactttgaaatattgcttcttttttttatactaacacaataggaaaagtgtaaagttttttgtttgaacaagtggttacatttattgccaatttttgacaaattatatggtttattataggtttacaggcagtagaaaaaagttacaatattagagttcagcctacttcatttttaatatacatactccataaaaaagaaagaggagattctagaaacgaatagagaatggagttggagatggtgctgctgttggagatgatactgctgcggtctaaaaaaaggttgggatggctggataggacaacacatcatagtatcttgtttacttgaccatattctcaaatctgggctgcaggctccaaagacttacttttgttcatgtctaaggttgcttggccctaaaggacatcacagtgactaaatgcatgtgaatttgagatggtggccaatccccatgtattaatttacagtaagaaatgaaattggcacagaaaaaaaaaacaggagactgcttggtaaatatgacattggaataaggggagttaagtaaaataaatgtttaattgcctcaggcttaaaatttcatgttgcattcaccttacaacaaggatagtctgacccctagcaatggaaacatttaaagagaattggctacaattttcaattctatctctgtattagaaatagccttacgaattgtaatagaaaaattgccaggtgctggttaagcctccttttcccatggacagtgtttttatggattgccagcatttgtctctgtgattctatttttttctttgcttctcggttctggttgacatatttcctatgccatgacagtagttatactctggtcagatgttactggccctgcagctatttttttgttttatccttttcctatttctgctctggcttatgatgtgttgatcttatagtttaacattcagagaggaatctta

SEQ ID NO: 115462 - DNA, 1040 bp, Homo sapiens
tcagctgctgctctgcttgggaattctactcccttctcagtatagttgtttcgagtagtaactgcttgttagtgctattcacattgcctgaagtggattttattgttattgctgctgtagtgtttgtggtttatctgactgctgtacttctagttggccacaaggtcacattttccaaattcctgctactgtatcactttatatcctaggttatcctcttaatcccaccttctccaatcccataataagaagggaaaagcttgcactgtcttcataatggtggcgggggtgggggcaatagagtcctgagatccattttaagtaaggggcacttgcctatctgccttcccacagtatccttgcctcttttgagaaacaacaccagtagtccttctgagatgtaagcaacctctttccaagttttggtcagtcacaggcactatggatgatgtattgtaacccatcatatttgtatttgttattgtagttgtgctacgctgtgggtaaattccttaatgtgtactagacagggaatataaccaccattatagcactatttctttggggaaaaaaaagtgttttgggtccaaaatagttggttgactttaactttcttaccttaagctattcctaagttaggaagtccttatatgagtggtgatatattttaagccacatacttggtgattgataggtggcaggtacacaaagaaaaatagagaaatattttttcttacttaattttcaaaagtagtaaaccgagtcattttaccacattgatgtttttaaactagtataaatttccaagaatataaataagtttgtatctatcttttctcaattttcagcgttacaaagggaaggggtataagcaatttaaaaaaaggacttcctttattaatgatggaatatgatatattcttgattagctatttaagtttacatttggatttataatacaactgcactatacaaagtcagattatcagtcaacagtgattgccctctcagatggtctactaaaaaggaaaccaattaac

SEQ ID NO: 115463 - DNA, 1070 bp, Homo sapiens
agcataactcacttgcctcttgttttattctaatagatttcttagcaacccagtactatcatactaacctaagctctgtcacttatttactctttgggtttctactcccatccaggcaagattaaatttatttttgattactgatctagcaggtgttctcttgggcctaaatacagaataccttttggtgatctatgcacctccctcttttttcttctttctttcgtagatgaaaaagggtgatctaataacttatttcatcctggcagttcaacttgtagaactagaaaatgtagtttaattaaacaacttggcaataaaattcgagctgagacatcactatagcatttgctaggcttgaattgtttctcagcatgttacaaaattaacactgtaaaagaatattcaactctgaacgttttgaaacaacaaattcccattataattttataattatattgaggattgggggctgtgtggtatattctgggaggctactttctgggcatgactatctaatagtaaacaaatgttactggtatggggtcccaaaacatacttcatgccaaatttcacttataatctacataaatcgttttgtagtctatgaaaaacattttaattgactcaaaggcaatgtactcatactttaaaaattttaatatttattaaaataaaaattattcactagtatatatggtttaaattatggaaagaaattagtggagctgtcaaggtcaaatttatgtctggtaagcagtaaaaaatgtatgcatttgggtatatttagtaattgaaatacttttacatctttatcttatgtgtactttgaaaagtatgtctagctccaatagatattaaagatatatgtacatttagcttttgtcacaaatgtaccgctaatgtataattttaaattataactttttataaatccggtttctcattttttatatgtaatataacttgaacttcataaataagctatggttttgttcccacagaagactgaaaaagaacccagttacatgggcctaagactgactcctgagccttaacttgctcttgaa

SEQ ID NO: 115464 - DNA, 1136 bp, Homo sapiens
gtccttatgacagagtcacatggcttttttaaatcttctataactttacctctttgaagtgtcactattctggctgtactagatgaattactttttcctaaccagagatactagtccttattacaatagtactaagttgtactttttaaaaaagcaaactgagtgataatggaatcctgagttaactggttgtgtgaggaaactttttcaaaatttgattaaccacatagtcttttctcctgtttttttcctctgtgttctccacccgcctcccccagccccagttttcataagactgctgtgaagatgtttgatataaaggcttgggctgagtatgttgtggaatgggctgcaaaggacccctatggcttccttacaaccgttattttggcccttactccactgttcctagcaagtgctgtactgtcttggaaattggccaagatgattgaggccagggagaaggagcaaaagaagaagcaaaaacgccaagaaaacattgcaaaagctaaacgactaaaaaaggattgaaggactgaacaggctttgcaaccagaggaaaatcatttggaaaattacacagctttggaagaatccactaaagtttcttctttggatttcttgacagtatgatttagtaaatgaaatttgaccaaatggaagaatcatgttagttctgacctcaatactatagtaacttttaggcgtgggtgtagaagtttataggtttctattgacagttattgtaaattagcatttactgtggtacaaattctttataactgacttagtcatttgccgcttagcagtttatatactgaaatgaaaacatcttgtggggaaaagtgactttagattatgaactcaattcaaatgaactctatttaaaatggggtcctattttggacaaaggaaattaagaatgtaaaagtcagaacagtcttgaggtaaaaagtgtgctttggcttaaaagggatacagtatattaattacatcttttattattattgtttatttcttagaatcatttctggctttctcaaaacaaaataatattaatgagtacttctatttgctgcatttttcttattacagcctttgagacagctggtaattataagtcattttccattttt

SEQ ID NO: 115465 - DNA, 1050 bp, Homo sapiens
aagtaaaggacacaaattgtatgatggacccaaaaaaacctttataaagagtaagatgagctgtttgattttgtagtggtgtacctaatccagtaaataaatgagtggcaacatttttagtataaaaattgaaaatctaggaacggatacgctgtgtaagtcagtcagtgagccaacttgtctcccgtatgtcaatgaactaaaaaaattttattattgaaataagtaacttagtaaaatacttgatttccagtaattaggattttcttacagggcatttgcaattgtaaattcaaatgaggaagaaacgtattaagttactataccggataggcaattttagatgtcatataggttgcatatatacaatatagaaattttccatttaaaattttattacaattatcctgaaattgtgacttaaattttgttttattttttgtattctttccaactagccaattgtacagaatttaaaccgtctctcagatgtgtacagtagaactcaagaagacagactaccaagggtcatctgaagtcgtgattgggtcactaataacaccaggacaaagttaagggatcactactcaagcataaggtagatgatttttttaaaaaaattccagttgaaattgtaagtggatgtatatacactcattccctacccaggtattctaattctccactttgaatagcggttgacacaaacatgaaagggagaaaagcctctggggcaaaatagaaaacgtcactcaagtcacataatcctcatttgccagttgccttttccttacactcaaaaaggaacaaaacacatggcatctgttaaggctactttctcatttattaaattaggcttattccaacagaggtcctcaaagctgaaagggcataaaatagcacagtactttttgcttctttggcatattaatgcgatgtcatgactcccttaccctctccttcccattcggggaaatagtcatctctccttctctgcgagcatttcacatgctctgttgcttgtccttttcaaacaccaaatttgctgat

SEQ ID NO: 115466 - DNA, 1039 bp, Homo sapiens
ggcggcggcggcggcggcggctcctcgtcttccccggccgcaacctcggcggccgcaacctcggccgccgccgccgctgccgccgccgccgccgccgccgccgccgccgcgggggccggggccccgtcggtgggggctgccggggcggcggacggcggcgacgagacgcggctgcctttccgccggggcatcgcgctgttggaaagcggctgcgtagacaacgtcctgcaagtcggtgagtcacggggcagccgcgagccgtctgtccgtccgtcagtccctgggtggggggggggtgcccgcctttctcctgcggacagcccctagttccgcgcgcgcccgcacccctgcgggtgtcctcactggcccggacggtcctcctgagcggagcgcccatttcctccctcccttccctgccccccgtcgccccggacgggccagcgcgagtgggaaatgaatcagcaggacgcgcccctccgtgggctccgcgcccccggcccgcgctcccctacccgccctcctccggggagcacatcctggagggctgttcgccggtttcgggggtggatgtggacaaaggcgcgggcggacggccggcctccggcgagggtgtgtgtggcggggctgtgcggggcgggggagggggcgcgggccgcagacaatgccggccgcggcccggccgctcggcgctccccccctctcccactgcctgtcgctcgctcctttttctttctggcccccgccccacgcgatttgaggggaggggaatacacttaaagccgctcggccgccgctcctcccagggctccgacgggcgagcggccgcggcgctcccgggtcgctgtggcgtctggcccgggcgagctccactggccgcccggggtttaaatgtcgttttctttgcgcctcctcagtctccaagcggcgcagaggagaggtggcggcggaccggactccgtctccggagggacatctcgcccgtaggacgcttactaattaaagggcgcgagcctgaggaggagctgctagcgcttccctt

SEQ ID NO: 115467 - DNA, 1109 bp, Homo sapiens
tgggaggccaaagtgggtggatcacctgaggtcaggggttagagaccagcctggccaacagggcgaaacctcatctctactaaaaatacaaaaattagccagagcggttgcgggcgtctgtaatcccgccgctcgggaggctggggcaggagaatcgtttgaacccgggaagcagatgttacagtgagccgagattgcaccactgcgcttcagcctgggtgacagagcgagattccgtctccccccccaaaaaaaacaaaaacaaaaaaaacgagatgcaaataaaaatgagatgccattttcttctaccacattggtgaagactaaaaagacaatacccagaattggttgaagagatttgggaaaaaggattctgcctacgctgctgcttgacaccatctttttctgtctaaggaatttatcctatagataatactgatattagtgtataatgatgttctgtatagtgatgctcattgcagtgtggtttgcaagagtaaaaagctggagttaacctaaatttctacagaagggaagtgcctaagaaatactcagtggaatactatgcaactatgaaaagatgaattagatttatatgtactgacaaggaaagatgaccagaatattttaaaacaagttaaaaacttcatatagtatgctgcaatttgtatttaaaacaaaaatacttgcatatagatgcataaaaacatctgtaagtctacacaagcaatcttggaagtatgggtatttttcgagaaaagcagttaagtgaatggtcaaggtttttgggggggactttaactttttactttatacctattttatggttgggtttttcttaaaactagaggcatatatttttgtaataaagaaacttacaaaaattatccttgagtttttaatttatattgttttggtgtgttcgcatatgtgtgtgtgtgtgtgcttgagtgtgtgtgagggtcctttctgaaggaaggagatacattttaaaaggaatggccttttaaatggcctatttttctatttacttttgggagaaaagaatatcgcccagcattccacataacattctggtaaacacattcttacactcttttcatattcat

SEQ ID NO: 115468 - DNA, 1064 bp, Homo sapiens
ctaagtatgtcctcactgatttttaagatttttatcctgggcctcttttttttccacaaaaatggataatcaattgctgtctcaattctaaccctatgaatgtttcatatggaaagatatggaccagcatctctttctgcttacactcatattcacggttaagaatgtgtgatttcagctagtaatgtgttcagtaataggcagtgtaggaatgacatgttttgttttataagagttgtccctttgaaaaatcacatgagaccagcctgggcaacatggtgaaaccctatctctactaaaatgcaaaaattagccgggcgtagtggtacaccgctgtaatcccagctactcaggaggctgaggcgggagaatcgcttgaacctgggaggtggaggctgcaggctgcagtgagccgagattgtaccactgtactccagcctgggtgacagagcgagaacctgtctcaaaaaaaaaatcacatgactggatctgtactatttccacatgctttatatttttttgtgttagactgtaaattttcttcactgaggcaaaataaatttggtacctttattttaagaagcttacttacatatacatatgataaaacaaactcagtgttagaaatttttataggggcaatcattaaactcaaactgttgttgacttaaactgttatatttaagagcacaaatatcctaaaaatgaaagattataggtaactataaatatcttagaaacaaagcgggttataggcaggtctttttaaaaaggtagtaaacagtatgaaacccacaaaaccgtttttagctacctttcaaattactgtggtataatttttaaaatagtgctttgtcacaacaaaaaggctaatttagtttttgtgatttattaattttttaacatgtaaatatttggggattactttaaattcaaaaccacgaactgtttccctctttaagtgcatgtgctttgaaaaaatcagtatcaaatgataatttggagaaaagtgttactgagtcttgtcttgtgaagagacgttttgtttgtcaatcctacccaga

SEQ ID NO: 115469 - DNA, 1004 bp, Homo sapiens
ttctaaaacccaaatatcatgtttgtaatctagttgttttatgtgagcaaacttttaaatatgtaatatgttagccctgttcctttatgactttgttttttagtgttctgcaagtttccttatccttagcactttggactttttttttttttttggtgagacagagtgtctctcttgtcacccaggctggagtgcagtggtgcaatcttggctcactgcagtctccaatctccacttcctgggctaaagtgattcttctgcctcagcctcctgagaagctgggattacaggcacgtgccaccacgcctggctaattttttgtatttttagtagagacggggtttcaccatgttggccaggctggtctggaactcttgccctcaggtgatccatccaccttggcctcccagagtgttgggattacaggtgtgagccactgtgcctggccaggattttgtattcttgatgccatttttacagttctttttcccttcttcccccaaataccacttgtgtaatttttgtctgatatacgttcagcccagtgaactagccagtcttttcacgattgtggtttatacttttctctagacagtggtgaagctgatgagtgaaatgaccaatggctgctttgtgatgatggcagggtagaatcaagtgagacttgagggcagcaggtgcggaagactgtgaactcaacttgcctcacagctccagtttgttctttctttctttcctttcttccctcattttctttcttcttttcctctgtcctttcctttcttggggatggggtgagggaagggaggagaaaggagtgtgtggtagaaaagaagacaaatcagaagagataagtaatacctactgagagtatattccatttccctcattccctccagttgtccccctcttcctccaatcaccctttagggaaataaagttgaggtcagaaggacctatgtgttacagctgctgcttagctgctatttttagcatggccctac

SEQ ID NO: 115470 - DNA, 1054 bp, Homo sapiens
ctgcctcagcctcccgagtagctgggattacaggcgcccatcaccacgcccagctaatttttgtgttttttttttagtagagacggggtttcaccatgttggccaggctggtctcgaactcctgacctcaggtgatccacccatctctgcctcccaaagtgctggaattataggcggtagccaccgtgcctggcccacattcttaaatcttaaaacagattcttatattttggatgacagcaagttgggtagtttgctgaattattaggaaacatagtgaatatcttggggatagaatatcaagttcattgaactatatcatagtgtaatctttctgtagttagaggttatagtagataattcaaaagtggcctggagatagattgtcagctgacctattgatatcaatgtatctctctagatatgtgtatatgtataatttaatatgatgcatagaacattgtagagtactggatgttagtgggtaagagactaccttttgtatctttaatgcaatttacgttttgtttaggtgagtcatgtaaattgatgtgagctctagcttaacatgccttattaaaaccaaagcccagtaggtagtttgattagtgctgtttagagtttttataagcaaagtgctcagatgactttccttattagaacttgtcagagcagtttctttgcagttttcatggatctcccttagcaacttactaaagaggcattttgtttaagctgtttcataaatagcaggaaattccaaaggcctggattgtattgcatttttgctttcaataatgactactactgtgggggaaaaagccgttaaaatactctattcattttaacaatttgtagcaaagtacttttattttaaaatggatgaattttttaaaaaagtacagattcaagtttcattcaaggttttcactgttttcattaaaattttttgtagtttatattttagatgtgttagacaacaattagtgatataatagctagtaactatgagtttattcaaaatttactgttatgtaattgggtatgaatttgt

SEQ ID NO: 115471 - DNA, 1064 bp, Homo sapiens
aatgagggacagttttttttaatgagaaatcagaatatcctttgtaggattgtagatttctaagcatctttgatgaaggaagcatcagttgtctaatcaaattgaatcaaaatatggagtgctaacagatgtaaaaatactctaccatacactgttatggagtagtcattttgaatttatcattgtttagcaggtatttctagtcttgtttttttggggtgagaattacagagcatttaaatacaaagtctttttttggagtgaaagatgaatctgctagtttgaaaaaaaattctggcaaattttaaatctagaacagccaactactgtattaacagtgccagtgcattatatgcatagtagacattgaaatgtcacttgaatgaatgatagccttagagtatatgccagccctgtgggtgtctgcatgaaattctcttaattgaaaaaaatagctccagtttctaatttctatttgattttctgaatgtgaattgctgtggcatagtctttgagggaggtgaataggaatatgactgctggataagtaggctggttttcagtactgggtttgtcatcaatatatttctccaaataccgtgtagggtttcttttttttttcttctcatttgacgagaccttttctttaagcttgttaacttgctagtagtagcatcaggccaaaagctattctgaaagcaatttatttattagatgattccaacttctaaacagaaagtaacttgaatattcccatatagaacagtacttttgggttacctagaaaaataattttgaattataaatgcctttgtgggattaagtgattgctttttccttctatttgatgtttcatttttaaaagaaattggtataactaagtttagtttttgaaaactctccctctcacagatgatatgcaaaaaaaacacataacttcagaatatcccacaagatcttacacattgtgaaatgacactgtctaattaataggaatggtttgctacactggtctccaaaatgctgatgactttctcttgaggtagaatttgcttaagactcaa

SEQ ID NO: 115472 - DNA, 3600 bp, Homo sapiens
ggacagttgtgggctgacctcatcacttagggtttagtttccaggcttccctgaatatgtaccatggcaagtggaagatggaagaagatagaacaactcttagatttatgtttgtgaattccttatgtcatatgactgcactaagatctacattcccttcttttggaaactttcattaataaatgaagagagttggttagcatttcccccaatttaaagatttacaaataaattattcagaaaaataatttcaaataaaattttaagggcttattatgaactcaaatcttacttgtggttttttcaattgtatttttgggtattctcataaatccttgccttggaaagttgtggtgatatgacccagactacctattccacattctatttttgctatcacagtttaatattttcagtgaagtttagactggattagccatcacatcaagcatttcccccctttctgacctgttagtgtcctttctgcacttctaatttgtaccatagagcgccattaaaaaaattttatatgctatgtttgtacacacatgcatgtgtaagagtggactttgtgtatgtataagagtgttaatcagcttgcaaactttagacaggcagggctcagctcttagaatctatattgcagccaggatggtgttgttcatacctaccctgtgcagaaccttcagtggcgtccctttgttcagaggcctgaagtcattcatgggtgtacaaggcccagcatggtctggcctggaccctcagccaccttctgcacaatgtcctctcctgcctttcagatgtgtctaggctgccctgctacctgcctttgcctatgttcttttttctgtctggaatgctcttctgtgcttggttcatgccctaattgtcatcttggctcagagaaataatcctggcaacaaattacctcctttgaatcctaatcatagttttttgtgtgatttttcttttttggattgtcctctcccatgagattgtaggctccaggagagcagaaactgtaaatatgtgtgtgaatatgtatatgtacatctgtttgtatccatggctatcagtataaccatttgcacatagttgtctctcaataaaagtttgttgaataaatggatgaaggaagtggtgttttactttgggaatattttcataactctccaggaggaggcattgcttttattcagtggttccatctatctattgcttcacacccatcacacaaagaatatgccagtttgaaaaatacagcctagttttgtgtgtttggctactttgggccactcccagattttccaaaggtacacttgcattcacctttatggttagaggcactttcttagaatctgagtttaagaaacggtatgctattttaattacagtaagtactttatcaaggtcagttgtcttagaatgtggatttatatgacatagtctctaatacattctgtttggcatgtattacagggaaaaaccaaacagtcctgtttgcagccaaagattgcaagatggtggtaggtgtgtagttagagcacgagactttcttttgctcacatgcataggtcagttctcttctttcctgtcttgtcagttctcttggatgagcaactgtgtttggtcatgggggcaaggcactgaccttggagctcatgtgcaggtcactgtgggccatagcaagtctgcctgaacttttttttccccgtctgttgatctgtgcattcttgcttatgcttgagctttttttcagtttgtttttaatctttgcttcctcaagttaacataagtagcagggtagaatgatctgccacatgaaagtcatttctgtctcaaagtggtcttggagaaacctgaaatttttcagtgtcttgtttgggatgaggattgggatgagctctcatttgaaacacatttatttgccattttatattgttgcagctcaacatattgaccaccttttgggtagtaccagttctgtgctttacaagcatgatttctagctctcataacaactttgaggagaaggtattctcattctaaggctgaggaaacagatatgttaagtcacttgtcaggagcatctgggaagtctgtgctggacttgaacacctaggcctcccagctctcaagtgggatcatgttgtactttgttttccaagtgttgctagaggcagcttgtctttttgcacatgtgtcattcacagtcctccttggtctgtgataccattcaaatatagtggcctgacctctgagcagtgtttcactacttctgaatgtattatgttttatttttttctctttgataagtagtaatggatgtgtaacccattcacgatatagtaccttcttgttccttggagctgatactacactcagttgagggtgactttttctttgttggacatttacaaataatttcagtcacaacatttagtgacataaatactttgacttgaaacaattaccattttctcgatttttagtgggagactggggcaatgtgtgtaggacatccttcagaaacagatgagtataacaagctgtgtgaggcagtagaggtgcacacacctcagttactggaaggcacaacttcgagttcttgtggattgtgttggcagccctgtagatagattcagcagatgctgtagacattctcttactaccgaattatagcttaaagacctaactcttagagcaagccttaaaatgtgctttccccgctttgttttaggaaactcttctgtttgctgatgaggaaaggttatctttccaggcagcatccaggaatggtcttttgaatgtcttcatgccttcttgtgacctcattcctgctgccatcgtacttatccctgctcagattaactgcctgcgtgttcaactttattccatagttggatctacctgtagcatttgcagctttctgtgtagactgggcacaagttaaaagcttaggaagtctatataactcaccataattttagcactttaacttattaaggtacatgttttggttatctgatttatagaagtaccatgtaaaaatccacctatgctgtacaattgctgaaatactgagtaagctctgcattttatgaccaagttataggatgaataattactctctggagtgaatggttcaaaatgaaataactgtatgccttaggtgtgacgtgacacgagatgtatttaagccccaaaagtatgtaattatcacactactcttgcatagacacacaagtacatttttgcttatggcaagagttttatgtgcaaaagaaaactcactttctggtaagcgaaggaacagtccattatttttgaggggttcataagttgtttggtattagaggctccatttcaatccccctgcatttctttagggtctaatttaaattcatacatcacttgattctagagtaaaccattatcataccctggattttgaatattaaggacagttgagggagtttctcaaagcaccattttatgacttatagtctgcctctgtattcagtgacttattatatattccattcttagactgcattttgatcatcaactgtattaaggcaatatatgttgtactttatt

SEQ ID NO: 115473 - DNA, 1028 bp, Homo sapiens
tgtttttaagcttgctttgcagatgtggaaataggcatggagaaggtaagtagttctcctaaggtcacatagctattatttggtagagttgggatgtgaatccaggcagtgtggtttcagagcctgtgctcttatctcctactttttgatcttgcccccacacatgataattgtttgatttgtctccttactgctgagcacttcaaatgagtggctgtttccattgattttacttatctagcacttatttttattttgacttctgttactggctttagttttttaccctcacctttggaatatctctcttcaaggtcaccactgatttttatagccaatacaatgggttatttaagcttctgtttctctttgatcttttcctggcttttgataacagtagccatttatatggaattacaactttgacttctgtgatgttgaacttgcttgttttcgccttgtctcactgaggcaccttggttttcttctttctctacgcattccttagaccattgccatcttttggattgagtttgaatttaggtgtgttatataagaagccccttaatgttaattttatatttaaatcaggacgaataaaaagatgaaatacatatatattcttgtggtctttttccttgtgtgtgtgtgtttgtgggggaggggggtaaagtcacagaggagtgggagtaggtcccaatgtggacttttccctgggctgaaggagagggacttacttttgaatacctaccatgtgccagcactgtgctaagtgctttaaacacattgcttccttttaattatcctgtgtgagattggtagttacctttattttacaaataaaggtaactgaaactgactttgtgtgatgaaaaagtaatagaagtgggattgaaaccctcatctaactgcttctgacagccaggttctttcctctggatcacctggaaaaatctccagtttcttatctgttaaatgaggaaacttggcaagataatttttaaggcccgtttttcagtatcatcctc

SEQ ID NO: 115474 - DNA, 1007 bp, Homo sapiens
cagcttacatattggagactgtgccctcctttccccaccccacagggggcactgcctgcaaggaaggtgtttgatctgaaccctctgaggccaatcaaatggaaaaggtttagtacaggctaacagcaccagtttacaaggctatccatacaagaatgattacatcaactcgtggaaagtgtcatcatggaatcagagtaacctcttggttatttgaaattgtttgttatatagaattggtaagaataccctgtaatctagtgacatatagaaccagttttgaatagtaacagaactgcctataagattttatagtacttaccttgcacacttctgctgagttcacaaaaggctgactaaacccttgttctcggcaatctcatctctgatcccaaagtgttctcatacttattttagactcaacatattttctaatgaagcttctggaaatagctggtatcatattacggaaacttattattggcacagtgccttaatgattagttggcttggggggtggggagagaccctagctatcaaggatggacgtaaaaatactttgctaatatgagcactgctgaggtttaagtcattcctgaggtaagctaaaatatgtttaaaggttattaaaaaggcacacagtttctcatttaacattttggtattaactttagaggccaagagttttaagtagtctctgtaggatagtttgtttccttccttccttcctcccttccctttccttttccttccttccttccttccctccttccttccttccctccttccctccttccttccttccattcttcctccctccctctttctttctttttctttctctctctccttccttccttcctccctccctccctccctccctttccttctttcttttcttttcttttcttcctttcttctttcctttttttctctcctttctctctttctttcttttctgggtctcactgtttcacccaggttgaaatgcagtggcatgatcacag

SEQ ID NO: 115475 - DNA, 1200 bp, Homo sapiens
acctcagaaactgtcagtctagtaggggagatgttaagatttgcaatattactaaaaatgatttttttatctaatgatgttagttttttagatcaagagttaagtggtgtaaatggttcttcctcttcccacagatatttcactggacatctgagatgtcagattttaccaaaaaacaaactacaaaacagaggctatagcataaatcagattatggaacattccaacttaaaactcaaatggctttccaattgtatttagaattaaataacttctgagataacttctaagaccctaagtgagatcataaccattttttcttttgcatcctctgtacaaaagaacttgaactacatcgaacaaattatgaaacatccttatcattgcactgttatttttgatttttgaaaaagtttcaaagaacactcagatttgtattctattttaaatttgcaaataccctatgaaatcctcccctcccattatttaaaagctgtataaaaataatagaagcaatgaaaccacattttgaaacatgtgcaagatactgggaaatgggaaaagtcattctataccattgtgttaaccaaccatagtcactattttagtgtttttcctccttgtatttcctatgcattaaatgcaggttttcattatttgtacatttttatatctagctctttttggtttgacattgtatgataagcatttttctgttatatacaagttatgtgtaaacataaataattcagtggatttatattttatttgaccattgtcttattttggacatttaaatttgtttccaagttttcattttatgcatgaggctcagatggagtgtctttgtgcatgtggagtaagcactgcccttcactctgcccgtattttctttcgcctttaatatagacttccagaagaggaaatggtgggccaaagggcatgttggatgtttttatggcactttctatgtattgctaaattgcctaccagtttcacacaccaattgccagcaatggatattagcatagttttacaattttttttttgccaattaacagcaaaataaaaaactaaagaacccctacaagttacctgttgttttaatgtgaaaatttaaagttactcacaaagttaagtattttcccatatgtttgcgtattcattgcgtctcctagtttgtgaactttactcctgtcc

SEQ ID NO: 115476 - DNA, 1728 bp, Homo sapiens
catcagttggtaaaggttgtggagggccatagtggtggacagcacgagctctggggacaaactgtcaggtctgcacctgggctctgccccagggtggggaatatgtcctggggacagaggagtggaatattttttatttttaggaattcaatttctttctattattttttttctaaacttagaaaaatcccttgcctttttagatgtttagtcgccagttctgaatttcttcaagtttagaaagttcttttacctccttactccacctagattttgttttatatttcaaactcttaaaattgatgactttatcaactatctacacttattatgaagatgtaacaggcattccttagaaatgaaatttctcactttgaaattataaaattggcactgcatttatagtaaaactagatgttcaaaagtttattgggtaatgatgtttaaataattggctaatttctttacctaaattgcttttattttaaagagaagcacgtcagaattttattaggcatattagctagtgcatggcgtggtgatttgttaggttttgggtattgtaagagagttttatttgtttagaagtagttggcaagatatttatcttttgattttttttcctaaaggtgagttttatataggaatctgtacctcgggatcacgtggctttgtgtaccaggcgtccagggagcaattaggagggcaatctgttaagtcttttgcctcagggcagaaccattaggtgtgctgtgtatgtgcctcaaggggtgtaaataactaagctattcatgtactcatcagtttcctttcaaggcatctgtgaaacctttaatctgtggaagaatcagagaaagttgacctattgtattattatcctccctcacctgaatattttgataaagtatattttagaatttacagattggacattaagcacatgaactttaaattccactttccattttgatgtgaatgttctaaaagttccctatgatttaaatgtaagcagatctttaatgtctacagaagagattttttttttttgttgatttattatctttcggagtgaataaattccatttactgatggctgagatttctcactgtcatactacagaaatgagcagcattccagtttgtttcctatattaattttggggcattattgaaaagaaataatcattcgtttccctttctaccattgcgcataaatgccatttaaatgtggagaaatctcttccaccttaaaaaaaaagccctcctttgacactgagcctttctaccccattcttaccctctgccctattttttttttttcatatccaaatttcttcaaagagtgatcacattcactttatttcttcaccttgtacttcattcttttaactttggtctgccccagcactccactgaacctgctaaagatgccagtgttgctaaattcagtgggctcttcattcttcatcttatttgacaactcagtagcactgaacacagctgaccactctttctcataacagtctttactggactttggtaaatcaagatctgttggtttttctcttacctctttggtaactccagtcttagttaagccaccttcctcttcccgctttttggacccttttcctactctcctatactctcaaaccactatgtaccaggttcaagtgttcacttctcctgagctccagactcctgtagtccacctattcataggacatc

SEQ ID NO: 115477 - DNA, 1089 bp, Homo sapiens
caatacaggattatctgaatcgaccaaggcctacctgggaagaagtaaaagagcaactagaaaaggaaaagaaaggctccaaggctttggctgaatttgaagaaaaaatgaatgagaactggaagaaagaactggaaaaacacagagagaaattgttaagtggaagtgagagctcatccaaaaaaagacagagaaagaaaaaagaaaagaagaaatctggtaggtattcatcttcttcttcatcaagctctgattcttccagcagttcttctgattctgaagatgaggataagaaacaaggaaaacagagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtcagaatcagagtatattgaggaggtgcaagcaaaaaagaagaaaagcagtgaagaacgagaaaaagcaacagaaaaaacaaaaaagaaaaagaagcataagaaacacagtaagaagaagaaaaagaaggctgctagttcaagtcctgactcaccgtaacattaagaaaaatcaggattcccttataaagaaagtgcaatgtctgaggaaatttcaactgtgaaaactacaacatatttactaaaatgcatgaattttcttgtttttagaattattcctggactattcagtagccactcagatgccactgtgtgaaagggccataaatgttgcctgctgcttgaacatctatttttttctcttccagtgcttgataactctgggagataatacactgcagtcgtactagtggttaagatatttgggaataaaattaatacttttgactagaagcgtctaaggataaaccaacagaaattgaatctggatacatctttaagatgtaatcagaaatgaccagatgactctagttagaatttttgaaggagggattacattaatatttcaaaacccttactctgtagataag

SEQ ID NO: 115478 - DNA, 1092 bp, Homo sapiens
tcaggtgctggtggggtgactttgaatgttgatggaatattagaacttttgtgtcccccaaactgcttaaatcttaggtctgttggaccatatgtaaatggccttcttttcatattcactttttttgctctgccatcttgtaaaaatcttggaggaggccgggcgcggtgggtcacacctgtaatcccagcactttgggaggccgaggcaggcggatcacgaggtcaggagatcgagaccatcctggctaacatggtgaaatcccgtctctactaaaaatacaaaaaataattaactgggtgtggcggcaggcacctgtagtcccagctactcaggaggctgaggcaggagaatggcgtgaacccgggaggcggaggttgcagtgagctgagatcgtgccactgcactccaacctgggagacagagtgagactccgtctcaaaaaaaaatcttggaggaaactcctgcagtcctggggtttgactaagtggtctgtgcagccccttccatctctaaggtgcagtgcagtctgtcatttctaatggcagaactccatggacatggacaacacaaatactggttaatggtgtttggtatattctcttcaagaagacaaatattttgagaaatatttttatcaaaagtggtaaaagggaaacattttagagtttaaaggagttctcccaagccagcatgtattcctgggttgtccgggaaattctcggctcactcttgagtttgacatcacctttatagatgaccatagttgaagcttaactatttcagggcggcatgataaatgagaagaataatgaaaggcatccgatttgacagaaagaacacttaatttgtagttagacctgagtttagatcctggttttagccattactaccattgtgacctggggccagtttttaactcctgtgggcctcagttgcattaattgagataatttgtttctagtatcttggcccctgcattggcattctatcaatgttaatgctcttttctctttcattgtttcatactagaatgcacatcctctgtatagcacatactgtctaacataaccaggcagcgtagtttacttg

SEQ ID NO: 115479 - DNA, 1021 bp, Homo sapiens
ggaggttgaggcaggagaattgcttgaacccaggaggtggaggttgcagtgagccgagatcatgccactgcactccagcctgggtgacagagcgagactccctctttgagggggggagaaaagcactttcctactacctaagttttacagaagtgatattttaccctttctctctctctctcttttttttttttttgagatggagtcttgctctgttgcccaggctggagtgcagtggcatgaactctgctcactgcaacctccgcctctcgggctgaagtgattctcatgcctcagtctcctgagtagctgggattccagacacccaccatgatgcccagctaatttttgtatttttagtaaagatggggtttcatcatgttggccagactggtctcaaactcctggcctcatgtgatccacccacctcagcctcacaaagtgctgggatcacaggcatgagccaccgtgcctggctaagtgctgctttttaaatcagttgtgtgtttgtaaaagtctatactctagaactgtaaggcaaagcacttaacacatgaaacactacaagtgtatttaaaattgtttgaattagtggcctgtcaaagctatcctttgaaaaacaaaacaaaaaacctacaaaaccatctctactttctccttttcctcttggaagttggaacagttcacatttcaaaaccttgcttgagctaagttcttaaaaaaccttgaaaagacttacatcaagtgctgcatactgttataaaggctttacatgtattaatttatttaaaacttccaacaaccctgtgagagataaaccaaggcacagatattaagtaatttggctttggccacacaactaataaatggcagagctagtatttgaacacacagtggctcaaaaatatctatactcttaactgctttgctgtgtagtgactgagagctttgagttttcttggatcagaattgtggctttgggcattttgctgcaaggaaaccttaaaatggagatccattc

SEQ ID NO: 115480 - DNA, 1038 bp, Homo sapiens
attagctgggtatggtggcgcacacctgtagtcccagctactcaggaggctgaggcaggagaatcacttgaaccgggaggcagaggttgcagtgagccgacatcgcgccactgcactccagcctggtgacagagtgagactctgtctcaaaaaaaaaaaaaaaaaaagagaattgaatgttttcattcaaatgtgaatacaacattgtatttaacttggaaattctgaacaaatgtaagatggcagtgttggtggcagattcttttttcaatggcatagtgtcatattttagtttcattcatattggcctggtttaaatagtttaccaaggttggtgggttatctacactttaaaattaattaaacattttaaaattaagtttttggttaaaatttttacctgttgctaaataaaaaatatacagaaaacacagatttttttgggagaaaggggagttaaatgaattatccgtctaatgtcttccaaatattccttattaaattgttgaagtggacatagttattctcttaggagtattataaacataataacaataaatttgtttgcccttacagagtttaaaatgactgttaccaatttacaggttaggtagggaactgcttctcagagagggtaatgacttacccatgattgtcccaatattcagcagtaagatgtggtactagaactaagttctgttgccatattgtcaatatttgcctgaatttgtttgttgtatgaaataaccaggtttttcagttttggacattggtttagactcaatctaaaaaccattaaattagttcaggctgtaccttcctgtccgccaaaaacattatcccagttgtgtgtaatactgtatatatatctaaaacatcttatacaaatgtttttatgtaatcaaaatgagttttcttaaatttaaatacattggatttaccactgataaattagattttaatcagattcaccttgagtgttatattagggagtcagtgaagtgcccccagggggtggcaatcatgactataaatcct

SEQ ID NO: 115481 - DNA, 1108 bp, Homo sapiens
acagcccatcagtgacagccaagtagttgtgagtgactttttttttttaagaggcagtttactttgttttaaaaacatgaacctttaaaagaattccaaaagtagcacacacattgaaaattataatcaaacatactaaaggaaaatgttaaatgactcctaaaattttagcatagaagtaatcttcacctaaattttgaattaaatcttttgttgtgagtgacttctgaaggggatggagtccttattgcctttttagctcactaactccaagtgtagagaatgggctttatggtccaaatctacttaatccacgttgagagggaacagaaaaggagtttggtcgcagtgcctagcacagaaagaaatgaaatttacctattaatgtaactattaagagacttcccactttaccttcaaaacaaaaggaatatcattttcatgtctatacttagtcttccctgctgtcctgtaagcctctggttgcaaaatagaatctcaatagtatttcagagaatgggacttcttgccatctgatacctgtgaaactcttaagtgatcttgggccctgctctcttgctgtggttccagttgaagtgtggagtctcacagcaggggtccccaacccctggggccatggaaccctacaggtccctggcgttctaggaactgggccacacagcaggaggtgagtggcaggcaattgagcattactgcctgagctccgcctcctgtcagatcagcagagattctgattcttataggagggtgaaccttattgtgaactgtgtatgcaagggatctaggttgcacactccttatgagaatctaattcctgatgatctgaggtggaacagtttcatcctgaaactatccccctacccctagttcatggaaaaattgtctttcatgaatcggtccctggtgccgaaaaggttggggactgccgcctttatagcatcagctctccttgagcaactagccaggcaatgttgtatagtgtttaagatttgggagccttaagttctgcatttgaatcctggttccagcacttagtaactcttgaccctgggcaagtaacttaatctcttggaacctcgtttttcct

SEQ ID NO: 115482 - DNA, 1762 bp, Homo sapiens
tctacttcccacgtctgaatgaacttgtaagaagaaaatacttcctctgtaggtggcctggtcaggttggcctgatacctggagtgaaaagattggaacagagtaaagagcacaaatctgggaccctggaaaactgccctctggtcctggttttgctgtttaatgattgttataactaaacaaggcagtttgcagatctggctttagttttcctacctgtacactcgggggtatagatgatctccagaattacggaatcacagggttggaagtagctttgtgcaaccttcctgaggggcatggacgtgatctttgaagcagtcttgacaggtcgccattacatctccatttgtctgtgttcagcctttgcttggcgtccactctagaggtggggaaccgttggttttcaaggtagttttgagcaacttaatattaggtagcttttcatagtgtatgcattccttgccctcctgtagtcctaattctatgtttttcattttttatgtgacaaatctttagatattgaacaagaattatgtcagttctctttccagttatgctgcaaaagctctgtctgccctccctccctctttgatgtgatttcagacccttcacaattatgctagctttcctgaaatgttccagtttttcattgccactttaaaaatgtgattctcagaaaagcatataatacttcagataggaagtgagcagcacaaggcatgctaagaaggtttaaaaactgtaatttgatgagtacagcccaagttgattttttgttattggtttcttttatagacagcatctgtctgtgacatacttgatgttttatttcacatggattgattgctcatcagcaaggcctcacgttatagatgggcagcttatttttttgacccttggcagtgctttatattttttcttttgtggattattttatatctgctccttgttctgcctgctgaatccttctgaacctttcatctgctctgggaattagtgatcctgtcaggctgttgtctccttattatccttactgatcatacctttgagtccatcccaagtggttgataaaaatgttgaccagggcaacatgaagtagaggctcttgtggtaaactgctggggtctttctgctgtctttacatttgactggtggggaaccctgacagtgtttccaggctcctattgacaatgtgtttttattcttggttagatgtaatttagatgtaatttgtcttgctctgaagtcttgaactcagtttgttttctcattaatttatcgtcttctgttttgaaaattctgtatttgtttttatgtttatagacgtttggattagtggtgttagctattttccccccgacaattattatgttctcgttagcttttgtgttagtggtctttactaatactgccaccaagccctcacccatcttttctttgctttttttttgcattcctgacctggagtgcctagtactgagtgataaatgggggttgggatggtggtgctggtggagcaacagacggaagaaatttcttacattaagaaggcttccagtcttttttccagaggtactgctacaaatacatgccaagatttttcaaaagactgtaactttaaacagtttaagaatattctgttggaggtaaagtttaaaaagcaattcataaagagaaacatactgaagtcttactccagatatcctgatggatgctgtatgttgaaaaattacattttagaaaataaagggtatataga

SEQ ID NO: 115483 - DNA, 1018 bp, Homo sapiens
gaatttgaagatatatccataaatgcttgaagttctaatgtggtttttagttacagcagatcttttaaaactacaatggaattttgccattatgtcactcattatagttggaattctactttaactagatttgttttctgatttatatgaaaccttaattgcttgaagtatagacttaagttaaaattttgtagcatggattccagagattctagtttgttttttttttccccccaggaagaaaaacaggaagtactatgtccagaaactaaccaaatgaaggtgtttttaatgactaactttcttcagagaataagatactgtatggtttctagattacagtgctttagggctaaatgtggaaactggaactccaatataaggttttgcaccttaaaggttaagtatccatttgtatccaataacaacttaggaaatttaaagttgttattcccacaataattattactttgtccctatgggaatatttagaatttgtatttttgggcataatatcttatttatatttcactgtatttatagttgaaccttatatctaaatgaatgagagaaattaactcatttttgtatgtaatttaattgtgtagcattcactaattgctaatgatttgcacacatgaacaaatcaaacaaaaatctctgctcttatgttgtacacttaggtaataaggtggtaaatgcatgtatctaactctggatctcatggtaaaattaagagagtaattgtgcattacaccaggaataatgtgctgtttacaagtggatgtcacttgccaagtttacacatctgatttagaagaaacaaagatttcagacttaattgaggacacatgtctttgatagctttcttgaggtaactctagtcctttaagactatcttgaaaccatcagcaggatttattttaaaaatcctccagttgaggcagccatttaaaattgagtaattattccctggggcccagttctttattaccaaaattatagcatttttagggtt

SEQ ID NO: 115484 - DNA, 1017 bp, Homo sapiens
caaagatgggattaatcaaaatgtatactttgttcacataagtggaatgtcttaagtagattttttaaataaataggatctacatttttcttctttgtagtggcctgtctaatggagtatagtttctttcatctttttattagtgagaatttaaatatattttgatgacatttctctttcaatttcttcaccacaaccaccatcatcgtcatggagaggctaatagactttatgaggggctaactcctcagaggaggaagaaattacagaggtggcatttgagctgagcctttaaaaataagagaagatttgcattagagattggtattttctgttcttgggagggtattccagatacaggaaaacttgagcaaagacaacaggcatgtttgaaaaacagtaggctttgcttccatgaggccaaagtgtaggctctgtaaaacacaagagtagaagagtagattagagacagagtgtcaagagctctaaagtcatttctgtttggactttattctcagtgtcatagtttctatatggaaaggggctcagagtttaaaagagtaactccataaaaataattgtagcaccacatctttatttggaagattaaagtcttttatttgaattatatttcagaatcttaaaatatgtatatgtatcacacaaagaaaatacctttaaagactttttctttatgtatagtctgtggtcctgtgaggtctggagcttgggactactgtgaaataaatgataaccttgtcattcagtagacagcctgagctgcattagggtcttctgcatctcagggttggaggcttctccctgctttggcagaatttctcttccctccagtcttggccttctccattaacacacaggtactttgaactttatgtctgcaggtctgtgtcattttgctatctctttggggaaccacctgcctaaccttatgaggtcctgttcaaaactgtggttctgctcttttcagcaactgatcattattgcatatcactgtct

SEQ ID NO: 115485 - DNA, 1967 bp, Homo sapiens
gttctggacagagtctaactactggcgagttgtatgaccttgggcaattcacttgacttctatggaccttctgtcatttgataaatgattgaaaatatgaagatgtcttaaatactacttaaaatcttactgtttttgtctttggggagtactaaaggcagtaatggaatttattttaagtatatatttaaaatatgatatttgtttttcccttgaagagttttcatttagccaaatggattgatttaaagtttttgaccacagctgctaaagaaatgtgtgcacagctactgttttggtaaacacagacaagtaaccagatggtagtaatactttaaaaagttggtctatatgggctgggaaccatccaaatggaatttttagtgtttcgcctaggtactttagatttagtacacactaaatgagtttgagtgtgttttactactgcagtggctagaaagaacaaatagagtattatgtggaatacaaataatgcttattaagcttgcagttgattccttctgatagatgttccaaattgctgtcagactatatttacttactcataaacagatgtggttttgctttaaatcaggataactattccaaactgagttatgcatattttaaacaactgttacggattacattttaaaattattgttgattaagaagctgatttattatattttataaggttcatttttggtggtagttttagatgacagagagcttagatttttttttaattttttgaaatctgatttaaggtgggatatcaccagttaaaaattattttctggtctgtagtcaagaattgatatttaagatgagcaatttgttataattttaaaattttagtcactaggctgggcgcagtggctcacgcctataatcccagcactttgggaggccaaggcgagcggatcacctgaagtcgggagttcaagaccagcctgaccaacatggagaaaccccgtctctaccaaaaatacaaaattagccgggcgtggtggtgcatgcctgtaatcccagctacccgggaggctgaggcaggagaattgcttgaacccaggaggcagaaattacagtgagccgagattgcgccattgcacttcagcttgggcaataagagcaagactctgtctaaaaaaaaaaaaaaaaaatgtagtcactaattatcactaaatgagatgttggtagcagcttgaacatcagctggcctgtgctttaactgaacaatacagtagtagtaatcttagtgttaaattttacatattgaaagtattagaaaatatttccttcactttaacttagtttttcctcctggatgtgtttttttagtttatttcttaagatctttgctaggtaggtgtcacactgttcattaaatatacagaacttatatatcctgcagatcctgacattagactgtgaactcacttatttatggaagccctattcactaccagcttttctggtctgatgataggttctggctacttccatgaatttgtatgagattacttacttctagcattcatgctcacatgttttcacaacaaatacttattgagttgttattactaaatattaggcaatgtgctggggcaaatggatgaccctggtcctcagaagtgtaccttctagtggaaaggtaaatgttaagtatctgacaaatgtaaaactgcagctgtgacaaagtatcagaaagtagagcaagatggttcttgctcctcagaaatagagctagttctgttcatcaatatgaaaacaatgaaactggtctgtctttccaggttataatgattttcagcctgaaatattcttgatgattttaattatgtcggcctgcagtcatttccactgcccataatctaatgtgttttgcctgttgacatgttaaagatgggagccacttagagccattcttcgatcttgcccttcctacctcctcaaactgagag

SEQ ID NO: 115486 - DNA, 1019 bp, Homo sapiens
aattgcaggtcagaaacttatatttagttatcagactctgagtcatgagttttagtattctgtgtgctgttcatgtgtgccttctgttacagacaacaccagggaagagacctaataaaaagtctcatgttcttcaaagagaataattgagaataatgctacttaagagcacgtaatatcagagcaaacaggcaatgaacaacatataattctgtatattatgcagagatattaaatatacatattagtaaggtagcagatgctgtggtgctgaaattgacatgtaaaatagtacgctttctctgcagggctctgttccagccagcactcctttacatgtaatgaatagttaattttagtcctatggtccataggagactgatgggggactgtgaggaggaaagcattccaactccaagaacagcaggttgtgctgagatgtgctttttaatggagaaacattttataactcttgggggtaaatttataaagacggttgtgcatgtgtttttgtatttaaattaaggaattattaatacagttagacagccaggagtctggcagctatattgcaaaagggaaaagcagaatttgttgactggactgagctcaggaatatcttgcacttttaagaaaattcctattaaacctatcctttgtccaaatggagcaattcatcagaaacagacatttgagaatgtgtttaggtagttgaaatttcaggctgactttttaaaactaacctttggctatatataggaaaaggcaaatgacttttatttttctgcctcacatggaagttcccttgccatttgagatttccctatgttcataattcattaatcccatctatccaggcaatatctggtgagcatctgttatgtaccattatgttctgggagccaaaaatgaataaaatcaatctacaccctcaagcagtttgtagtctgctggaatgacagacttaaaaatgcttataactaaaatattttatgtgcaggactagggtttttaagcta

SEQ ID NO: 115487 - DNA, 1173 bp, Homo sapiens
tataccacagttttgtttagtgctaggtaggaaaggtgaaaaaaaaagcgcgagagtatattaagtatacaaaaagcttagtggttttaaaatgttaagctcacatttggaagtgtaattctattttaatctctttcctaatggaggaagaaagatgactgatgtggtagggtaatcttgtttgaaaaattgacaactctggcatacggcccagatctcttttcagattttgtgtgaaaaagaaaaatggcagcctcttagtgctattcattggtgtaaaaaaaaaaaaaaaaaaaaaagatatggttgaacctaagggtgaagtgctaactcttcatatagtaggagagtagattaaaagagttagtggatatttcacataatcaatgtctcttaccttcccagacaggagaaagaatgtcatgagtattaaaataattagcagagcattaaagataccagggacatttaacttacttcttggcctccaaattcataagaaatatgaagggttaaataaaccttgcttttaaaaataccttttccccacaggtctatgtgagaactgaatttacagggtgcttggagtttccttttgctattcaaaacatgttagagcatgaatgtttggggcgttcaggccctaagctatgttggttgagtgaaaggggaattttctgttctattcaaccaattcagggaacatttaatgcgtgccagccatgtgcctggtcctggtaggtactggggacacaaagatgaataaaacagcttacagtccactggaacagacaggcatataaacaattcactatagtgttgtgtgctaagggctataatagcgatctgcagaaagtactttggtccacaaaagagacaacaaatacttttttgtgtgtggggctgatgaggttctaggtaacagtggcctttcgctgtgttgagaaacaaacttgaaatagatcatacaggtaactagggacttacagagagaggagaaggggcatatttggcagaggaaattgcatgagctaagagatttatattgttcatctagattagagataatctacatgagattatattatgtataaaaattaaaatctccggcagtttaggcagtgggtcaaagttcgaagttgatagacttgatagcttttcctttttttctct

SEQ ID NO: 115488 - DNA, 1995 bp, Homo sapiens
ggcaaggcattaggaatggttagcgccaaaatgtgaggactcatgttggggtgagggatcaggtgagagctccagagtgtgggtggaagaatttggctgccaaaggcctacatttctcccctcccaggtctgagcatactttccccttcctcttggccctggtaaacagaattagtctcctgtttcctcttcaccaccactcctaaagcaaacagccaagcatttccaaaggttgttttgctgtgagcagcaatgggaaataaataggtaaaaggatcttctgcttcctcctcgtttacacccggtccttgggaggcaagataaagtacgcagagatgccaagagttgccacttgggcaccaaagggctctaataaacttcatctgcacttcagaattttgggacccaggtgagaggccaaagtgagcagtgagaggaagcagcagtgaactgaggtgggggcaatgtggggtgtgcaggtgacaagggatcctagagaggaagggctgcagggctgtccccacctttaagaagggtggaaggccagagctgctttctttgtattagaaaaggttggcatcagagaaagcagcttatgtttaaaagattggggcaaataatttacattcctaagcattttgcagagttacagttgtgaaaataattcaaattccaccaatttttcttttaatcacaaccccctccccaactgcccacccagaatttgaggctagacaatgattgtttcccttaagtatgcaagttaaaatacagaaatacatcttgaaaaattagttgatagtaatttgttgttggtggtagggaacccttatgtgcttcaggatttggtatgacggagtgatatgacttttttttttttttttctagttcaacacttccccttaaactagtggtacttctaggtgcccactgcagatatccaaattagtggatgagagtcttattttcaaaaataattttaaataattatctaatgccactcatatctaacacaggtattctgatcacttggattcttgtaagaaaatggtgtaagaatctacattaatgagaaaacaaccaatactgagcagaatgctgctgggaactcttagttgggcccatccaatgcatgctccgtaaatttttatgttgtttgtatggtatgctgtggtttacagtctggcctttgcattaatttgccattgtttttctctcaaatattaatgaagtgtaggagtgattgagttctaaataggcatttttaaggtagtcttaaaataaagcttttcctttaaaaaatatttttttcagaaagatgaaaaccacttcattagtgattgccggcaaaatctcctaatgtctttctataagctgtttaagcttagcattagaaattagtgctagaggatttaattagccagctcacaggatgcagtccctttaatttaggatttccctttgagaaaattatggagttgaaaaggaatatgatatttcatacaagtttccatcttgggcccttatgttgtttgttctgctgatctggaaattgtacatgatttacattaaaactttttgtttttaatatcgattattgtagtgtggggtgttagattatgtgcaatagttctcagagttgggaaaggtaaaagggtttttttgggcaatgattaactcatctactttaccagggttacataatcaagtattagttactatacatttagctaatgcagtgggtttagttaagcaatgaatacattatcatgggagcattaacacttttgcatttttagacttgcctttaaaaaaattacagaaaaactcctcacaacccttgccaccctttcagccataacattacattgccttggtttctgcctttaatttccctgggggttctttttatttaggaaaagggtgaaagatgtatttgtgtaagtactacaccagtgcttctgttaaattctttttcaacaaagaatatgttac

SEQ ID NO: 115489 - DNA, 1473 bp, Homo sapiens
taaggtttacccatattttttcacatacctgtaatttattcatctggagaagcactgtctaatagaaatataacatgagccttcccatagaaatagaatattaaccacatgcatagttttaaatattttaatagccacattttaagaagtgaaaagaaacaagtaaaattaattttggtagtatgttttctttagctcaatatatctaaaatatcaatccaacacatatcataatattcataaatattcaagaaaaatgttgttattttactttttttcatgttaagtctgtgaaatctggttactgattcacacgtcacaacatagctcaaaacactagtagccacactgcaagtgctcagtagccacatgtggctagtggctgccatattggacagcacagctctagagtcttctgagtatgagaatactgctatttatttgtccttgttcatttttgataggcctagttttgaaaggagctgctgtaaacattcttttataagtctcctggtgctgtgagatacttttaatgtggtttctgtgtcagaggaaatctacatagttgtatttcttctagtactccccatatcaggctcagctttactaaagtagctatcataaggtgtgtaaagcgtttgacttggtagagtctgccaatgttaaataacaggagtgtaaacaacgctgccacagaggtaccttcagccctccaaaagcacatgtattcaaggactttttcaagtaggcttctgctctgtcatatcatctgcctcaaatcttgctgccgtgtgaaaattcgggcagctaatggtcatcccagagatttctctgtttgtggcttcttattaaattgttcagtggaagcagagaacagaatataccatttcttcaaacttttatgcattctctcttttccctccttttttccttaggtcatgtaatctgctagcatcactttgttctcttgagttttagtaaaaccgaaagcctccatcagtaatcagttgcttgttctgcatttgtcttgcttgttttgaaggatagtagcccctaaagtttcttatcagaaagatttttcaatctattttgaaataatggaaccaatgaaacaatgtaaactaaggttggatgagagaatgtgttcacgtgatgtagttctttcatagtttctaaaataggaaagcctatcaaggatagattgtaggttacctttagactcaatatgatttcctaataacttgtgtataggaacagcttctccagagcagcaaacttgagcagtttatcccgccagctttctcttcacttaatttatcatcaaatttgctcccagcctggaaatggaccaattacatgagctgccttcctgccttccattctagtttgacaagtggtaaaaaagaagagaggtaggaagcaagccacggtgaccttaagtgatgaaatgggaaatctgctccctggagggtc

SEQ ID NO: 115490 - DNA, 1737 bp, Homo sapiens
caggcttttctgtttcttctaggttttctagttttggggcatatagttgttcataataggtctctgatcgtcttctgtatttctgtgatatcaattttaatgtctctgttttcatttctgattttatttatttggatcttctctctccttttcttggttagtctatctagcacaaacatcattaattgcctgaaaagtggtacactgtgtatacttttattctccttgattttttttttcaatcaacagtatgtcctggatatctttccattgtaatgcatggagagtctccacattcatttttatggctgcataatatttcatggtaggaatgttgaaattgatgcatatcaggacaaaacatcttttattgtttagagtatttctttcttccactttggataagttgtcatgaattcccattcattactctcagggaaaaaaactaagctctttgccaaccaaggcactcagtctgatcctgcttcttttctccaggattatcttgtattactcttcctctcatcttctattcttgggttgcatagactgccttttatttcttccatgcaccatgttttttcctgcctaagggctatgctcaagttcttctcacatgcagacccttctctcctttcctgacctttacttcatttttaattagcttttaatccacttaaggcagatctcagctcagtgccatttcatcaaggtatgcttaccctagcaatccaaggcccagtcagaattctctgatgatagagtcttccatcacccggccctcttcctctgagcagttattaccatttattatacatttatatatatgattattagattgatatttatctcaaaaacttaaaggagagtttttcaattagtgggtggccacctgttatagcttataaaatcagttttaaaaattgtgacaagccctctttaaaaaatgaaatagagtagaaaatattgagcctttgcttatagtaaggacacttgcatcaaatttttgcagattaatcatatgaacacacagacacataagcatattaggcatgatgtaaaatatatttcttattgtgggtcttgttcagcaaaatttgaaagcccctgaactaagttgtagattcagtgaggacaggaattctgtctagtttgtaccgctattctatctccaagtctagcagagaggctggcactgagtcaggcactcagtaaatatgctgactggctgaatgaatgaatgaacatacactttttcaggcaggctcagggatccactgccttcctctactagggactagtaggccttggttctaagcagatgttagtgattatttctttggttaattgagtctgctttagatcattagaagacaagaaaagtaatacaaaaccacacctacagatgtattttttaagggttgataagcagatgaaacactgaggatgaacagtttttagatctaatttttttttgtattacttatgaatcttagaccttaaaataccattttattttattggcaaataatgaaacaatctttacctccctaaatatctgggtagttttttaatttctaaggtagtctacacacatagggcttattacttagctgctatctttgtgtgtacttcagcaataaaatatttatgcagtttggcaaggtgatactacaacctggtttaatacaacagctgcactgcctgttcccatgtggcttgatttccctttttaat

SEQ ID NO: 115491 - DNA, 1073 bp, Homo sapiens
gtgtgttttgtttatacagaagtttcagtaccatacacacatttgtaaatactggataaaatgctttttgaataatattaaatcattatattttcattgggggtatagtcatcattatgattaatgtattaacattggttttaaaggaacagatagctgttcattgatgcttttgttgaatatcttctctaatatttgttataattaaaagttttttttttagttcaaaagaattagagtaaatcctgttactgggtatggccaggaatagtgtattctgcttaatcaataccatgttcataaagatttttcctgtataccatatgtagattgcaaatttccccagaattagattacaataaaatacatttaactctaatactactttacacatgatttaagcattctttggtgattcacaggcacttcaaactcatgtcatgcctccgtgtcaacagtctgaaaattaattaccattaggctatagatgtacatgagtgctggttaaatagagagttctgttttatatacttaagagtaaagtgtttattttcattgctgttgctgtgtaataggttagaaatctaccagaaaaaataaacattaaatcaaatccataaatactaataatgtaaaaggtttagtatatttagacacacaggaagtatttcatatattcttatgttagaaacagttcaaaagatgtattattagcctggtgtgcagttgttctttttatccctatatattatatacacattatgtatgccatatgaagtaatagcaacctctaattttggaattagcttaacttgaagttaagacagatacgggttctgatccaagctgttccccttgtccattgggtgagttattttacttctctgaggcttggttttataattcataaaatggggattataatctggcctattttacatggttgttgtgaaaattaaatagtaagtatcaatgtaaaactctttaacattgtatccaataaatggcaactccttttcttcctccatcttcacctgttaatgagtttttagtactttgatattgggaacaaa

SEQ ID NO: 115492 - DNA, 1022 bp, Homo sapiens
agctaaaatttagagtctttcttcccccttctccccacactggaattattaaaattagttggatattcattttatttttggctgctatagatttaaatgaactgtcgatcctcagaatggaaaaatacagcaaattctaatatttattgcttcctaaattcctggtggttaaagatacaaatatagcaagtgttcaaaaaaatgagaaatccactagtcatgttcattaaaagaatactgggaattttatttggatgagtcttggtacccaatgttcatcgctagggaaataatgaatgatgtatttattatcttgtctttttattaagaaatctataagtgacacctgaaattttgacaaatatatcagtacctgtattaattttatgagaagtaatgttgtctatatttactagaagatcctagtcttagtgaaatttttcttggctaatgatggaccacatcatgctgattgatcccaggtgtagtctaaaccaaacgatgctgttgtccgtgaagataccaaatgaccatgactggaaggggtatttgagattagccgttttacaaataaggaaacaagtcccgagaggttaggagacttccacaacatgacactgtgtaatctagggttatgcagcaagttggtaaaggatgtgatatcagtattttctttttcctattaataggatatacgttcagaagttggctgtggacaagtttgctacttgtgaactattagatatttgttgactttttccctggcaattttcttaagtatcttgtaataacttaatcttgctgctttctgtgagtctcctgaaataatggtagtgcccttccccctaatcaaaatgtaaatcaatctgtaactacaatagatagtttcgatgtattagaatgatgtttggggggcacagtgtggtggttaaataacacaagtataatgcatggtttaaataagtattttcataaaatcctaaatgttttactttttaagtaaacctttttcaattttgtaa

SEQ ID NO: 115493 - DNA, 1107 bp, Homo sapiens
aatgcaaaacaaccttttattgcttctcatgtgccacgaatgaatcattatacttgtcaaccctaaaccaagccataattggagcagctactgttatcaaagtggggccgctctgtgacagcttaataaagctgaaactgttaaattaaatctcagatgcttaactccttagcactggtggattcgttgggtccatttctggcagtgaccagtacaccaggaaaaaaaaaaaaaaaaaagattcctggcatgaaagccctaatctgatgaaagtgtacaagcgagagtatgctagccaagtaactctgcttcttggcagatggatttggagccatcagattgtcagccagaagattacaaaatctttttcatatggcccagtgtccccctccccaagatttacaatttcctgcttacatgtgatctatgaaaatttaaatgttgatgtttcaaaattaattgtaaaagtaacatttattttaactttttctttctttcaagtgaatatatgaaaacttatttgtggtagccacaggcccaatttcttccccccatgctccagctaacaaagggactgattattctgtttttcttttctaatataagtgcctatgacattcatttggtatgagttaacttttgtgatttactccctgattttcataatgtagtatgaaataggtacagatgcatagtcttaagatcctgtttattgcatctcatttacagatacatttatcttatacatgagtcagtttttcaaatattaattttactttctctacatggtgtttattttcccaaacatacaccagtgttctcaagatgagtaatgttgtatcataatcagctataagaaaaggtatatattaaaatagaaagccccattgcaatggtagaggttgtacgtttgatagaagctacatatttagtagaatctatagaacacacacctcttgaattacattctttattctgtgacatgcaaattttctggaaagcagatcacagaaataacctctggatttccaagaacaacccagtgctgattgggggtgagcacacctattgttagctgtaatggctgtctgttcagcacacttaatt

SEQ ID NO: 115494 - DNA, 1408 bp, Homo sapiens
aactctaacagagccaatctcaaggttttcagagaaaacagatttcttctgacttgaataatcaatcttgaatcataaattgagcttttatttatctactgtttcaatctacaatgaaattacttatttgctttgcctgtcagtcctgaaaaattgcagttttcttttgttaatttaagctatttgtagatggacctgtgtaagtttttgttggatatgctttcatatatatgggagagacatgttctaagtacataagaacatgtggttaaagtacagaatttattagctgtgcatttaaggatacttcataatttcagatgataatatactatttacattatatgctgaaatatgaggaatggaatgatgattctgtcaagactaatatcatttattttggaattcatatatacataactatacatacaaattccaacttacagaagaaccttctgaccacgtagctagatcgaaggttaaacaccatagtgtttaagaatattggttttaggggaacatgaatcttagaccagatcctggctcccttaatagcagcacaattttctacttctctctgcacatcagtttccttatctataaagcgggcttctttttcatgtgagggtgaaatgtgaaaatacgtgtaaagcattcagtacagggttagtgtgaaataaacattcaataaatggcagcaattattgtcaggtggataagtgtagatgccactcacttttagaagtatgttagcggaattaagtggagcaatctttgcaccctaaagacatttaaaattttaaatgtagaatctaattaggaatccaaaatgtgttacccgatattgttaggattttctttgaagtgataaaattagcatacaaaccagcattaaatattgcaaggtatattgagataccttttatactattaaattttcataatgacttctttgtattgcttgacttacagctcttctcatatgatgaatggtttgtttgagtttgattattttaactaatgacattcttatactcatttgcaaataatttagttttctattttgtaatctagcagatttataatcttttttggtaactgtgataggttaaagatggccacagattctttactactgtctcatgaaaatatgaagtctttgttccctcctctagaatctgggtgatttttatacatgtttgatcaacagaatatatcaaaggatatcttgggccacttcctgggcccaaaccttacgtgactggcaacatccacttctcatctcttcaaagatcttggagccctgagtttctatatataagaagtctggctatcctgagtcggccttgctatcagaaagtccatgctatccacatggagaggccatattgacacaggatgaaagggg

SEQ ID NO: 115495 - DNA, 2955 bp, Homo sapiens
taatcagcatgtattactattttgtgtactttatgaaaaattcttacaaatatgtgtatttatcatttaaaaaaattgctcaagataattatttcccttttttcaatcttactgcacaattgaatagccactgacattcaagattttaaaaagttgactaattttgatacctagtcaaaccaaatttttaattgtatatcttctatgtccagctacatacttaattttatgtgtttcccatattattacaggacttgtcatttaaatttcatttcatgagtatttagcctcttttgttgtcattggttttattagagctaaccatgttaaaagcctagtgtgtgtacgcaacatttctctacacttatatagtcacatataaacatgtgaaaggttcaggtatctattaatgttttataaaaatggaatcatgttaacagcttgctatttgagccaaatcaataggcagacctctaactcactcttttaatacatgcataatactaagttgctcttttaaagtctcgttttagttttaaattttgtttctatgatttcagcttaacaaaataaatgaaatgacaaaagatacttacatgaggctaaaaaacacttatgtgaggcttggactttgaaacatttgatcaattgactgtgagaggtcacggaaccaatttcttgctgggcatgggtatgtttattctgctcagcaaaaagccccaatagattcaaaacgtccttaaatgtaggactttgccttctcccttgcagtttcactatccatccacctctagtgaggagtctgggtgggagccataacagatcatcattatttatgcctctcaaatgatctatcacacatgcattttgatatgtctaccattcaggtacagatagctaagttgacctgagaccaaactgaagtaatgtctctttgttaaagacttgtcaaaagcctttccaaaccagctgaagtagctgaattttcagtaaggatatctgtgttttaatctccactgtcactgcctgatggtgtgaccttggcaagtcactttacttcccttgcttttcagttccatcagcagagtaaaggggttggcgtagatgagttctccagtctcttcttctcaattcagttgtcctttgatttttgtgttttcccttatgtctgtgctcagccaaaggtccggtgacaggaaaatgaaatcttaccaattaaggaagctctagattttgcttctcatttaattaagtctcagaacaatgagaggttatatttgaactaggttaagtacacataaataaaaatagtttgttaacctgatttccagttgaggattgctaaagtttgtgccacagttgaaggtaagtttagagtgggaacccaaggggtgggtgtgcaggtagaatttgaaccatataatccttaggaattgaataatcccaggagttgaggtgagaatatcctttattccccaaacatttcttttctccgtcaggtcctgaaacttgaaccctcttcggagtgtatggctctgctcttttgtgatgccctggcatacactatgctggggacatcacaccagtcatggaacctgcccaggagtcaggaggcagcctgtaggggcaaggtaagtgcgctggtttgttttgtagctatgttgtgtggctttgtgaaatgttaaatatatgcatttatgccctttgggatataaagtgatatttaagcattatatcccaagaagcataatagttttaattgtgcaaaaccgcacaatatagttaaaaaatacaaccaaaagcacaacccttatgcatatctttaaaggctgactgcataatcctgaaaggttccatggctggtgtcgcatctcttgcatagtgtttgtgagagctgttgatcccataagggcagcccaccacagcacctcagaagtggggagcagtgagttttcctgtgacttttgtgctgagtggctcctttgagtgtatttggcatggaaactagacttgacaattctttttgcaggacgcctttaaccttagctttaatggctgcagaatgtttgtgtttgataaacaagtgagtgaatggtggctcttgggctgacctgcctcttagtacttaggatgtgagagtattcacccttcacccttctgcttagggggtgcaggacaatgtgtgtgggtgtgttcatgaacatctggccacagaatggtatgactgatttattcacatgtgaataatagctgacacggctttctgaattgtggaaaaaacagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatggtaagtgaccaaaccggaaagacatttccatgacttacttctttgtttagtttctatagcattactggaatgggaggtggagaactgaaggattcaatgggagatggatgaatgcttggcaataggagctgagattttcattcaaatccaagttcaggaatggtttcttgtgtctttttaatagtattttgggagaaacatcttactattaaattctttttttatggatatatctgacagtggcaactttacccccttgactttctgttttagaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaaggtgaatgtgaaggagtttgtttccattggaatgggattcttagtgatgacattactaggttttgtgttctgggag

SEQ ID NO: 115496 - DNA, 1031 bp, Homo sapiens
tgtgagagccccgattgtcgtgactttgtccagttcatgatgttcttcatatcatcactggtgtgtgcaaaatacattgctaggtactttggaaaatttttctgaaatccttcttccttcaacacatacacagtctatggtgaaaggaatttatttctgaatagtataaaggataatattcaaacaaagagtgcaggacttgttatactgtgcaaaaagagagccagttcgtgatgatcatctgatttttaaaaaaaatcatattatacattttatgaataaatgttgacttttaaaatttgtttaaaatgttgtaataaaaaaggaaagtgtaaaaatgttagttagtttcctaactaactaatgttcctaaacatgtttacatttaggtaagttacagaatatgttaacttagactcctttgattgtctttgagataattctgtaacctttaggtctagaccattcttagacccatttctcttttatcttgcaagctatgaaaacttttatttccaaccattcttaggtattgctaggattacatgtctatacctatgtctttccctactttatttttggtaattgtttttccgtattttaaaaataggcttttccatagctgttacaagtctaaagtaccataacagctacttgttatgggccaagattagtaaatggaatatcttatacattttcaaaattatttggcatgatgtgttagcttattgattctgaaaaaaaacagatttatttgatttatttttgatttctcatatttcctcagtttctatcacttgacaatatatttgtttatataagcacagcatttcctttagccccatccatatatacatacacatatatatacatatatatatgtgtgtgtatatgtatatatgcaaacatatttatttggttgtttccaggagtagtgctcatgtttcttttttcctactaattatgtttatgaaagccagcaacagaaattgaatataaggaccttttcaaggaatctaggactcgactta

SEQ ID NO: 115497 - DNA, 1026 bp, Homo sapiens
tgagcctcaaattctgacaggaagccccagtgaagtagaactcattagcaaaaagccattgtctgaaatggcaagcagcacagtacaaataccagctaccaagaggattggttctttattatagcaagttcatgttcctttcaggcatttcactgaataacaattcataatgaccttattcttaaaggtttctcacaggcacattactttacaggattttctagcctagctcatgtcctatgatggttaacaatgtaaacactggttgtaaaagtcaaaataaggcaggacctctgggcagcctcctcgtcagtaatagagcctgtttgtgttccttgcaggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggct

SEQ ID NO: 115498 - DNA, 1998 bp, Homo sapiens
tatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagttgattctgcctcctttatggtatatctcttattgcacctgaatttggtgattatagacttgggtagtactacgcctccaagtgtctaatactatattgactcatccagtaaacgtttatgtgctattttccaggcactgtgctaggccctggaaatgtaatggtgaacaaaatcagaccctggacctcactgtctgcttaatggagaaggcagacataagccaaataatcacaaagataaaatatgaaacagaatagtctgttttctgt

SEQ ID NO: 115499 - DNA, 1045 bp, Homo sapiens
gagaagattagcatggcccctgcacaaggataacatgcaaatttttcccatattttttgtacatttaccaaatgttacttttctttccagggataacatttataggtatacagtcctatagtttgcatttttcttagttagatacatccactgaatatttaggaggacgggggttgaattagatacagaacagggtcccttttaggtctaagcatcatgctcctgatcaggaatgatcttcctgtctacctgtcctcagattagaatgatctgaaagacagaatgatctagtagacagaacactggactgagagtcaaggcccagcatctagtcctggctccaccaactgctaactgtgtaactttgggcgagtttcctctgggttccgttaactcatctgcatgatcaagctgttactaactgacagagttctgaggagtaaatgaaataatgcaaattaaagcaataaaaagctctatgcacaagacttgtcctggaatagcaatgatcttccattctcacatttcagagaaatacggtatctaaagaggtttctggattccattcaaaacacctgcataatgtattatgaataaatttggtagactaaagaaaaaccataccctgaaactagcttatttttaaatgtttttgcaggtgtttgaagaggaggggctcactctaaatcttgaagatgttcagcctcgaaaaagtagaagtcattgtgaccaaagatgatgccaccatgcctttgaaaaagaaaggtgatgagcctcaaatggaaaaatacattcaagaaaggtcaatgctagtgagtatgaatgaacacatagcaaaaatttcaggtagaacagccatgccaagggctggtgggacaggtgaggccgagtgaataaaaagaagtagccccagagacactcaaggtggttccagctgcttttgaaggaggtttctttctaagaggtggctgggcttggtttcagcgtattccaatttgggactcatgaactgcaactaataaagatcaaaaaactgatacagaaa

SEQ ID NO: 115500 - DNA, 1464 bp, Homo sapiens
tcaaacgcgacgccggctagctgtgggccgggccgagcgctcaacgctccagcggctgggtaagccgcggccgccgcccaccccgctgcagagctgggcggggccgcctggaggcagcggggagaggccagccgaaaaggaagaagagacgccggaggcgcgctctgcgcaggcgcgcggcgccccgcctccccagcgtcggctccccggcgggcggtgcgggccctcccactctaccccgcgccgtctcacggccccggccctagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggtgagccgcgctgccagccccgctggcccgctcggccccgtgttcgggtgtgcacggaggggacgcgggcgccggccgcctcattgattgcttcgccgggctgtgggggtgggaaggcggcggccgcggcgcttttgtgtgtggcgtgtgtgccagtgaggccggcttggggtccgcccgggcgctgctgcagttctccggatcgggccgcgggggagggaagccgggtggggaaagggcccgggtgtcgagggtcgcgtctccgggggtctctgggcgagggccgctcgctcctcctcccgcaatctccagcccccccccggggacaccagcccgggagggagcgggcttcgttagggatgaccctgcctcgcgcttccccttggtctttgcattttaccggcttggcctctgacggggatggggatgggggtgggggagcgggaagaccagcgatttcacatttagagaaccgactgctggtcggaggccgagatggggggaaagagccagttccgtcgccttaaactgccgtctggttgtcaggcctccccggtttcgtcgtcgaccatgctgctttcttttttgccacttcttgggagaaaaatgtggagaatatcgcgctgagccatgaataagggtgggggagcaatgggaagaaatattcgatgggcttctccaaggtgatgagactgtaaagggaatgataggggatgggcagagtcaatgcgaggcactgctgagagagtgggggtgggcgaccggatgttgatattttcacaccctcgggagaggtaactgagaaaagtgtaaggcgaggtgaagacacatgcttcatttttttttttaagagccttaggcttatgtatctttctctaggtttctcttggggaaaatggttta

SEQ ID NO: 115501 - DNA, 1056 bp, Homo sapiens
cacagtactgtgactgtattgatacatgtaatctgaagagaatcttagaatatttccaccagaaaggtttttggagataaactagttttcatttttataaatgtggaaacttgagtcccagatcaccataagtgacttatctagattcatacaacttgtcaatggcagccaggaacctgacatgcttagcatagaaatcagactatcaagaactatgacagtaaaggaggaattctctgttattttggaaccgtataccgctttttacagcccagtcaagatgtaggaaattgcttcttacttcggagaaaggcaccagcgagcagtgttacagagcttgattagaatgatccctggtaagaagtgctatgttactacaagttcaccaaacctaaaattgtgggaggaaagtattcttgtttcttagttaagtattggtgtaaagagttccttttaacatctgaaatcaagaggcaattgaagatttcaaaggacccatcaggaattttggagttcagggcaggcaaagaaaatctttagaaaagattttaaatggcctaattctttatatgctttgccacatttttcttctgctagttcatctttacacgtcactatataggcttctggagaatagcatgtgtaaatttaagtaataaagatgaaccatgtggcaatacagttgttctttaggtacaattatgtgattgattatgggggtgggatggaataggggcatttgtgacctaatagttcccttttccctgaggactaggacgataatgtttctgtatatggatttgttagggcttaatagttttccaagtgcttcaagacatgttagctaattggatcttcacaggaactctatgaggtaagcaggatagaaaggtggcagattattggtttataggtgaagaatctgaggttggattatttgccaagatcacatggttaataaggagcatagcctgggccaaagcccgaatcccttcactcccagctctctaagtgctgctgacagatgtttgctgattatggtgtgaagttgtatac

SEQ ID NO: 115502 - DNA, 1747 bp, Homo sapiens
tgacgtcatctctttaagggatgaggtgttttatttcttgaaatgcagctgctcttttttactttttctttgctcttacttttggcctattttttctgtcctggcatttgccttctctttttcacccttaggattctaagtgccatttcagtattcagaatctcttaactacagtttgcaatttaggacttaaaaagaggtaagcaagggataaataggcacagcacagaggcagtgaaattattctgtatgatactataaaggtggatacatgtcatgatacatatgccaaattcatagaaggtacaataccaagagtcaaccctaatgtaaactagggactttgggtgataatggtgtgtcaagataggttcatcaattgtaacaagtgtacctggtgcagggcattgatagcgcggagggtgtgtggggttaagaattgtacgggaaatctctgtaccttccactcaattttgctgtgaacctaaaaaaggttggggaggagaggatgcaaactttaggtgttaaaagttaaaaccactcttgaaataatggaccaattaatgacaaaaaaattataatttatgaatgaggattagtcatataggtgtacaattaaggtaaaattttgccattcatttttgtcatgcatagtctattggccaatgttagaagaaaaatttttcaatgagctatagtatagtaaaaaggattcacatatgtatggcaactttagcccttttttttttttttgaatcaaagtttcactcttgttgcccagctggagtgcagtggtgcaatatcggctcactgcaacctctgcctcccgagttcaagcaattctcttgcctcagcctcccaagtagctgggattacaggcatgcgccaccgtgcccagctaattttgtatttttagtagagatggggtttctccgtgttggtcaggctggtttcgaactcctggcctcaggtcatccgcctgtcttggcctcccaaagtgctgggattacaggcgtgagccacagtgcccagccacctataagatttttaagaaatgagaacaaattaggggccctaattagtgaggtacatcttagaatttaaccacagaaagctctttgatgaaatactgctgttggtcaaaacttgcctatattgttataatgaggaagttgacttgtccaaggtcatacataaaataagtagcaaatctgagattagaacatagtttgtctgcccccaaaatcctctacatactaattcattgtagactgtaattcatttttgtgccctattaatgttccgggcattggaagtcacataattaatttcataatgcttttcttttcctttctagggtatactttttattaatcaggtgtttttattaatccaactaatatttgctgtatggccatcatgtgtcccttcatctgatttctttgaagaattagttgaaggacttttctctagaagaagttagtttgccagctacaacaaaataataagtagctattgcactcagtacaaatgctctgtggctctgtaatttgacaaagacattctagttttctccagtctcttttgctattgcctatgtttaaactctcttgctcacaagactttagacaatttaaacaggaacaaatgctatcgtaaggatgtctcatattagatgagcaacaatattgtcaggaaaatagtaacaattatagcaacttgctaaagtgctgacataatagattga

SEQ ID NO: 115503 - DNA, 1658 bp, Homo sapiens
tgtgtttattttttaaattatagctgatactgagagttgcctataacttcgctctaagtatatggtaagtgctttctttatatgctctttggttgcagttttattaagagtaataacattgcttttaagtgtacatgctgttttgggtttccattaagaacaatttcttaattaaaaataagtagagcttcttttccttctattactcagattttttcctttttaatctttacaggtgcttctttccccattctctttaagtattgatgttcttcagggcttgatcctacccctgcagtacttctcacatagtattctctttctgggtaaactaaatgcttctctttagcccacattggctacagacatgtactgttcgtatatgtcatggattactgcatatctccatttggatatctcataaacactcaaattcagcatgtccaaaattgaacccatcaccccttcctcaagtttacttcagtatttctcattcactctattgctccagtcagaaacttggttgtcttccttgactccttattctttcttgaccttatagccttattaccatggtctcttaatttaatgactcaagtaactcttcctgcactttttctgtacctaccgctataacttttggtcatgctagcattatgtcttgcctgtgctgttgcaacaaattcctaataggcctctctacctaggagagtaatttggttaacaacaacaacaacaacaacaacaacaaaaaacccaaaacaataatttggttaattactgtttcagagtaacctttcaggcatgtaggtttgaccctctgatcacaggcttaaaactttgaaagtgttctctacttctgttgccctttttatgaagcccaagtctaacatggcttatggtggaccctgaacaaactaacctgcctcttcagtcttattcttgctgcttatttgaggcacactatactccagacaagctgaactttcttggaacactccacttctaactaacctagctaactgctgtatctccttttgattcctagcctaagatgggtcccctgctttatgagtggcgagtcccctttgtttgctctgtcaaaaaactcattgtattgtattatatgtttgtgtctggtcagactcaagttcctttatattccccactgcctagcacaggcactctgcacactttataaattatctgtttgctgaatcagtgactaaatgaacttccagcttctctttcactgctctgtctattcaagttttgacattctaaaaaattgacttgtgttgttcatcctccaggcatcaagaatatgacatgacaaggtgtgtgtcactgtttttaatgtatacttgtaattttctctttaagtttaattgcctgttttgaatagcaatatagtcccatgactaatgaagttccaaaatgatatatatgtatgtatgtatgtatgtatatatctattagtctccatcctacccctaccccacagctagctacccagttcttctccaagagacaaaaatattactagcttcttatatttgtagagcattacctctttttcatttttcaggaaaatctctgcttatatatctctatctacatgtagtataaatatgtgtaaatatatacctttttcctac

SEQ ID NO: 115504 - DNA, 1035 bp, Homo sapiens
gaggcatattttcaactcatgagtttaatcatattgagagtcaccacttagaggttattagttaccacttatacatggattattttttatattcatcttcaaaatgagggatcttcattggaggatttttgtagtttattcttcctggtatatcattagcaacctttactgtacattagaattacctggaatagattaaatcagtatattttaaaaataaatatttattttaaaaataaggatttattttaattataaataagtatttttaaaagtattaaaaatatttttaaagtattaaaataaatcagtatttttaaaaatactgatttatgggccccactcccagagattcagttttattttacctaaagggagaccctggcatcagtttccttttaatagtactcatctgatttgaatgtgcatccaaggttaagacagctacattatttgatatctttttttgaggtgaataaaaggaagtcttcatgaatgaattagaggaccaaaagtttgctgccttaatctgtacagtgtccaagtcttagaaactcttatgaaacctttttaggataactgacaatgtacattttatagtattctgatatttcagtttaacaaggggttctaagctgtctagaactaatattttataaattaccccctattattcagaaatgatgattaaaacacatattattgtgaagctacttaacctctctttgtttcagtttcctcatcgatgagatgggaatagcagtagtaatgacctcataggttgttgtgaagaaagtccttagatcagtgcctggctcatattaattcctgaatatttttggagggtaggggaaaatatataaaggaacttgaatattgatagcattaatagtaattcattaagattatagtttttcttcattttgttttatattcttacatgtctgcctacttttgtttaattgaaagaagctcagatcatgatacatatgagggagtaaagatagaaaacataatgaacattttttcctttca

SEQ ID NO: 115505 - DNA, 1046 bp, Homo sapiens
tacattggtatctcaaatttttatgccagatttagattttcatacgtaagtttgcaaacattcatttctaataattataacaccagttttagcagtattgttattttggtttatctaggaatattactgtctttgtaattgcttgaatactatatctgattgccctttttcataaaaatgcctagaaaggaaaaaattagagttaatgagactaagaattgaaggtgttacaaaggaaatacttttgagaccaactctttttgtcttcaccaagtgtactgggtagtcagttgtaaaaaaaaaaaggatcaaattaaaggacatatgaatactagatagagatatttgtgaagaatatgtttaaaggggaatcataattgttaattgtagaatttttttttagctttctgaagagtccacttttccttttcattccctctttctactcctgcctcataaaatataagtttgacttttataatagtttttaagaaattattacaaatacaggcatgtttctgtgtgtatgatttagtaaacattgtgtttttaccctatgtttatgtttcttaactttatcaatatttatccttctcctctatctcttatacttaactattatggattgaggagttacatgtttttttgtgggtagggttgggaggtaggggtttgatctacttagcaggctcatccctagttctgtttgaccagaactttttcctgctccttttgttctgtactttcttcagttttgccttttacaaaacaaaacaaagacagcagttatataaaatgttctacttgtagatctgttttccatctttttttttttttgtttttttgaggctgagttttgctcttgtcgcccaggctggagtgcagtggcatgatctcggctcactgcaacctctgcctcccagttcaagcgattctcctgcctcagcctcctgagtagctgggattacaggcgtgtgccaccacgttcagctaattttgtatttttagtagagacggggtttcaccatgttggtcaggccggtctc

SEQ ID NO: 115506 - DNA, 1049 bp, Homo sapiens
ttatcctggctaacatggtgaaaccccgtctctactaaaaatacaaaaaattagccaggcatggtggtgggtgcctgtagtcccagctactcgggaagctgaggcaggagaatggcctgaacccgggaggcagagcttgcagtgagccgagatcacgccactgcactccagcctgggcaacagagtgagactccgtctcaaaaaaaaaaaaaaaattaatatttgatagggtaaatcttactacattgttctttcaattttcaagaaaaaaatgttttgcatattattccttaagatgacaatatagaatcattttgtcaaattctaaaaataagtggaaatgggtaatttgggaagggattgataactttagtaaagttggtctttttatcctagaacaaggtttccatttcactgttttatttcctaatattttactgcatttaaatcatgcaaattcttcttattacattaagactctgaagtaaatgaatgtcaggggccagtttgtatttcttgaattgttttggtatatgttgcatattattcctgataatattaaatgctctatatggggaatctaggatttgagtaagaagtgatagcacagttctttctggtgttttttttgttttttgttttggtttttttttgagacagagtcttgttctgtcactcaggctggagtgcagtggtgtgatctcagctcactgcaacctccacttcctgagttcaagcgattttcctgcctcagccccctgggtagctgggaccataggcgtgtaccaccatacccggctaatttttgtatttttagtagaggcagggtttcactatgttggctaggctggtctcgaactcctgacctcaggtgatccacctgcctcggcctcccaaagtgctaggattacaggcgtgagccaccccgcctggccctttctggtgttctatatgggttacattttgttattcatattaatagtcttataaacattataaacattataactgggtttttacagatagaaggacagaatgcattacagact

SEQ ID NO: 115507 - DNA, 1054 bp, Homo sapiens
tttggatagaggaaaaaatgtgtggatgaagctaatagggtgtctaaattaaaagatttagataagaaatggggtgggagtgaaaatagttgtttgtattagaaatttagatttttcaggccagacgctgtagctcatgcttgtaatcccagtactttgggaggccgaggcaggaggatcacttgagtccaggagtttgagaccagcctgagcaacctaacgagacctcatctctacaaaaaaataaaaaattagccgggggtggtggcacaccagtgatagtcccagctgaggtgggaggatcacttgagcaggaggtcaaggctgcaatgagccatgactgagccactgcagtatagcctgggtgatatggtgagaccttatctcaaaaaggaaaaaaaacatatttagatttttcagcatgtgtggtaaataaactttaaggataaaaggcagatgaatccaatattgaacctttgacagtagatattaaccaataggtcaaagaaagactgttagtagaggaaacatattagtttgatttatatgaagatattgatacttgtttttgacctaaaaagaagggaatttcatttagttcaacctaagagaaatgacaagaaaatcagagaatatggttattatattgaagtgtttaaataacataggctttgtactcagggctaggttttaacctcagttatgccacattctcagtgaatgaccttagagaagatactttatttctgagtcatttttctcatctataaaatcaaagatggttgaaggactaaataatataatgcctaaaaatgactaatcctaatacctgacatacaggaggtacttaataaatattttatatgggtatgaaatagggttggcccaaaagagacataaggaattacatagatggggtgagaaaagtcataatttggttaaatataactattgaagatgttagcaaaagcaatttaaatttcattgctaaaggctgttctcaaccagagttcttcatctgaatcaccaaccactgaaaatagagtgaatattt

SEQ ID NO: 115508 - DNA, 1038 bp, Homo sapiens
cttattccagcgccaaaccttgtatcaattaaactcattgcttcctgcaatacagtattctttgtaaacaatgttagttagttctaatactttgtagcagatacttagcccaaaatattctagagtaacagatacacttactactttttgttaccatgttccaaatcactgttactaaagcagggcttaaagcagtggtccttaactaggagcagtttggcccccaaagcaaaatgtatggatattttgcttgtcacaactaaggtgatgctgctagcatatagtgggtagagccaggaatgctgctgaacatcatacagtgcacaggagtgtccccctcaccttatccccatacaatgtcagtagttccaagactggaaaaacctggttcaaactaagagttctaaactttgaaccataaaaactaaaaatgagattctggcctcagtccatcacttatgtccagaatttttaagagagactgtagttgcttttagactctttaaagtaaaccctgcattgcatctagatatgttacctcccaaagatgtggaaaaccagagcaagataagtactccctatacatatctttccattttattattgcatctattgggcctctgtagagccttaatttggagaggttagatgaccagaactaatccaggggagtatgacatcatgagtttttacagcctccatgtttgagagagtgtgcatttctgtcacctttgccacacccagggaattatcttgccatgactcagcattagcctttagttaagtattggtgcgtgtgtacatattattattgctatattgtcttaacaaagtagattaaaatggaacagcatctaagacacgctctagagatcggagaagttttttttgtttgtttgtttgtttgtttgtttttttgaggtggaatcttgctctgtcacccaggctggagtgcaatggcacgatctcagcttactgcaacctccgcctcccgggttaaagtgattctcctgcctcagcctcccgagtagctgggat

SEQ ID NO: 115509 - DNA, 1040 bp, Homo sapiens
ttcttaccacaaagtaagctagagaaaagaaaatggtattaagaaaatcgtaagaaaggagaattatatttactattaagtagaagtgcatcatcataaaggtcttcatcctcatcatcttcacattgagtaggctgaggaggaagaggcaggctggacctggtgtctcagggctggcagaagtggaggaggtggaagggatggcaggagaggcaggcatactcagcgtaacttacattgaaaaaaatccacataagtggacccaaacagtttaaacccatgttgttccagagtcaactgtatttcttaattatactgtctgtgaataaagatgttttatgtctattgacattttagagaatactatcttaagtatgtttgattatatttaacagaattgtaatttggtttctgttgcacaaagatgcttattggattatcgaatttttgtccttgtaggaatctattcggtggttagaagatgaaaaggccctcttagagatgactgaagaagtagattatgatgtcgattcatatgctacacaacttgaagctattcttgagcaaaaaatagacattttaactgaactgcggggtaattctttttccattttaatgtttgaaatctgattggtattggtatgtatattggtgagagggcttcttcgtattgcaagaggacatacgaagtgaaaattaggggcactgtttagcatctattttccagaggtataaagacaactaaccattgtggtttttctaaaagtcatggcatagcatttcaagttttctctcatattttaagaagacagtcatcttaaagagagaaaatgtatttttaacaaatttataaattttatgtacctattcagatctttagtttggtaggctgatgcttatgagaattatcttctttctgtgccttttttcgggtctcattctgttgcccaggctggagcacaggggcgtgatcatggcttactgcatcctcaacctcctgtgctcaagcagtcctcccacctcagtctcctgagtagctg

SEQ ID NO: 115510 - DNA, 3447 bp, Homo sapiens
tgcactccaacctgggtgacagagtgagactccatctcaaaaaaaacagaacagtaacagtttgagagcaccaaatctagaagttcttaaattcatttcaaaatttcaaaaaagttaactttttaaacatcactgtactttcaaaaaggggaggaaaattgagattccaactttattctgaagtctacagagtagggtttcgtaaccttgacactgttaacatttggggctaggcctttctttgttgaggagtgttatcctgtgccttgtacaatatttaccagcatcgttggtctctgtccactacatgacagtagcaccacaccagttgggataaccaaaaatgtctctagacattaccaaatgcccgctgggggccaaaaatcatatccagttgagagccactgttattgaaagatagcttatcttcacagctgcatgtaatttgtctgacaatttactaacctatttctagtttttacatgactctagagcagtacatgaccagaaaatgcgtaaaatcaagaaatatatcatttagtcatccccccttcacaatcccccttcctcacagtgaggacaaaatgtaaatttctaaaaattcaaatatattttacatgttcatagctttaaaaaggtaaaatagggggtgctgagcacggtggctcatgcctataatcccagcactttgggaggccaaggcgggcagatcacctgaggttgggagttcgagaccagcatggccaacatggtaaaaccccgtatctactaaaaatacaaaaattagctgagcgggtggtgcacgcctgtaatcccagctactcgggaagctgaggtgggagaattgcttgaacccatgaggtggaggttgcagtgagcctagatcgcaccattgcactcaagcttgggtgacagagtgaggactccatctcaaaaaaaaaaaggtagactatgtattttacaatgtgaaacctgcctatactctaggaggaattccaataaattaaaacagagaactgtaaatgtgccaaacagaacagaaagctattgaaagatacagaaaaacaggtatttctggaaatctgtaacaaaaaactttcgcaatagttgagcattctatttagttccgagtttctagacaacaaagaacaaaaggaaaaatactgagttactgttaggaaataacacagctgacttgattgaacccataaagttgtaaactcttactgcgtgtaatacaatacttattccctctttcttttctttttccaagataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggagaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaaataacctgag

SEQ ID NO: 115511 - DNA, 1086 bp, Homo sapiens
gcctctttcattagagcctttatgtcgtaatgaatttgactaaaattatcttagactttcattatcccaggcctaagaactcactggcatttgtttcaaggtaactgaacaagaagctgtttggaattggcagaagtcagatgaaaaaccaatcttacatgccccttcttcctctcttgagctgttgtttatattcaaattaaatacacattgtttctctctgtagatacctatgtacttaatagattctagttagtaaactgcacatgcccaataactttgaggaaatttagtgaaaatgaagaaaaagagaaaatatttctctttagacctgaggttatgtttaggctggcccatagaaacaggtccagataaatttctaaaaaagcaaagtagatatttatgaatagtattcaatgcctaggattaacatctaaaatgactcagtagtactgctagccagccaataaaatataaactccatttgtcttagttatatagaactgtgtttccagcttagaaaaagtcaaaccaatgacttttagaacaatctactctcattttttattcagcctctagaacatggaagctttaaaagtgaattggctaaataggcaagaccttctgaaagttaacatcttaatgattaaaaacagtaagtacaggttagtaattacctgggtaattaattgaagccttattctgttttcataagacttacttgcttaattcaagcaaaacaaattttggtctaaattacctagataattatgacagctttttacttgagaagtgtagaacttgcttcaggctacaaaactgtattattcctaaatggataaccaggtaggattctaactggcattattgtatgcttaagattgatttaacaacagctattcccagtaaggaaattttaaaaatcagatccagttacatgtattatgatttttctaccttatggactattttggagggataagctattaagactaagactatgaatgagagttggggaaggagcaggaagggaggaacctgcacaccacattggaacctgcacaccacattaacacaaaggcaatc

SEQ ID NO: 115512 - DNA, 1660 bp, Homo sapiens
ttgtacattccataagatccttaaaagacaatatataatgtataactagcacaattttgacttgaattctgacaggtcagtgctgctgtgtatcctgtgaaacagatatgagcaactttgattactccaccctgtcctctaactactgacagttgtttttagccataacaagaatcagattcagcagttacaggttcctcaaagctgtagatatgtgtagcttgcacaacttaaaataattgtgtagtttactgtcctctgaattgtgaccacgtcttgtttcttgctcacatagcagttacaaatatagttattactttctttgtatagaaattgaaataaagttcatatggctcaatagcagatttctggttgtgagcctcatgcgtatcatttgtgtaacagtgtgtgcgatgtgatgtttgctatctttttagcttccagtttaattagaacagagagagaaaggccaattttctttttattttttatgactcagaacctatatggtttaatgtatcacaatactatctccattttctcttttatgggcaaaaagtcattagataatctgcctaagtataatagaaaaatattaagctagattaagaaaaatatttggataaaatatgtgaattaagtgtaaaatccttttggataaaatatgtgaattaagtgtaaaatccttaatattcccaaggcttgggcaggtcacctctttgagaaaaatgaggtggttaaggtcaaatctgtaggaagaaaatgcattattttgaaaggagtaacaattgctttaaaatttaatttacagttgtaattatttgtgaagtctgaaactaataactatttcagaattttaaagaagaaaatggctaatatagacaggattactaattcaaggtattccaagtttttgttaataaagatcagccacttttaattagagatccaagtcttaatgtaaaaatcaggctttccaaagtctcattaacagatatattaaaggtgactattttatgacttactgaactaaaaaaaagagtcaaggtgacctcattaaagatatgtcgttcatttattctgaatcttatattgatagataataccagaagatttcagcatagcagataaaatacagcaaatcctaaccagcacaggttttagtgacaaacgggcccgttccatggacatagatgacttcatcaggtaattacatttttgttttcctaagtgtttacatttctttactgtgacaccttcagattggagattttaaaggcttttaagcggtataaggtgctacctgggagagttattgcatagcacttccatggcatggaatagtatttggtgtagaagatggaggctagttagctgcagcagaatgaacattttctttaagaacagtagtaaagaacagtccgagccagaagattgcctttgtgttaatgtggtgtgcaggttccaatgtggtgtgcaggttcctcccttcctgctccttccccaactctcattcatagtcttagtcttaatagcttatccctccaaaatagtccataaggtagaaaaatcataatacatgtaactggatctgatttttaaaatttccttactgggaatagctgttgttaaatcaatcttaagcatacaataatgccag

SEQ ID NO: 115513 - DNA, 1055 bp, Homo sapiens
taactccttcaaggaggtttaggtgtgttacacaggaagtatctgaagtcatgtctgttttgaatcttatttttgaaaatgatacttagatttaaataaacgccatgttctttgttcagatgtgggaccattttgtttttccttccctttctttttttaagatggggtttcactatgttgcctaggctggacttgaacttttggtctcaagcgatcctcccacctcagcctcctgagtagctggtactacaggcatgcagcactgtgcctggctttattttttcaaattaaaaaaaaaaattgtcatgctttgtcaaaaaaaaattctgaggaaaagacatattcagtgaaatgcgccaaagtgcaaaaatcaaatgtatgtcttacttttgcatgtgtgtgccagccagatcaagattacagaacattttcttcacttcagaaagtttccttcaattgtatatattaaaagacaaaataatacctagtgggcatagacaagaacaagaagtttgtaatttgaagaaaatgtctatcttctatttcaggaatgggatggtctagtaaggataacctttgttaggaaaaacaagacactctctgctgcatttaagtaagtattacactaatttctaatgtataaagggccagtgctccagatactatgctagaatttggtccttttcctgagcagctaccctaaagcataaagattatgggtccagacaaacttcaccttttaaactatctttagagcttgggaggctctaaagcaaacttaatgaagaaagtttgctggagttgagagtcagatcacattttttggcaaaacaggaaaacactcccaaactctgaccatatatctgctctagttttttgttggaaaaatgaggtgatgatggaccccttccacacttgtgaaggatatgtgtcatgtaattaacctgggaaaatgcagctcatcaatttggggttcaagggtaaaagagaggtgagacacagttttacagggcttggagatttttttttaggggattttttgtggagagtctaga

SEQ ID NO: 115514 - DNA, 1049 bp, Homo sapiens
tctcaaaaaaaaaaaaaaagtctacatcttttaacccgtcaaatcaaggaaacattgaacgtcacaatctgcctcttcagtctcacctcttccttaaaggtgtttgctaccccataaatatattactgctactgaaacaattttatttcactttgttttcatagaagaggtgatggactagtgctgatttgaaacatctcatccagtcattaaaggcttatatttgcaagctatcttgccatgaggagtacagcaattataaaaacaaagccagctctctcattctgtggcaataaaaaaaaggctgaatgtgttctcctaccttataatcagctgccaatgctttgctatttctctcccaagaaaattcattgcagttaaaattcatttatagttgacaatgaccattttccttattcctttctgctttcttttcaggtgtgctatacttatgtttcaaagagaatttgccctccgactggttgcaaaacctggagataagttatactgcagactctcaattaatacacagctgttggcacgtgtggaccatctaatgaaagtaagtgaattttgttttctttctcttttttctgagatagaatctcactctgtcacccaggctgcagtgcagtggctcactgcgatctctgcctcccatactcaagcaatcttctcgagtcccgagtagctgggactagaggtgtgcgtcaccacgcctgactaattttttggtattttttgtagacacagagttttgctatgttgcccaggttggtcttgaactcctgggctcaatgatccatctgccttggcctcccaaagtgttgggattacaggtgtgagccaaagcacccagccagtgatttttattattgaaataatctagcttaattcatccttgagcatccagttgtgccttctgtgaggatagcatatctggttactaaataaaagttgcctttgtgagtactacttaaatactttttcattaacaggtgggaaagaataacttcagaccaccgcccaaggtggaatccagtgttgta

SEQ ID NO: 115515 - DNA, 1506 bp, Homo sapiens
ggagtttaattaggaaggaaatacccaacgcctcccctttgtaccctataatgctggtgcctttcactggccaattccaaccagaagttgaaaggtaagggagctgaactgcattatctgtaggatgcagagaaaagcggataatagatctgggagggcctttcatggtggctcacacctgtaatcccagcactttgggaggctaaggcgggtggatggcttgagcctaggagttgaagaccagcctgggcaacatggtgaaaccccatctctacaaaaaattggctgggcatggtggtgcctgactgtagccctggctagcagggaggctgaggtgggaggtttacctgagcctgggaagttgaggctccagtgagccatgatcctgccacttcactacagcctgggtgacacagtgagaccctgtctcaaaaaataaaaataaaactaaagatagatctgggagccaaacagagtaagaaacacattgtttaccatgtaaacagggtctatatagaagtagggccaggagctgtggcccacatctgtaatcccagcactttgggaggctgaggcaggaagattgcttaaagctatgagcttgagaccagcctgggcaacaaagcgagacccaatctctataaaaaataaaaaggctgggcatggtgcctcccgcctataatcccagcactttgggaggccaaggtgggaggattgtttgagcccaggagttttgagaccagcccgggcaacatagagagacccgtctctattaaaaataaagaaaggaaattagcctggtgtgctggtacacacctgtggtcccagctgcacaggaaggtgaggtgggaggatcccatgagcccaagacttcgaggcagcagtgagctatgatagcgccacttcactccagcctgggcaacagagtgagaccccatctcttaaaaaaaattattttttaataaaaataaagtcagtgaaacctcagctgaaattgcaataaaatttcaatttcggccttatttgacatccattttcatttacttgagaagttatctatgccatgtattgtgtatctcagtagatgtgacatactaacagtaagagcaattgcattgtacgctcttctctaacaacactgactgcagagacatgtagtgtatttttttcatcatctgttgaattacaaagcatggagacagatgaaacatgattctattgattatatgagtagaactctcacataatctggttgtctacttttctgggtggtggtgtttgtttgtttgtttgtttgtttttgagatggagtctcgctctgttgccaggctggagtgctgtggcgcgatctcggctcactgcaacctctgactccctggttcaaacaattctcctgcttcagcctcctgagtagctgggattacaggcacgtgccgccacgcccagataatttttgaatttgttagtagagacagagttttaccatgttggccaggctggtctcag

SEQ ID NO: 115516 - DNA, 1050 bp, Homo sapiens
tttgagcatctgatgaaagctatggccgtagaatattagagctgtgtgcagacattcaattttgtgtacagtttctgctcttctgcatccttgaaaccatacatgggttgaaaattgaaaaatcttcgcccaacacgtacagtcctttcccatttgaacttgttgatacgaacagagaaggtaacaagaggctattggaatatttccagatagaaagcagaatgccaatcccagaaatgctgttgctgcttttctgactcctaaagttgaacagtattcctccaagttaggagaggtcttagattttcatttgcaccaaatgttattgaggtaattttgttaaccacgtagatcatgaagaaatctaaaaatggagtcagattaagagctcttatcggagcacatatgagtaaagatgttcaggtgtaaattaacttctgtgttctgatgttgccagaagagctaaagtgtttgtgcttgcttttaggctgccttaagaccaactgatgtagtgctggaagttggacctggaactggcaacatgactgtaaagttgttagaaaaggcaaaaaaggtagaaaggggatttaatgtttggtatcacaaatgactatgttagcaagctcagttggtttacaatctaaatatgttttaactaattgctattattttagtagtaactcctgatcccttgttggaaattttgtcttagaaaatatgagatatttcagccaggcgcggtggctcacgcctgtaatcccagcactttgggaggccgaggcaggtggatcatgaggtcaagagattgagaccatcctgggcaatatggtgaaaccccatctcaactaaaaatacaaaaattagccgagtgtggtggcaggtgcctgtagtcccagctacttgggaggctggggcaggagaatcacttgaacccggaaggcagaggttgcagtgagccaggattgcaccactgcactccagcctggtgacagagtgagactctgtctcaaaaaaaaaaaaaaaaaaaaaggaaaatatgagatatttcag

SEQ ID NO: 115517 - DNA, 1493 bp, Homo sapiens
gcacgtgaatacttctttggacctcagcgatcccagaacctaggctactaaaacatccataggcttaacctcatcatataacttaaacagccttcgcaacaccgagagcaccacaccaacaccttcttatccagccctggttgggacaagggctccaactccagactgcagtcctcggtagcgcggtgtcttctgggatctgtaggctcccgcggttcggccttcctccctctgtgactccaattcccggcagtcagtgggctccaaggtccgccctttttctggaggaggagctcagagcgtacgggagggggcggacccttgcccctccggcgcttgggccagagtggtgcgggcggcgcgtggcggcgatccccacgtggtggctttctcacgctagccctctttggtcctccttgacgtcccgggcctgtgggcccgctttctgccgagatgccgaaggtcaagtcgggggccatcggccgccgccgcgggcggcaggagcagcgccgggagctgaagagcgctggaggtgcggatccccgcgaggaagctggggtcggtcgggtcaggtcttccggcaggacctagcctggggtgcggaccaagacctgatcggcagaggccggtcaggacgcgctcccgtgagcgcggaaggcaggggtgggtccccgactcggccgcaggccctgcgcgtcgccgctgacttcctttccagctggaggatgaacttataaagagtttgtcagtcctggcgtgacgtttcgtggccctggttggcgcagaaatcttccccatacccatgcagctttcttctctggtactgcctaatatctaatctcagtaggaaaattaatgctgtttcgtattttcttacaggactcatgttcaacacggggattgggcagcacattttgaaaaatcctctcattattaacagcattatcgataaggtgggtgtggaagaggaaagggagagagttgttggtttattaattttattcctatgaatacataagcgcagaaagtctgcctgccgtaaattagatgctctgtaaatatttgttgaatgaatcaaataattgtctaggattcttgggctgtcttctgcatgataagcttcattttgtgggtctgagtttctcctggttcccaattctgtgtctttttgtggattatctactttatagctggacctttgtatttgttcaagataattattcttctatttctaatcacctttttgatcacttagtttttatgtactccatctatttatgtctaaactacacattagaaagtttgttccccagaaaaacatatagtactacatataaattatttggtgtatgctagtaccacatataaattgcttggagtattactgctttctgagttattgatgttctcttatggttatggatgattgggtgttaggaagtgaaatacacacggtgcagattacacttatggttaaaagcaaggaaagcatc

SEQ ID NO: 115518 - DNA, 1856 bp, Homo sapiens
ctcttgctattactcaggagtaagcgccaagcaatttgggtaacttaaaaaataaatatttgcgggagggagggtggactgatgggagtaagattctttaaataactcttctctgctgtgacggatccgctattgatatctagaatataaagcgtgaaatggttctgattgaagcttcaatcaacgcaggaaacaattgagctccctgggagtcggagaaaccagacctatggtttccatggtgacagatccggctagtccggactcctggctctttatactgcgcaagcgcactgcgcaagcgcacacaactgatttggataccccgcgccttttggttcaaagacaaagcccctccttccccttcccgccgttcgcctatcgccttctctctctgccggtcgcatgcgcgctggtctcctgtgacgtagttttcgcgcgtccgcgtcgtttggagctgcgacgccaaacatggcgtgttcctagaagccgctttcggcatcagtaggcggcggcgtggggtctggcagcgtggggagagggaccaaccgacgccacttcgtgttgggaagtgggagcgggagggccgggcaattcccgaccgaaccaaacggtgaggccccggcccgagagccaccgagcgcgcgggagtggaagggagtgggttgggcacccgagtcccgagaggcgggaggaaagtggggctaccaggagatgagggataacggtagcgaggcaagggcggcctgcagacttggctgtttgcgcaaccttaggaacccggggaactgggggctggccgaggcagcccgggagtgggcagcatggtagtggagcaatcagggtgcggggtgggagggaccgtatgctaggctgagcagaggcgagtgtacccatcgtgaccgcggttgcggacctgggtgatgcatttgcccttgggggataggtggtgcaaattttgagataaagtggttatctcgagtataagaccgttgtgcattgttactgcgcacgcgaccttgttgctaatagcaatagtgtgatagctttaaacattagacccttacatgcttttaatgaaaaagtgaaggtagttgtccgtttatagagaggagcttcatggagaggtatggccgccaattctcaagctcagcgactcctgtagatttatatttgggggtatttgtgattcagcaaaactacttttgcttattacgtgtgtcattttttctttattattttgtgacatgttggtgaatgagagaagtactatctgaaagtgatttgactaaatagcaaggactggtaaattacctactagtgccaaggttgcagttgacatacctcctcccctccataatttaaacgagctcagttgtagcgcggtagtgcccttcagatttcggttattcttcagaaggaagaatagtttgtagccataatgcttttccccctcctgggataggaattttcttcctccattttcatgttatttcaaacttctctgttcagtagaggagcttcagattaagggcagggtgactcttctataggagacatccattgcatgacacatattacatctttcatcactgaggaaaatttcggtgaaagtagaaacattttcccttttggttatgatgggactggtattttctctgtttctgcagtaacctagcacagggtatagtagaaacaattaattatagtagtggcttgtggccatatattatagtctcagggtaggagggtggtctccgccctagttgaacttctaaggccaaagagaattttcaccacaaacacatttggctgtggtaatgttagaggttttaaacaaatatgtaaagattatc

SEQ ID NO: 115519 - DNA, 1359 bp, Homo sapiens
gacatggagagaccccatctcaagaaaaaagaaagagaaatataaggttaggatttggaagaaaaaaaaagccattcagaaggaaatcccaggtcaactctgaaccagctaggtgttaatttctgagtcttatgcattctttctctatggtgggaatggagtagtatacatttgtaatcacattagtattcagttataactgctatgtacgtggttaacagatttagtagttaattttacatgttatataatcaatgcaaaatcattgtagacatgaccctgggatttgtttgatagaaaatatggtagtgaattttgcttaagaagtaacataatctgtgttttccagtagatggcactatagctctctaaattcttaaaagccgtaagaccttttttctcagtctgaatacttcaaaatgcatataaaacatgtccttgaataatattggaaacaacaagaatattttcaggctgcacttgggatactatattacggtttaaagcagacatgtctttttcttttttttttttttttgagacggagtctcgctctgttgcccaggctggagtgcaatggcatgatctcggcctactgcaagctctgcctcacgggttcaggccattctgcctcagcctcccgagtagctgggactacaggtgcttgccatcttgccccgctgattttttgtgtttttagtagagccagggtttcactgtgttagccaggatggtctcgatctcctgacctggtgatccgcccgccttggcctcccaaagtgctgggattgcaggtgtgagccactgtgcccggccggagtaattttttacataggattaattcataattttggagagaaatatggtaagtagtgatgagaaaatgtgcattatttgtttataggcaatggcccagcagcacttttctactgctttgtccaattgaattttacgtgtctgctaaaattcattttgttttagtggttatataaaggatacaattataaatgcttgtcttggctgggcacggtggctcacacctgtaatcccagcactttgggaggtcgaggatcacctggggtcaggagttcgagaccagcctgcccaacatggcgaaaccccacctcttctaaaaatacaaaaattagccaggtgtggtggcggatgcctgtaatcccagttgctggggagggtgacacaggagaatcacttgaacctgggaggtagaggttgccgtgagccaagaacgtgccactgcactccagcctgggcgacacagtgagactatgtctcaaaagagagagagagagacatatatatatgtatatatatataaacatacatataaatatatatata

SEQ ID NO: 115520 - DNA, 1623 bp, Homo sapiens
gaaaggtggcattggcttgcatttttagggtctggctatttaagggaagacatctaggttttcatatctgcttcttcatttactctgttgtgatacatggtggacattatatgaagaaaacctcgtttcacactgacagataattgggtaaaggaggacctcataggtcccagaaagggtcctagctctaccaggggtccatgggccacactttgagaaccactgtttaagcagtcattcagtgaaatcgtattcatttttgtcaagtgtataattaacaaggtgatttgtcaccgtgaatgcattccttatctattgccttgattccatttgtttaattttttcctttcagattgcaactcagattgcagtgctcattgcaaaagttgctagattggattgtcccagacagtggcctgaactaattcccactcttatagagtctgttaaagtccaggatgatcttcgacagcacagagcattacttaccttctatcatgttaccaagacactggcatctaaacgacttgctgctgatagaaaactattttatgatgtaagtgatttcacatagttaaatttgattatgaaaattgtgcggccgggcgtggtggcttatgcctgtaatctcagcactttgggaggccgaggcgggtggatcacgaggtcaggcctggccaatatggtgaaaccccatctctactaaaaactacaaaaattagccgggcgtggtggcacacgcctgtggttccagctactcaggaggctgaagcagaacgatcacttgaacccaggaggtggaggttgcaatgagccgtgattgtgtcactgcactccagcctgggcgacagggcgagactccgtctcaaaaaaaataaaataaaataaaaaaagaaaattgtgctacttgtaaaaaaaaatgactatagttttacttctgttgatgttttttgaaagacttaattctttctcattttaagctgggcagtgatatgaataaaaagatcacttagttgccagtgaggaggattggttgttggatacactctgaaggcaaggaggtcagtttgaggcaaaggaagtagttcggatgagatgataggtctcttgaatgaagctgtagtaaagggaacaattaggtgggcatagagttgacatttaggaggagaattgatacgtctgggtaactgaaggatgtagggcagatataggaaggagtttgacgtaagtagggagtgacagccttttatcaggttttttgcaccttttttttggttttgggttcgtgtgtgtgtgtgtgtgtgtgtgtatgttttgagacagggttttgttctgtttttggtggggtgtgtgtgtgtgtgtgtgtgtgtgtgtgtgtgtgtgcacgcattttgagacggggttttgttctgtcacccagggtgtagtacagtggcatgatcatagctcactacagccttgacctccttggctcaaaccatcctcctacctcagcctcacgagtagctaggactacaggtacatgccaccatgcccagatggttttttaattttttttagagatgaagtctcactatgttacccatgctttaaagtgtttttaacagtgttctttgttacctt

SEQ ID NO: 115521 - DNA, 1101 bp, Homo sapiens
tactttatatttagtcgaggcaatctccacagattgtacagataatcagggccttaagctggatagcttgtgtgagttagcttcttgcttgtttttttttgtagtatgaggctagttcttctccatatagaaagaagtatatgcttaattagcatcttgtagttactttcagtgtagtagttaccacattgtgctgacttgtaattgtcgacttatttttctcagattcactacagtgtagcttttattgctgtcatcctactgcatggtctgaaagagtacacataatgattgatgctcaataactgttaagtgaatgaacaatagaacaggagacttattcttattagatgcctgctggatttcagagtgatatagggcaaaacttccaaaagcaggatttttgagagattagtcagagctagagatacctggaaaaaattcagattagcactttttattttggaatggagcagctgaacctggagatagggactaaagtagggactaggaagggtatcctgtctaatgcggttgaggtacaagatgtgtagttaattgaaggtagcatttgtgggaagacatcattataaagagcaattttgctggttaatacagctgtgcctattattttggtaatctgaagcatggaaaatcttccttttaataataaaggaagatgcaaagatggtcctcaagtaccaaattagtttcctacataaaaaaatgtaagggctgggctcacgcctgtagtcccagcactgggaggccgtggtgggcagatcacctgaggttgggagttcgagaccagcctgggcaacatggtgaaaccctgtctgtactaaaaatacaaaaaaaattagctgggcatggtggcgcacgcctgtaatcccagctactcaggaggctgaggcaggagaatcagttgaacccaggaggcggaggctgcagtgaaccgagattgcgccactatactccagcctagacgacagagagagagtgtctcaaaagaagaaaaaaatattaagctcatggttgagctggttgctatagcaaagtgtagtgcacagggtacacttaaaattgctacctgcggctcag

SEQ ID NO: 115522 - DNA, 1033 bp, Homo sapiens
catcctgaagaagtaaaaagtaatttaatatcatttaatacttttatccagttttctagattgttctcaaacacatttttacaagtggcttgagccagaaaaatgaataaggtgcatttgacatgtcttacaaatcttttaattttgaatagtattgacttcctccctctcccccttaaaaatgccattgacttgttaaaaaaaaactagattagttgtcttgtaggatgctctgcctcctacatttgttgattaatataccttgctgattaggttcaggctaagcagatttgggcatctatagcgaatattttttgtctcagtattcgtgatgaattatttaatacatgaactttgatgtaaaacttttttggtgctaatgtttcttaagggaaaattatgaagacaacaattctgaggctaaaaaagtttaagaatatttgaaatgctaaaatacttagtgtgtaatggttagcttttgatactttggagtcaaggctttgggcttctcagttacagccactaaacagtcagtaggtggcactgtttcttctggtttagaaatagaaaatgttaagtatttgggggtttcatgaactagtacctaacatgtttcattaaacagtttatttgcatattgtctcactgaatattccttcccccctccacatttttagaatcacatgtagaaaaaaatatttttatttctcctacttggttgctttattacttactcttttccagctgagccttctgtaagcatgtatcagttggtgttttctggagcagataggaggtatacagggcttgtgaatatattagttggcaatggttacttcctgtggtttcttctttattcctgttgtttcttctttctttatctctctccctgcttttactgaaaggtaaagggctgaaaggtgttaaagaaaaacttttcaaacacttgtaaaggatgataagacagactttattcagatgggactactgcagtggggttttgcagtaggggagagaaattgtgctcaactct

SEQ ID NO: 115523 - DNA, 1328 bp, Homo sapiens
aaatgtcacagttgagcagtgtagttgattccaaatttggaaatagggtttaatttttatatcgtttttaggagataattgtatttccattaatatagccgaaaactgaatgaaggtttttggttaccgttgagtcatagcttaaagtttgtgaaatagaaatgactttctcaatttcagttactgcaggtaagaagtactaacaattatataaattacactaaattttggaatccagttttagaaacatgagtagtaacaataagtcagaagaacactgcatttgtgagttagaagaactagactttagttccatttttcccactaatttcccagccaaatgaccaggagttaactttccaacccagattaacctccaagcttgattaagttttgcaattctgaatctttcttgtgattgtaattttagtaggataaaataagattcaagtaaagcttgcttttgcttttcagtgctgcgtaagttaactgttaatggatttgtggaacctcataagaatatggaggtgatggtaagtgatcgaagaaatttgctgtgactttgggaaagtggtattttcctgaatgtttgaaagagtgctctttttatttggcattcaattagaagagtttttattaagtgaccatctagttttttaccattctgacttttagacttctggtctgttttcactacatcaaagtggctgttgtgtgaaggagaggaaataggcctaggatatttctcaaggatgccatggtacattgagagtgttaatttgaatttaaattaaaatgaactcctgtgaatttgaatgctattataacattaccaggtacattgtaaatagttttttatatacttaatattttcctttgtttttatgtatttaaaataaatttgtttttttctgtctgatcattacattaatacatgctgttcacaatcaattaaaaaaataaatatataagagaaaaaccttgtcaataaatcgatcataagttgtgatatatattcattgtctgtagatagccatcttctttttttttttttttttttttttttttttgagacagagtctcgctctgtcacccaggctggagtgcagtggtgcagtcttgggtctctgcaacctctgcctcctgggttcaagcagttctcctgcctcagcctcccaagtcactgggattacaggcatgcaccaccatgcccagctaatttttgtatttttagtagagacgaagttttaccatttctgccaggctggtcttgaactcctggcctcaagtgatctgccctttttggcttccgaaagtgctgggattac

SEQ ID NO: 115524 - DNA, 2164 bp, Homo sapiens
tagactcttttcgcttttagtatttgttgcatatcactgtgatataactttctgtaactggcagtttgattttgtaaatcccttgttcattaacctccactggcttatctttagcatcctttgttattcactaccccatgtgagagactatagcatttatatttgtgttgtattttactggtggtctgtttgttatcttcttcttccatgtgattgtaagcacctttatttggacatacacatgtgtgcacacacaagtgtgtgtttgtgtgtttggggatttgctctcctgagaagatatcttagtctactcacttttaaggagctactgattgttttatgttagtcagtttcaatttagtaaaacattgttgagcctgtgggcagacactgtcctgggtactatgcatggaaagatgaataagaatgttcatattgtgtagttactatgttttctaaaaatagtcatttttctctggccatccttgtgggcgtagcagaaggaagaataaaagcccttccaggagagaataagacaaattaacaaacagaatatgaagagtattattagagagcagattagctgatgagctggtggacattgttctgaatgtacaaaaaaaaatcgccagggaaattatcagaataaatttgtcagaagatataggaaaaatgataatgagtgtgttactccttgactactttattttacacatgtatgttgcttgaaaaatacttcaactgtgacatttagtttttaaatgttatccatgattcattgctaaaacgactattcttttactataaaagtgagttcagttcatatattagggttaattttatataatatggcacagagggctactgtgtctgttactcagtgtaaatcttggtattgctttttaaataatgaattcataatgcaaaatatgcaaaaataaaaccagcaatattatttttgtaaaaattttgatgttgtcttggttgtgaacttattaacttctaatatttgaaatgtatttttaacaggtagaagtataggtacagataatgtgtgtagagatagactggaaaagaccatcattctttttactaaagtggtaagttttttaaaaacttgttttctcaaatataatacacatattcagatttacaaaggaaaatgatatttttataaccatacattttcactttagtgtaaggaaacctatgttctgactccttataggaaagctaaaaattgcttttatatgtactttagaatgcatataataattaaatttacataccatgtgtcatagtgtaagtcaccttggtacatgaaaaataaattctaataaatattagagtatttgattcctctaaagctcattattctttgacccactggagaaagtggagataaagaagatagcagtgcagttcagctagaagtagatcaaatgtagcagacaggaagtcagtatattcagaatgaccatcagactatcttcgtccatactaagcatcttttgagtggaattatagggggtgcgctgtggtaggcagtgtgtataattacattttataaaacattaacttttaatgatattttggtcttgaaggattgggagaagtgcaaataattgggttacagcagttagaaagacctagcttggggactgcttgcactaaaataggtacttgaagacaggtgggaacaactaaatctgtaatctatttccctttttaattaaagattcaataatagggtaggggttgcttattccctgggaggggagtaaaggagcagaaatgagctgttttttatctttgtgttttaggtagtaattacctttagtttcagttgtcttcgtttctcttgttccaagtagcctcaacaacagaagttcacctaatcttccaagatacattataaaattgactaagattctctgtttaaaaaaacacaaagcaaagtaaaacaggatgatgtgcttagtcaaagaggactatacagtatatatcactgacacttgcctgcggctctgctgcctcacagtccctactcactatatcagttacataagtaaaatttaaaaagcattatttagatgatctgttttagaaaacacatttatttagctgtgagatttttcagttctttcaactctttcttaaggta

SEQ ID NO: 115525 - DNA, 2088 bp, Homo sapiens
tttaacagctgttgatcatcatttgcctagatccattatttgatcaggagttacacaatgatggcattctaattctgttattccttttgcatttattagctgaaattcttctataaagaagacatctccctccttagctatttgataacattaaaatataattcatatgggaaagggaagataatatttaaattctttaccttagtctattacttttaaaggtctattgtatatttaagcgttttgtatcatattcacccattgttataaaattaagtatgaattgagtctgttttggtttctgtattgaaaataatagaaagttcttattatcagatataatctaacataatcctcattatatgatgtgcctcaagaagagttatgataatgtaaaactgagtgaacatagactccacactaaggttcaaactgctaaatgattattagtaaagttataattggagtgattatattccaatatgaatttggggaaaatacattttaatttttatttatttatttttctacagcttttggacttcttggatcagcatcctttttcatttactcctctaattcagagatcactggaattttctgtaagctatgtttttacagaagttggtgaaggcgttacatttgaacgattcattgtccaatgtatgaatcttattaagatgattgtcaaaaattatgcttataagccatccaaaaattttgaaggtaattcctttattggcagtttaaaagaattattttaatcttaagtgtgatataattgctataattacaaactttttaaaaaatgtcattttagtctgaaaaataaattgttgctgggacatgaaaaagatataaggattataggctttagtatgtttatactagcttttaaaaacaacatagtgcatttaataagccattttttgtagcacaaattggttgaagcttagggactttaagaattaggtactatagtcatcactgcagctcatattgtagggtgtattcatttgaacaaataaaagctttctctgactttatataaagtgtgattgtttctagacaggttaaattgttgtattatttggaattcattcatatgcgtgtgtgccaagatgaatgaagaagtcttggtggtgggggagagagaaacacatgcacacaccccccacaccctctacattatgaggaagttatttcagtatgccgtgatggtattgcatggtaatatataagctgtaatgccagaggcaagattgatgtgagtgtgttgtaaggaaagagtatctttgagatttgtttataataaaaatgaaaatttatacacaagtgtatcttcttccctgagagtgtattttttatttatttaagttacataatccaatgtagctacaatgtttggctatacaattaacttggaaatttcatttttctagatagcagccctgaaactcttgaagcccataagattaagatggcattcttcacatatcctactttgacagagatatgtagaagattagtctctcattatttcctattaactgaagaagaactgacaatgtgggaagaagacccagaaggctttagtaagaattaattttttagtgttagaatgacttttctcccctttctataaatatctgtttgagtgataggtataatattgtattttcatacagcacttttgatctggaaatcttggtgttttaaaattaacttactctttcgttgttatccattagaacaaattgagaagcagaaaatgaatgacttatgcaaatatgttgtagaattttgtccaggaaaagacctttttagtttttggattcctttacaaatatatcatgtagtttcaaacaaaaatataaaattaactctctcttaccctgtcagtttctattttgtgattcattccatgttattttttatttgtagaaattcttgcaaagaaatttggaggtttttgatgaatagttttttttttttttttggacaggacatctttatatctgtttgaattttagtactagatagataagtagaataagtctgttgggacccttgctatagaaaatcaag

SEQ ID NO: 115526 - DNA, 1299 bp, Homo sapiens
aaggtatgattaatttaaaatgtacactttgcttgccatagttttaagtttttgaatgcgtaatgacaaataattgaaatgaaatcaactttcttttattaattataattcgattttgttttcctttgtgttggttataaaaaaatggtaaccttactttttttttttaacaaatcaaaagttggaaacattttcaaagttttagaattttaagattaagtatttgctttattaaagaattagtcaatatagtatgcaactgttttgatgagaaatttgtatttttccctctccagccatgcactgaagtattatttatagatatattccatgaatataatcagactcttactcctgtacttctagaaatgatgcaaacacttcaaggtaaggcatattttgtgattaactttgagttaatctctttaacgtttagttaagaaatagtctgagtgcctacaatgcatactgtactgtttcctgggtcatataataaatatgaatttgagaaaaacaattttaaaacttattatcttccaagggggtggcatttgagataggccttgaattatagtttggacgatgataaattttcctgtagtaaatacaatagaagcaaaagcaaaacagtagtcatactgcttgcagaaagtctatctggagcgtgttgtgagaaatagtgagaaaaggttaaaatagtgttagcctctcttagaatggtggcagtgggaatggaaataattgattatggatttgagagaaaatgatgatgtaaatttttgacacttggtcattacactttgtacacaagtaactaattatctgcctattaactaacattgatttatgatttctgtcttttctgctagactgtaagtcctaggggcattgatcacgtctgttttgtttatattttattcccagtgctgggcatattcagtaactattgttacttgattgacttttagcaaccgattgaatgtgctaggcaaggaaaagtgatcaaagatgatcctaaacttttgagccttaatgacaaggaaacagttacctcattagaagtggtaggagatagagatatactttcggagtgcatgtatgtaaggagccttgggaaaagaaaagaggatcttaaggacagaacctgagattttcacctatagggatatgagtaaataaaagccttgtaaaaatgccaggtgtagtggtgtatcctagagaagagcatgttgtcagaatgagtgttggccaggcatggtgactcacgcctgtaattccagcactttgggaggctgaggt

SEQ ID NO: 115527 - DNA, 1044 bp, Homo sapiens
aacatggcaaaaacctgtcgctacaaaaattaggaaaattagctgggcctggtggttagtacctgtagtcctagctattcagaaggctgaggttggaggatcatttgagcgcaggaggatgaggctgcagtgaactgagaaaacctcactccactgtactccagcctgggtgacaaagcaagaccttgtctcaaaaaaaataattttgtggtatatagcacattagcattttgtggtgtatattttctagaatattgcttgtcataacatttttcaaatatgctataatggtttttaatcctgtgttctctaatgataatcataaaacttagactttccctttgtacttgtgtccatttttgacaccatgaaatgtgttatacttaattgaattgggaaactaacaaattgtgtttaaatataaattttttaaaaaactagttttatttgcttttactgatacctatttatatatatattttttaggacccacaaatgtggaagatatgaatgcactgttaatcaaagatgctggtatgttaaacttaagtgatttagaagcatttatttattcagtagatggagagtctgttttgtggtagattttgtgctgagggtgttgagatacaagagtaactaaaatacaggaacaatctgattggggagataaccaagtaaacagataatgtattataataatactatacaggatagttaatgctaaagtaggtgatgatcaccagatagtttggtgtgtctaaggaaagattcccaaagaagtgtaatggaagaacacaaggataagtaggagttacacgtgtgaggaggtggtgatggaaagagggtgttgcattccagggagatggagcaataagtacaaagacttgaaggaaagaggaggaagcacagttagaatttgaattgtgactattttggtttaactggaacattggggttaaaggttgagttgaggctggagagagttaagtagggaccagatcataaaatattacatccattttagaagcaggcattattttataa

SEQ ID NO: 115528 - DNA, 1007 bp, Homo sapiens
aggatatagagacatcatggcaaaaatatttgaataccctttctaagttctaattgaggtacctaattaaatagtacagattcatattacatttagtaatatgaattatgaaatgaattaatttagtacatttaatagcacatttgcccaattctattttttttgaaatagtctcattttgtcacccagcctggagtgcagtggtgcaatctcagctcactgcaacctccacctcccaggtccaagcgattcttgtgcctcagtctcctgagtagcagggattacaggcgcatgccaccacacctggccagcccaattcttacgttttatatacatttaagcacttgtctacttaaattttaggtattgaatgcataaaatgaaaggaaaaacctctttcatagtttataaaattatttcttagtttaaaattggagaatttgaaaaaattctaaggggcttttttcttaatttgaaggatacacttctactgattcacttcagtatacctggggcctatcagaatacttagcatatagtcatagatagttaatatttgttgactaaactaatgaatgcataggtcacatttagagccacagaatttgtagagctggagatactctaaaagtaattcttaacagtaagtagctgtttatctcttcagttattcaatcatttattcagttaacatatatttttaacacttggaatttgccatgtcctataggcggtgttaaataaaatagactctgacttagtctcagggagctagtgagcctttgatggagagaaagctttcattggcgaaacaaatgtgcagtttagttgtccttaaaccctagaggctatttagtgtaagaccttcactgtccagtgcagaagctccctacgtgtagctattgagcacttgaaatgtgcttagtgcaactgaggcaacaactttccaattttaattaatttaaatttaaaatttaaagccatgtaaaatatttattgattacatg

SEQ ID NO: 115529 - DNA, 1005 bp, Homo sapiens
cacaaatgttttgaactgcatgatttttctccttacctgaactttgatttcttttagcgaagatgatgagagaaagaaagaaatgtatatatgtgctactgtaaatgttttgccagtgttaatatatgttattttggtaatctgagtcacattctgttattgtgtacctcttacaaaattagcttagttgaaatcacaaaatttatatgaaagttttatataagcctagaagtttcttacattgttctgaaaataatcttcatagtattaacagaattggagtagaaaattacatacaggagcttctttattattatttttggggacctttccagttttagagtttggggcattgccactgtttttggttacttgagctaaaaccaaatggatttggtttttatgaaacatacctacattgcggttctttaagataaaagagtcaggattacaacatatatgcctaggaatttttaagtactaaaagttttaataatatttatttagatcaagacttcattgttaatattttgtactgtggtacatttagaagtaggctttaagcttttttttttttttgacagagccttgatctgttgcctaggctggagtgcagtggcacaatcttggcttattgccaacctctgtctcttgggtttcaagggattctcatgcctcagacttccaagaagctgggaccacaggtgcatgccaccacgccctgctaatttttgtatttttagtagagatggggtttcaccatgttgcccagattggtcttcaactcctggcctcaagtgatttgccctccttggcattccaaagtgctgcgattataagcatgagccagcacacctgcttttaagcttttatattaaaaatgcagattgcattcttactacattttagatttaaatgataaattatactaaaagaaatagacctcttaaaatatttaacattttaatttcatgattttttcctgtttaggtataagccattgcg

SEQ ID NO: 115530 - DNA, 1065 bp, Homo sapiens
agccagacatagggtatttgtttttgatttcctaataagaactattctgccatttttagaataacaaattatatctataaaaatatatatttccatgcaatatatattaagggttacatcagatagctagtatgtgagtgcaataattaacgtctttttgccgtaatgagtaggtcttgcaaaacaaaacatttcgtgattggcaccaggcatatatggaagaacagtgacaaggcactgttaacagtttagttaacagtataaaatttaaacagacatagcgtagacaatattcctctaaacattattcagtttgtagatgagttaaattctgaaatggacacattcagcagcaatgaagaaagaaaacactttgtaaaacaatatgtaccggcagcttgaacgatttcaggttgtttaggtaatgccaagcttttggctgtttatttgacttactgctttgacattatgatttatttcttacttctgttcgtatgaatgtagaggtctttcatttctattataaaccttttttattttctttctttttacctgcagtatttggaaaccatgttcacactactttttcagttactgcagcaagttacagaatgtgacacaaagatgcatgttttgcatgtcctttcttgtgtgatcgaaagagtcaacatgcaggtaattatattgtaaaacatgaaaataaatgaggggtgggtagaatagacgtagaattcattaatatccttgactacattgtttaagagttaaaacattaattgaaatgcttctaacttatagattgtggtttcagttatgtattattcaaaattgacatattcgattttctaaaaatgagaaaattaaaatactaaaaaaaaaattggatcaacagtgtagaggtgttcatagagcagaattttacatattttagaagatccagccgatgtaaaattgagtgtgtttgagggcatagccacaagtgtccatcagcaagacttctgggaaagtctgttatttttacctgaaaaattaagtattttttgcagtctggtctgcattatattt

SEQ ID NO: 115531 - DNA, 1057 bp, Homo sapiens
tgtgtgattcttagtacttggtgttcttaatacattaatcacattaattcatttgatggtgtttttttcaacaacattgagagaatttggtcacacagagttcattgcaactgttttaagaactcattttaagtccttgcctctgctatttagtttgggcaaagtctttaaccttgtgtcctcatgtataaaatggtaaagataattctgaactcacctaacttaggatttcatgagcataaaattatttcacatctccaaaatgcttcagggtactataaagttgcaataaatggtttaaaaagttgattataaaaacaagatttggctattttctgtaattttatttagaaatatatggcagatggaaatttcttagataaaacttttttttaaatagaaatgggtcttcttatctttgtctccccaaacttggaattaaaactttttctgtaaagtttgttatttttttggcttagtaaatttaaaaatgcttatgtgtttctgtctacactcatctttcggagcacaaatagcctaagcagcttacatgcctatatcatcagaaagtaacaataaggtatagttattcaatatagtttttgtttttgaaaactcaaactaaataggaaatggttaaaaaaatattttcagttgtctgattctttttttttctaccttaacctctgatcaaccctatcatttttatcattgttgcatatatcccttaactctctttaatatgccaaatttgacgtttgtccatgaggcagcaaacttttaaaaaatgttaacaaattttatcttttttgagatgaagtcttgctctcccccccgggctggagtgcagtggcgcatctcagctgactgtaccctcttctccaatctcctgggttcaagtgattcttgtcctcagcctcctgagtagtagcttggattacaggtgtgccaccatgcctggctaatttttttttttttttttttttgtatttttagtagagatgtggtttcgccattttggctgggctggtctcaaactcctgggctcaagggatcc

SEQ ID NO: 115532 - DNA, 1057 bp, Homo sapiens
aaaaaaaatgccctgcttctgtggcagctcggtgctacaaaggcttattgactgcccacggtgtgtaagcaactgtgctagaaaatccttttgctttattaagctcactttactgttggcaacagttttctccagagacaatctttcaataatacatgaaaagtttcaaaatcccattttgtaaattgatagtgcagttaaagaaagcaaatcatagaaatcaactgtaaaagaaatgaacatttgattctcttcatccctccctccctccctttggaactaactgtttttgttagatgtctagaatttaacagttttggttcttagaaattactttggtgcaaattataaataatgatctttatcagaatatgagatgaatgactttaaaactttactagttagatacttattaatttgtggtttgcgttcttcagaaaggtgttgttcgaacttaaatggcatgtatgtggtttggttgtaaattagcctgttgttgaaatattttatattcaaacacttatatttgtataaggatggattactttagatcagaggttggcaaacttgtactagacaggaccagatattaaatattttgggctttctaagtcacacagtctttgttgcaactatttgactctgctgtcagtgtcaaaacagtcatagacaatatgtaagtaggtatggctgtgcgccaattaaacatcatttatagaaataagtacgtgggtggatttagcccatgagctgtagtttgccatcctctgccctagattgtaagataaaatattaattcctggcatataaataattttgtgcaaacatgtagatactatatgatgttgaatgttagaaaaaatccaatattaaagagattagactcagaattatcagtattactgacaatatattaatgtgttattaaaagtgtagatattttcaagggattacattaaaaagtaataataaaaatgcacggctttgttaatggtaatgttttttcctagcttttagttacatgctaataaaaataaattattaggagaaaattttt

SEQ ID NO: 115533 - DNA, 1024 bp, Homo sapiens
ggaggtgttccatccaatagcttgtattttctcaacaaaatatgaagcatcgtctttagtggggagtaatgggctggattaggagtgtgcacaagatatgagaggtctgtaggtgagagaaggtataaagtagatatcttagagaatgggaatttgaatttattagggataaaaccagtacaccagttgatgcttggggtcacgaatatggagtgaaactttcagactgattatgtgatttatctcctactatggctttttattttcctcttgatccatctcactagagatttgtcagttactaggcttttcaaaaacaacctttggctttggttctctttgttgtatatctgtttcctatttattaatatctgctcttatgtttattatcttattctacttgctttaggtttatgggcttgttgtcatctgatctccattctaagaaaatcagctcatcaacttttagcctttcttctatcttaatataaacatttaatacaataaattatttttaaacagaatttgaacaaaagactttgtatagtttttttgtttctaagaaaattggatgaggtagtaatgaatactggtaagcaggcagcagtatcagctatatcttattaaatgtaatatgatcatttaaaaaaacaaatttgattgctttttgctgtttactcaaaagatcatatctttctcttaagaaaaaacctttcttttaaaagaaacttgatttcctaggataaactttacttggtggggaattccactattaatgcatattataaacatttttctaacattttatctaattttattttttcttctattaatgatttggatctatgatctacattttgtgattctttttgattttatatcagtgctatgtttaacaatttaaaaattgttttcattgcactggaatgatttttgtgatatataacaatctattctttgtatgtttgaacaattaagaaaaggaactggaagtagacccgtgttgggggccaggggttcttta

SEQ ID NO: 115534 - DNA, 1050 bp, Homo sapiens
gttgtgtctttctatcaacaggggattggttccagggctaccacatataccaaaattcatgcatactaaagtcccgcagtcagccctgcggaacctgtgtatatgtgtatgtgaaaagtcagccctccatgtactttggttttgcatcctgtgaatactgtatttttaatcttggatttggttgaaaaagtctgggtttaagtggacctactcagtgtaaagccatgttgtgcaagggtcaactgtagttactttccttactacctttgctatgtatgtagaaatattacataatttgcagacaggtttttattttgaggcatttggttaattctttcttagataatttttataacttaactgattatacacttacctttcttcatttaaatgagaccttttaaaatatttaagtcatatgttaatggctttaatgggcatggaaagtggtttaatcatctgtttttccttcctaggttagtaactttggaaaacagtccatgtattacaccagagttgcttcgtatatttcagaatatgtcaccacttcttggtatgtgttaaagcataaacttactaatgtttttgaatgcaaccataattgggaggcattgaaacataatttggaggcattacaacaaagttgtaagttcaacttctagtttagattcaggggatatatgtacacgtttgttacatggatatattgcgtgatgttgaggtttggggtacaattgattctgtcatccagttagtgaacatagtacctaatagtttttcaacctttgagttcctccctctgccctctagtagtctgcagtgtctatttttgccatgattatgtccttgagtactcaatgtttagcttccatttataaatgagaacatacataccttccatttttatttaatccctaatattgacaaataagtctgttggtgttgtttgttttgttttgttttgagacaaggtcttgctctgttgcccagactggagtgcagtggtatgaccacagcttactgcagcttcaaactactggactgaagcaa

SEQ ID NO: 115535 - DNA, 1223 bp, Homo sapiens
ttttaaataactatgaatcacttcatttaaactaattttgagcagtgaattaatttggttttttgtttgacatttattgttttggcagaactaagttcagaaaatcttagaacttgctttaagatcatcaatggttatatctttttatcatcaacagaatttttacaggtatgttggagtacttttgcattatatgaaattatataattattattttgattattatttgaaatcagggggtacgttttcaaaattttaagattggtctgttattttaagacagagaaacattgactgtgagcatttcccattgcagggcagatgtgctgcatgcagttcctttctcaatgcagaaaatgtgctatgtcaacaaattttttttatattcctatgaaaatcagtgtatcaataatctatatttttatttggcataatcttttttaacttttcctaagcgttctgattgaaatttgatatgcttagaccattagtgtataattctcaagtatattataatgaatcccaaatgaaattttatgcctttttgatattacagatatattcttacatatattgacttttaattgaatttcagacatacgcagtaggtctatgccagtccttttgtgaacttttaaaggaaattactacagaaggtcaagttcaggtgctcaaggtattgtgatcattttaaatgaatatatttatgaatttttcatttatattttatgaaattggactttcatttggatggttcgcaagaaggagaagagttgatatagttctagacaggctattttggcagttttcagttggtttaatacctgtggaccagaggtctcaaatctgaaggtgcatacaccttcaacaggcaagagatcaactggacatcttataaaaattcaattctggatttctaacaaggtctgaactgattgggatgttgcctatcttgagacctcactttgggtagtaaggatttaaaaactcttgtaaattatccagtgatgtgatatctgatacttcttattctttcattttgttagtctgctgttgggacaaagttttcacgttataatttgatagctttaatttaagttggctatcaaaattagaataccacgtttgttgatattctgtaattatgaactaacagtctctaagttgtatattatctttatatattatacctgtctattaaagatataaatagtattaaatgt

SEQ ID NO: 115536 - DNA, 1467 bp, Homo sapiens
gcaaggggtttactaaagggtgagaatataagccactgttaccaaagaatcatgtgggctctaaaggacttgtaataacagtaatctgtgcttgtggcttgttgagaccctggatacttgaggcctggtttattggactagtctattaatccacatttattattaatttcaaagtattctcctagctccaaagcttacaagtaacatcaaacatgttgcttactaaaatgcctttatgaatttttattgcatttatgcctttattaaactgacacagtggcaatataagtatattaaggaactcagtcttatacaatttcagcttcagcttttgctttggtgataaattcttctctggaggtaagaggaagtaaggaattaatacgttggacttaattctgactatttgaggaaaaagtgattggtgatgtgggagtgattaaaacaagtgaaaattgccatgtcattttgatattattgtctttacagatttttttctgtatgtatgcctgttttaacctttctcctctattatactgagcttctccattatccaaagttcagtaaatgtgtgctctgtttgctctgaatacatatatagtaagtgacttgaaagacaaggaatccataatttttatgttgaagatgtgatctcgactatactgaggatccatttgggattctctgcttgaccagtcccttggtttgcgtatgctgccctgctacttttatggctcctgagtatactttggtcttcattttcctcagttattagatgaggagtgatactaaatgatttttattctgtaataggcagtacctgaaattctccatgttaaattgtaatatatgtattctaagtgattaagaaaagaggtgatttctcacatttaaacacttcccagaccaaatttgaattgaccttacccccatccccctcttttggcttttctgcaacaatattgttaaagtaattgttgaaagacaacttgtggattatttggaatggccattgtgattctacttgtttttaattatactcttaccacattattagagggagcgtagcatagcaggtaagactacacactgaagggagacttccagggttagaacattggctctgctacttcacagctatgtgatgtggacagattagtctttgttcctcattttccatctgtaacatggggatgataactttacctacttcctagagttgatgtgaggaatacttgagcttatatatataaacagttatagcaatgccaagcatgtaataagtgaatataagagctggctgtttttatgtaatatatagctgtctcattatttagtctctctatggggggaaataggctactataattttaggcaaaataatttggctgtagagaaacaaaccaagttgttccactttactctttgaccatttatttgaaataaatacttaagtacattaattaa

SEQ ID NO: 115537 - DNA, 1105 bp, Homo sapiens
gaagaaaattaattgtattttattttattttttttggctgctcagaataacacaatctttttaaacatttttattattgaaaattccaaactaacttactgcatatcaaaaatctatagtcaaatatgtagtcattatttttgtaacgtttaatatgttacagattaaggcaatttctctgtaagtatgccaacagtaggttatgattaggatacagatacttgaattaacaaatttggagccagagatggtggtgtttgcctttaatcctatctacttcagagactgaggttataaaatcacttaagctgaggagtttgattccagccttctgcacaacatgacaagactgcatctctcttttttatttctttttattttttttatttttttatttttttaagatggagttacgctcttgttgcccaggctggagtgcaatggcgtgatctcggctcaccacaacctcaaaaaaagaaaaagaatgaaaaattgagaatctgatagtatgtgtttaagatggtatttttatacgaatattgctgtagctaaatctgtatgtttggtttaaaaatctcagaaactagattttattatttaataaatggatgttaaatcctaaatatgttcattatgaataaattatatttttatgttaaggaatattttaggacaatagtgctttcattttactgctatatttgaaggctgggcaaactcaaaatttttggcgttttcctgttcttagagttctagtatagcaataacaatagtttttaatattagctcattttcgtttttagtatctctcataccatttcttaatatagtatgttatataacattttaaatatattttttactaaatgtcattgttatactaatttttgacagtgtctgcaagtaatttctttgttctttgaagcagaaagttacaatgttaggaaaattggatagagagaccagtatgcctgcttttggagcaaatggtgtagagcaaaggatacgctttactttattttgtgactgaacatgttatctagaggaatgtaattataaaatactctaaattgttaacatttctcatatttgaaatttgtcaata

SEQ ID NO: 115538 - DNA, 2540 bp, Homo sapiens
attccattaaaaagaaatgaagaaaatcgctatatgagtttgagaatataagtaaggagcattgtctctagttttcttctgtttaaaaagtagaaggcagtggaagaataaaccaggtaattaaagtagctatctagcaaaaagaggaggagagggtgaaactagatctgtcaggatgtatatctgttttatattttagagtttggaaccatgtagaggtaaagcatgatttagggggaaaaataaaaacaattcctaaagatacaaaagagactgaaacatttgaatctaactgttacgatgttggtggcacagctatttgagaagaatatttcaagtcattttaatacatagtatttcacatgtacatccctggtgggatgtaacgttacaaaaaaagtaagtttgtaattacattcagtagtattattgtcatcagtaatattggtattgttattttgaaactcatatgtgtatatgaatagtagatagaaataaggttataggacctggcatttttcactataagagaaataatatcggaccatttcatatggatttcccacaggcacctcaaattcgtcatgtcagagtggaatgtcatcattattactgacatcacaattgtacccatttgaccaaacaggaaagctagaagcagtgaaagactttttcacctttggtccactgttcagcttttctatatgttgccagttctagttctgaattttctcttgattctgtcccataccctctgcacccaagtctgataatggtatttttctttcagaaactctcatcttctctagctacggttccagaccttttagaccacaaaaactctgttttatccctgaaatatttgtgtatacgactatgttatttatttactcaatcagatactgctttatgtggggattatttaatccttacattaattctaagtactcccttgccacaaccccctcctccctgctgctaaataaaactgtaaagattcctatggattggggccagccacagctatgtattattactataaattctcttcaaacccttttgtttttaaaattttaaccagaattttatatgacatagtttagagtcaactagatagatatataaggtttcttaaagaaaaaaactgtagacacctgtctttctgccatttttccttgctcagagacaaccacttttagtgcttgtagccaattgattcttttgtatctatgttcagatctgtaaataacacccctgtgttgttccttcatgagttgttaattgtaggcagtatgtattgatactgcctttgcacttcctctgtgccttcatcctccaagtaatcaaaattcagtgtttacgtcatgattcctctatttcttcttcaaagctgagacatgtagtcagctgtgattacttctccttttctgtacaatcttttgtattctctggaagtaatacttacctttttttggtataatttttttatgttcactaaactgtctgacagatgtccaatatgttcagacacatcaaggattctgttactttaattttcttgaggaagtctcttcagagccatgctgactcccaccttggggctctttcttttccaagtttgtagctgctgctgcttgttcctgttgttatgaaattttagaatgaggtgccgtaatgtaagtttatttaaatgcattccattgggcactgatgggctcttatagtctggaagcaatctcttttagactctttagagaaaatacactctcttcgttctcctggattgggcatcagttgtccagatactacagagttgaaaatatctagcactctgtttcttagacagactttcaaccagtcttattttctttcttcttatttttagcttcccctttctccttcccaaaagtataagattctgctactttctgtgttttttggagtggagaaggggagaagttatatgaagtaaatctggttgcttctgtcagctttctcctttgacaccttgggattcagctttctctgacttgagtcagtttcctcttgaatttctttcttgctttcagtgtttgtttctcattcctcttgtctttttaaaattatgctccccctcttaaaattttttttctgtaattttagtagggttttagatgggagtgaaattatacatgtatttaataatgggcaggtggtcttactttctactcacagataaatactgtctggtgatatctgcctctgtgactctctcggtctactagcttatctgtatattttccatgtttatcttttttcccagatctagttgtgtttttgttttttgttttttgttttttcaaaaaagtaaacttgagataaaattttattgtttcaaattttatctcctcttgcttttaatgaggaattgatatcttgtatacctgtatcttttagtagtagcatacatagtgcttgccacacagtatagtgtttatatttttaatcttttatttggaccttaccttcacttcttgctcaaaattagagcagcaacaaat

SEQ ID NO: 115539 - DNA, 1005 bp, Homo sapiens
tactaacttcctgtttagctatcaaaaagccaatgttttaaaaatgctttttgctgcctctattagtgcatcatttttaagggttatttgtttacattgcaagggtaagaattacattaactgcatgtgatacctatgttattacaatgtgattaaatacagttgtatgcaagatatatagctgtgtgtaaatattatatacttcatatcaaactgcaattttaaaatggattatcttgtaaaagtgtgtctagtgtcagaatattgcataccctgcatacgtgtatgcattcttaaatttggtctgtgatacttattttagtacattgtttccttacatgtgtttttcataaagcaatgacttgcagtattatcaccaatctttctttctggtttttaggttgtggaaaatgcccttaaagtgaacccaatactaggtccacaaatgtttcaaccgattttaccctatgttttcaagggtattatagaaggggaggtaagatttttctttaagttccaaaggtagtgttagactataggattctagttttaattactctgttagatacagaaggaaagcttttcttgtcatttggatcatattaaattatgttaaattttcagggcggttagacacctttgccttttcctgttccacacagggaagcatagattttctttgacatgtgtctttcaaacatatgcatgtatgttcacacaaaaatcatttgaagtacaggaatggtgagtggcttaattccaatgcttgactactaagaatatgagggggacaaaatagtattaatgttcttatagactgaatatgttaaaccactggttattttctaagaacagctctcttaaatagatccatggacctgtgtatgttatgagtatttaaagtaatatagtaccaggaggcagaggttgcagtgagccgagattgcgccgctgcactccagcctgggtgacagagtgaactccatctcaaaaaaaaaaaaaaag

SEQ ID NO: 115540 - DNA, 1021 bp, Homo sapiens
caattaaaggtacccttccagaacatgcaagaatgccatatgcagcatagactataattagtgcagtaaagtcaagattgctttgtccttacactagggacactaaataaagcagaaatcaggaggccttcccaggactagggctaatcagaagccatcatattggattagcattcaagatggagtcatttttgtctccgcagtcagattaaagaattggcatacataattttcggggctggtaagtctgaattttgcatagcaggctggaaactcaggcaggatttctgttacagtcttgaggcaaaatttcttctttcctgggcatactgtttttgctcttagggttttcagtgaattggatgaagcccactcacattatctagggcattctcctttatttagcgtcaactcattgtaaatgttaatcacatctacgtaatactgtcacagcaacatctagcctagtgtttgaccaaacaactgagcaccttagcctagcagagtttatacataaaattagccatcacattctgtattatgttgatttgttttagcatcatttttagtgtagcatgcaaatgtcttaggaaataattcatttgttttcctttgaaactctgcagtttgaggttgcaacttgtcctctcctctgagggtagcagcaaattagtctagcaaattagagaacagtgaacagtagtcatccaattgaataaagaataatctaagtacaagttgacagttttgaaaaatgcatgttttttttaattgtaccagattggcagtgatttattaaatgatactactaaaatcactcatgggctacatacatgttttgaataagtctgcttagctgtcaggattaattagagtcagtttctggttttgctcaaattatccatttccagctcatgacttaaccccagttcaggtattccagttctgtggtttactataattgaattttaaccatgacttatgaggctttagcctttaaaagtatttacccacaagtaaa

SEQ ID NO: 115541 - DNA, 3344 bp, Homo sapiens
tctccccaatttttcttgcaaagataacctatgtcagtaagttggtatgcagcttcttaacatcttataacccaacacaaccaattagtgcgttactactaattagtagcttactaccaattagtacctcacgtattaagtagtactcagtattttttgcaaccaaaaatattttgaaaattttaaaaagagcactggaggataatataacaacatttatgttcattctaaattttttcccctatttttattaaaggaataaagcataaagtttaagtcttcaatgcgtatttaacacaacataaatattttattcattaaaaagtttacaaaaaattgtattactcgatatacatcttatttgaactagccttttccattcagtagctatgttgtttgatagctagagtctgttgattgatatttgggttctgaataactaatgttttcaagtatcctttaaaaactattatttttatattataggagatatttcaatgtgtatattaggaaaactctaactgcattctgaaaaaataagttcctgagatttccgttcagcaatacttttgaaacacagataaaattacttcctgtctcttagcttcctgtatccatggcaacctctgttttacacattgactgtaaaggaaccaatgtgaagagtggtgtttcctgagcaaacggtgacttaaaaaaaaaaaaaaaaaagtggtggggtggaggtcagcagtgccacagaacaaactggagttaagaaatgtcgttcttcagatttaaaaagaaaacctttactgaatcagctgagtgttaataatacgaatttccttttcttggtaagattatttacttaaatatgaacttctagctgacatgaaaaatagttctgtgaaaaactgtaatttagaatttaattgttctgtagtgaatttgtattttcataaattataatgttatttgatattagactttatgttgttaaagggacatattaaattcaaagattctcattcctacatcatttgtcacctgtgttgtaatcaattgtaatttttaagttaacttagcaaatgtttcattaatctgaactattttgtcaaatagtgggttaatggcctgatcatgttaataattctagaacgtattccatactcattattttttgctattaccatggtatgatttatgatagtattattggctgatcctaattaaaatagaatacagaagttatagtattataaaaaaaattcatttgatgaagttttcgtgatttaaagctttaccttctctttttatagccaattctgatctgaacagaaaatccaagaacagggatatgtgtggattacagttttctctgccttgcctacgactgtttctggttgttacctgttatcttttattattactccacaaagaaatacttggatgttcgtctgtttgtcagctctgcactgggagacaaattaactgccgtaacttaggcctttcgagtattcctaagaattttcctgaaagtacagtttttctgtatctgactgggaataatatatcttatataaatgaaagtgaattaacaggacttcattctcttgtagcattgtatttggataattctaacattctgtatgtatatccaaaagcctttgttcaattgaggcatctatattttctatttctaaataataatttcatcaaacgcttagatcctggaatatttaagggacttttaaatcttcgtaatttatatttacagtataatcaggtatcttttgttccgagaggagtatttaatgatctagtttcagttcagtacttaaatctacaaaggaatcgcctcactgtccttgggagtggtacctttgttggtatggttgctcttcggatacttgatttatcaaacaataacattttgaggatatcagaatcaggctttcaacatcttgaaaaccttgcttgtttgtatttaggaagtaataatttaacaaaagtaccatcaaatgcctttgaagtacttaaaagtcttagaagactttctttgtctcataatcctattgaagcaatacagccctttgcatttaaaggacttgccaatctggaatacctcctcctgaaaaattcaagaattaggaatgttactagggatgggtttagtggaattaataatcttaaacatttgatcttaagtcataatgatttagagaatttaaattctgacacattcagtttgttaaagaatttaatttaccttaagttagatagaaacagaataattagcattgataatgatacatttgaaaatatgggagcatctttgaagatccttaatctgtcatttaataatcttacagccttgcatccaagggtccttaagccgttgtcttcattgattcatcttcaggcaaattctaatccttgggaatgtaactgcaaacttttgggccttcgagactggctagcatcttcagccattactctaaacatctattgtcagaatcccccatccatgcgtggcagagcattacgttatattaacattacaaattgtgttacatcttcaataaatgtatccagagcttgggctgttgtaaaatctcctcatattcatcacaagactactgcgctaatgatggcctggcataaagtaaccacaaatggcagtcctctggaaaatactgagactgagaacattactttctgggaacgaattcctacttcacctgctggtagattttttcaagagaatgcctttggtaatccattagagactacagcagtgttacctgtgcaaatacaacttactacttctgttaccttgaacttggaaaaaaacagtgctctaccgaatgatgctgcttcaatgtcagggaaaacatctctaatttgtacacaagaagttgagaagttgaatgaggcttttgacattttgctagcttttttcatcttagcttgtgttttaatcatttttttgatctacaaagttgttcagtttaaacaaaaactaaaggcatcagaaaactcaagggaaaatagacttgaatactacagcttttatcagtcagcaaggtataatgtaactgcctcaatttgtaacacttccccaaattctctagaaagtcctggcttggagcagattcgacttcataaacaaattgttcctgaaaatgaggcacaggtcattctttttgaacattctgctttataactcaactaaatattgtctataagaaacttcagtgccatggacatgatttaaactgaaacctccttatataattatatactttagttggaaatataatgaattatatgaggttagcattattaaaatatgtttttaa

SEQ ID NO: 115542 - DNA, 1373 bp, Homo sapiens
tgcatcattaattttagcttagataactattttgaaaagttaattgaaaattttgtctgtgttactgcctgcctgttttccttcttggacgttataaaagtctgtaaagtctgcacttttatagatttacctccttaatgtataaaaatttaaaaaacactaaattttttaaaatttcattgcaatttaatttgaatttccctaatgcctaatgattttgagcatccttttaggatgctcacatgccatctgtgtatcttctttggtgaaatgtctgttcatgtttttgcctttttaaaaaaaaatgtttttgttctgtttcttttaagagacaggtctctctgtgttgtccaggctggagagcagtggctgttcccaagtgtgatcatattgcactgcagtcttgaactcctggcctcaagagattctcctgccacagcctcccaagtagctaggactataggcttgcaccactgcacctgatgcctattttaaattgaaattatttttcatcttattgtgttttcagagttctttttacatcctagattcaagtccattaccagatacttgttttacaaatattttcttccagaatttggcatgtcttttttcttcacagtgtcattagaagagcagaaatttttacttgtcaatactctatgtctttatctttgtagttatataagtaacataagactgttataaatctaagaatattaaaatattcctttactatcgaatctatccatctagtatttaaacatactaattagtgaaaaagaattttgtgatgttataggcaaagataaactttttgttataagaaatagattttgaaagtttcttttgtatttcacagctgaaatttctcttcatgttcgagaagatgtttaggaaaaaaaaaacaaaaagaattaatctagtattccagttaacctgttttgcttttcttttattctagtgttatccaagataaattctgtgggattataaacatttcagtagaaggcctgcatgatgtcatgacggaagatcctgaaacaggaacttataaagagtaggtgcattatttaattaatcataattggacttgggggataattaaatacatgctgcatgatttttttcaccatcactctataagcacagtatgaaagttttataatttctcttttatacagaaacgtttttgttattttgcttgtaatatttattgtttgatcttggtatcaccttatttatttatttattgagacggagtttcactcttgtggtccaagatggagtgcagtggtgcgatctcagctaaccgcaacctccgcctcccaggttcaagtgattctcttgccttagcttcccgagtagctgag

SEQ ID NO: 115543 - DNA, 1026 bp, Homo sapiens
agtagaacagcctgggattctaaaagttaaaatttggcttttataaggacttttttctccttcactcaatacattgacccactgaacggctcttcagaatagaatagagaatactagaagaaatgttggttcctggattctgacatctgtatattatcttaacttgtgtagatcctagtgacctccttaggaagtctctctctcttcagttttccccctctgatccattctgccccacttaaaattaaaagctgagtttcttacaggatcaagttaatggggctctattctgtgctgactcagacaccagctttctctcttgtctccctggattcttcatcattctgcaaacatgccatacacttatggcttgactaataatatttctgctccttggtgtgtcaagcccttatcctccttcgcaaatatctacctctaaaattgcattccaggcttataggaagaattcattccatctttccctgtttcttcatggcactttgtctttactgctaatatacaatatttagttgcttatattcagtctagtgacggtaagaggatttgagacagtgcaaaagaaagcacatgctcattataacagaaaactattaacataggattgaagggatttaaataagaaaccttgatttgggaaacctgtggcatcaggatataaaacttagctatatgctttctaattaccaggataaaaaaaagaaacattaggaattacatgggtcttattttcaagtagaagaaagtaggtttatcaggtgttaaacttaagacaaattcaatttaacagagtttgattaagcaaagaattgttcacaaattgggcagcccccagaaccagaattggttcacagtgtcttcagggctgtacctggtcagataatatttatgagcagaaacgggaaagtgaggtacagaaaagggaaatagggtactgaaacagctggattggttacagctcagcatttgccttatttggacacatgttcaacagttggccacctatga

SEQ ID NO: 115544 - DNA, 1032 bp, Homo sapiens
aacaaaaaaaaaggaaatatctaaaatatcttgccttttaatattatatataatcgtgaatgtttaaatatttatttttaccataaatagaaaataggtacataagaaactattttttcccttttcttttggaatcttttcttgtcttctggcctcatcatttaactaactttattataccttctttcctcatttgcaaaatgaaaacaattgtatctacctcatagatagaataaataattaaaatggttatggatacctagtaattactctgtaagagttagctgtcattttaatctgatcattgtatttacacctcgcattacagcacgttagctctcaagggcctaatccttagcttatagctaacattgcactgctctgagagccttcttttaaactgtttgaatttaactcattttactttgcttttatgctaggtatcatctccctagcacatagtgtagaggaaaggacaacatccaaagattcttaagacctgaattctagtccttttttactattacttgtgaccttgagcaagtcaccttgtctttgtagatccgtttgcctcatctgtgaaaagcggcagaaattggattagcatatttccagggtcttcgaactgaaaaattactgttaaaactcttaatatcattacttttcttcccccaaaacaatgtttgtacatataataagtcctcatttaacatcattgatagtttcttggaaactgtaacttgaagcagaaaaacatataatgaacctagttgtaccatgggctaattgatctaaacaagaagctcctacagcatatttctggtcacaaaaacatcaccgaacttcttaataaagatccaaaacacttctaatatttaacattgaagtaagtgtgagctatatatacgtttaagaaagattaatgaaaacaagttaaattattttcccttgtttttggtgaatcagtgagtgatgatggtcgtgatggtgggttaaatcaaggaataaatgtttgcaaagtgaaaattgtaa

SEQ ID NO: 115545 - DNA, 1041 bp, Homo sapiens
gggctgacaacacaattgtgtcattttgacatctctagtggagcagtctggagaagagctgggcctgcccctaggcctcccagtcaccaatgtcttcctggtttgagtttatgctgggtgaggtgatgggcacttcattagactgccatgttagttggtgtccccaggggtctgggagcacataattcagtgtcctaatgtccagcaggtgactgcaagggttgcttctgaaaatgaggttctaactgttgtgtgtccaggtgctacagcaaatatgaggtcaactcgtagtcacatgtgtaggtctgcttctggcgcctgctcctgggaccacattggatgtggctgttggcgatactgtaattgtagcagtcccatttagggaagcactgcctagctctcaggagggaataacagcagtcatgggtgaggcaacaaccagttgttggcatccaccggctgcctctggcccaccaaaccacagtggcagccatagatgaggtacttgtaatattactggatatattttatcatactgtttgagtgaataaaagcataggcttgaatgctatgttaacctggttaacatagaggtactcatatttgttactttattgcttgccatctgattatttcttttttccttcaaaaattactgaaatgattttgtttttttctttatcctttggcacaagatgatctttacaaagtttgtagatagataataggaaaaagccagctatatattgaaaagcagtttgaaagatagtgaatataaattattgcttctcattttgcattgagaaggcaattttactattaatttttatccatgtgtctgtcttttggttgtcactggtttgttgtcacttacgtgttggttatcacatatcacatatatttgcaccaaatttggttatcataaggcccagtttataaaaatgtgtgcaaatcctcacactccattcttttaagacttaacaaaattaacaatattaaaagcatttctctgtttactcttagttaagtaatcaaataatc

SEQ ID NO: 115546 - DNA, 1036 bp, Homo sapiens
tcaccctgttgcccaggctggagtgcagtggcctgatctcggctcactgaaacctctgtctcccgggttcaagagattctcctgcctcagcctccccagcagctgggattacaggcgcctgccaccacgcctggctaatttttgtatttttaatagagatggggtttcaccatgttggccaggctggtctcgaactcctgacctcgtgatcctcccacctcagcctcccaaagtgctgggattacaggcacgagccaccgtgcccagcccttgatctgtcttcttacttgctttttagcataccttgtaatttttattgaaagttggacatgtattgggtaatagggactgagataaataggcatttagtgtgaggatttatgttcatttgtctaggagctgggctttgtttagccctgttggtgtggtggtaaggcacaagggagaggagtgttctcaatcttaacgattaaatctcaagtctcttagtgggcttgagtctctggcctgggaccttcacttgtgcttcgttttggaaagctttcctatccccctcaggtgagacaggaagaggagaaatggctggagcgagaggagtgcctttccccatggctctagaacaagcctaaagcctggttaagtctttcccccgaagagtttattttcttttatcatttttattatgaagaaagctctggacgtatttcataagaatcactcttcccctcctgcaagaactatgatggcatctttctctgatcttcacaatgagaaactggtgggattcctagaggtaatgttcacaaaaccaagaggctttccccaagactgttcccagaagtgagcctaccagtttagagatccaacacttctgctccaggtaagttgatctcagctttgtctctggatttgctggagacagtttgcaaactctggagacagtttgccctgtaatgagtccaagtcattggttttcagtttgtccagctttttcttataaaagcaaagagtgacaacttccaagctttttatatga

SEQ ID NO: 115547 - DNA, 1005 bp, Homo sapiens
acctcagccccccaagtaggtgcaactacaggcacacatcaccaagcccagctaagttattgtgtattttttgtagagatgcggtctcactatattgcccaggctggtcttgaattcctggactcaagtgactcagccacctcagcctcccaaagtgctgggattacaggcttgaggcactgcacctggcctaaaactttctactaaaaaataattacatatctgtgctgtcctgaaatatgctatttagctcttaaattctgtacttttgtgaccctctctgaagtgctggtttattaacggtgaaatggatcatcttgtttttcaacactagagggcaccaaattctcttctagagcaaaacaatcaatgttttccaccaaagaacttcatttactagggtagaatatggattggtatattttcagtcgtttgataaccaaaaacgtaagagattttgtgctttatgataaagggtttagagaatcatagtaaggctttctcttgctatgaatctgtctctagctaagaatctgtcaatgcttttgctaaactgcttttcaggaacatttattgtatgtttgtccagagggaataaaacagctactctgggttaatgcttgggataacttatttttaagggttagggttagacacatcgtttattctggttttaagtttcaggtagcatgtgcagttttctgaaaataggcatttcccctaaattcaggataaaatcaatagccggtattgtgcttcagtgtgaattggggtgctggtagagaggagtgaaatgatgttagctagtaggttacagtgagccattcatatacattgatgtttagcagagtttcttaacttgggtttgataaatcatccttttattcttcaataaaagtgattggaacaaggtcacaccagtcaatgacttcttgtcactaattatacctttttttgtccaattaaaacatttaaagatatttttgcattgtacattaaattatt

SEQ ID NO: 115548 - DNA, 1063 bp, Homo sapiens
gataactctgggctgagatatactttgaaaaacattttctcttagataataactgattagtcataggtgacaagtgagtagtttaatggaaggagagtgggtaatgtgaaaaatgaaaagacttgtagatacagcttgtggaacaccatcattaagggatggaataaagaaacaagaggtgttaggctaggcagtgcttgtcagagagtaggttgtttgaacttgaaagccaagtaggtaggatatttttaagtgatagcagacaagaggacagcagtgggtaggagaagaagcttatatagccacatgtgagtatattgtttgtttgtttgtttgtttgtttttgtcctcagaggtagaagagcactaatttgaaagaggaattaaatggggcgggagtgggtggaatactaaccacctcctttctcttgaggaacatgctgttggaggagccatctttcataagaaggctgtataagtgatgtgctggggaggaaaaggtttcatgcaaggcaaggaaatatctgcatgtctgaagaggctgagaatcccgacagtaaggggatgcccagggcatgttggaaagggttttggggggaacagtgaaagaatgatttggaaagagcaaagtatgagggtgattttttggaagagatcagtgtctagagaagcagaatactctgctctaagcctgttctgatttagagagatttccttagtcatcagacttgatcctgggaaaactagtcaagtatagaccttgtgatgttcaactcacacagcttagctctgtatctactcaccaagacttcttagagacttactcctattgtctgaactttaatacagacataacttgttttttcaaatttaagttagcattttgttttatgattataagagtactatatgctcttataaaattcaggccaggcacagtggctcacacctgtaatcccagcactttgggaggccgaggtgggtggctcacctgaggtcaggagttcgaaaccagcccgaccaacatggagaagccccatctctactaaaatacaaaattagc

SEQ ID NO: 115549 - DNA, 1059 bp, Homo sapiens
attacaaaaatccttttgaaagcattctttctactaaatgatttggtatggtgtctattttgagcatatgagcaagcacaattatttctaaatcagagcaaagctacagctgaaaattcctttaaattctgtaagcctttagtagagttcatatggatgtcctcatcacagaacaaagacaaggcacttcaattcaagaagcttatggagtggcacatacatagtataggtaaatataagacagatggtatcgagagccagaatgtgtgatacaggcaagcagtgcttatagggtttcaaaaaaagaaaaaatggagatatcaatgtgggctgaagtcattgaggggaggttccattggggagccttgagcagggagagtaatcaggagaggacactgagaacaagagacagtactgtggcggggtgaatggggcagggtaggggagttggggagagttggtattctgggagatcaggaagacacagacttgcatacattgagttggagcaaagagagctagaatcgaaccaattaggcagggatactgtgaagtatggcattgggggtaattttgattataagggtgtcttactacagatgctcctggggacacacaagcctcatcttttggtatgttggccttagaaaaaatgttgcacgctgtgcaccagcaaagtttagccaggacaaagaattctgtattttgtggaaatacagagtggtttgaagtagagacaactgagtgtctcaaagatagcacagggcaggcaagctccaggcaaaaaagacttgtagtttttctgtgaattttcacagggtcagcccaggttgcttcagggttatttgtatcattcatccccccttgcctcacctgcctcccaaccccattttccccctttcctctgttgcattctggtcatgcgagaagatttagaaaagactagaactgtatttggagagccactcacaccagatttgtgactagtcatgcacaattcattagattttatgtttataccataatggtgaagctgcagatgctgatatgaaagcaata

SEQ ID NO: 115550 - DNA, 1010 bp, Homo sapiens
ctcaggacaggcaagagccaaaccctcctttcccccaaataaactagaagaataccacttagaagcagggagagaagggctgacatgtgtattccacaaacacacacacacacacacacacactcaagttggtactaactattgtgaccttacagtctttaataaaattctggcaaaatggcacacaaagcattaaaatttgtaacatggttatataacctttatttggctttctttctttctttttttttttttttttttccagaatagacaacattagagcctattagtgttggccttgggaagattaagtgcttttggaaagtgtaccctgttataaacaaaagacaagcacaatctggtaactaaaaatgttttcctaagaggacagagatgtactttttcttcctccctcagtcctattgatttttaaatgtctgatctcaaatattcaccttcatgaagcatctactaaccttttccaaatcagcacaatctcttccttctttgagctctgtataagttattatttaaagagcttataagttaatattaaattttgctatgtttcatagtgttatatccaatcaggactcatctcgggaaatataaattaagacagagacatttggcagaatttcaagagactggccacatggaattctttttgtttttttgagacggagtctcgctctgtcacccaggctggagtgcagtggcgcgatctcggctcacagcaagctccgcctcctgggttcacaccattctcctgcctcagcctcacgagtagctgggactacaggcgcccgccactacgcctggctaattttttgtatttttagtagagacgaggtttcaccatgttagccaggatggtctcgatttcctgacttcgcgatccgcccgcctcggcctcccaaagtgctgagattacaggtgtgagccactgcgcccggccggaattctttatcctaaggaagtcaacccacatgccaggccaaatgtaattc

SEQ ID NO: 115551 - DNA, 1010 bp, Homo sapiens
aaaaaagagtaaatcaaaaaaagggaaacatcacaaaaaggaaaaaaagaagagaaaaaaggaaaagcattcttctacacctaatagttctgaattctccagaaagtaactgagactttggcttaagccgttaaatttaaaaatttgtttttaaaacgtgtttgcccttccttggaatttgctatatattatgctttgcaataaatcacagccttttccatatagacatttttcgtatttgggaccattatccctctggcaatatatttttaatgtgctgtaactgtaaagtattaaatcagtcttgttacttgatagccatgccccaagtatagctatttgtgtatactaaacacatcatttttggtatttgtgtctctgtgtgtttggctagtgttactacttcataagttcattgtaaaatggctttactgccatcaacatgggtcatctacctagcagttaatgagtattgctggatcaggtgtccaccttccaatgatgaagcaaggtaaggggtaatgttttgctcttgacacagagaaatttaatagctttatgtactaaaatataatatcttttaaagatagtgaaattcttcagttttttaaatctctagggattttttttcaatgttgtagaagatgcagctgcttaatggtcttgactaggactttttaaatgaatggtgtctgcaggtagatgatcatgaaaatatctctaacaaagttttactcttctatgaaatgcagaatttctagtacctgcctcctttgtttttgtaataattaaaatacttcttgtataaagagattagttcagcctgttagtaagtctgcagagatgatgctgagttggttgtgatttttagaatagactcctgggttgttttacaaatgtgccatattggcatgtcttacagtgatacctcaaacacagaaatttttatttaggaagatagctaaatctttattagaactgatttttattgtattcagtataaattttat

SEQ ID NO: 115552 - DNA, 1020 bp, Homo sapiens
agataagtgagaaattaagtacagaggtagtagctgtagctaatattgactaatatttatgtgtcaaatatgtcagaatgaaagatgttttctgtggatagaactcaaatacaaatgggaggtaagtgagaaattaagtagatagtaactgtagctaatattgactaatatttataagtcaaatatgtcagatactatatcaaacattgtattctatctcatttaatattcacaactgcactgtgaaatgagtattaatattcccattttacagatgaggacactgagggacaaagaaatcaagtaatttgcctattatgagacagctggaaagcaagaagtcagtctggttcctctagactgtgtacttcattcattttgccatcgtataggataacttacaaggtagtttccagctctttaaggacctgtaggccatgacaagaggtttggcattatcctacagatggcaggaagccatttaaggattttaaagcagattcacattttggaaagataattctggctagaaagtagattggagacaaagtttaccagttaggagtaattctggtgagttataatgatgtgtggctgagatgtggtctcaataggtaaggagagaagtggataaattgaagatacatttttggtggtagagtcactaggagttggtgattgattcagtgtgggtaggtaaaagaggaaatgaggtttacctgggttttactgttaagcaattgggtggggctgtttactgacatgacaacacctcacaaggggcaggggttaaggggatgatgatgacatccagtctggggcttgttgtgttgaggttagtcagacataggaatgcaaatagttaatagtaagagatataatttgtagcttaggaaagaagtcagagtcaaagacaatgatttgggtgttacccacacacataataggaggtaaggctatgggagtggagcactctgcttagatggtgtgtagaatgtgaagggaaggtctgtggctgaa

SEQ ID NO: 115553 - DNA, 1111 bp, Homo sapiens
taagaggggtaactcgagcctctggctttcgaaaaggcgcttgcttcccgccagctgtgagaacaaggcacagtcaaagcggcgttttccttcccccagcgcagcagcaccctcgctacggtcgggaagggcctgtacgcctctagcgacggcagaaccagtagatgcggatgcagtttccggacgagtcatattgcagaagacacatggtccgaaccattactgatagttttggagggggagttagtttgatctgcacacgagagtagtgtaaacaccgccaacacttatgaagtgtcccttctaatattgtaatacaaataacataaataacattaagctatggtaactttacggacttttctcgttccctggagtacattggaataacccttctcagggttagcggtgctcgggtccggtaacaacatggcggcgtccgtgaggggctcctttgggcaggggtagtgtttggtgtccctgtcttgcgtgatattgacaaactgaagctttcctgcaccactggacttaaggaagagtgtactcgtaggcggacagctttagtggccggccggccgctctcatcccccgtaaggagcagagtcctttgtactgaccaagatgagcaacatctacatccaggagcctcccacgaatgggaaggtgagagcctcatctagggaacttggggtcctgggatccccaaagtgagatttcccggatttggggtggggagtgggtttcaggatctcgtggtaggaagagaccacgagaagtgttgtctttactcctgcatgtggacaatgttgcatcgaaacactgatgttggtacttttcaggatgtacttgaagaagtcaagtggagatttctctacctaccagcattccggtcctatttaatgctttaacccaactcatgcagccgatttctggggtcttaggtttttaaacagacatttttgagtttgatatattctttgcttaactaaggtcattcattctccatttcttctacaatcattaattgaacgcctgcgaggcactgggcactgtactaggcgccggagatacaaagatggatgggtaaggtagttgttttcccggaaaagct

SEQ ID NO: 115554 - DNA, 1015 bp, Homo sapiens
tttgaattaaaaaacaagaacaaagcaattgtttaatgacatttagaatgagatgggaaggagtaataattgaatactctgcaatggctcaaaggtagttttctgggagaaataatagaagatttcaaaagcatagctgactttgggatgagaatagggaaatgacttagaaatccattcccccttgggtactcttcctttagatgtaactaagcagctttctacaaaatagggtatatttctgtctgagtatatttagaagatacagtctagtgaattcaagtttaataacattgaaagaatagtaaatacttgaaaatcaattaagtaaaatgtctgcattttttattagaagttgtatgggaccttgcaggtcaagttgaataactgcatatgaagggtcttataactgaggacattcactaaatctttttacatttcaggatgaatttcattcacggttgcgttttaatcggagaggactggttgccatggcaaatgctggttctcatgataatggcagccagtttttcttcacactgggtcgagcagatgaacttaacaataagcataccatctttggaaaggttagtgtccagtgattttaaacctgtggttcagtttttggttttatgttattccttagacttctaagatacatatgattaacttatctaagagctacctttgtaaaaacattccataggatatgtttattattttcaaaaatgatggaatatattcctaatatagtgcactatgagggagcatctaagttctttttggatctttcaattcagtcattagttgtgactttagtgtattccttctttaaaatcatagtaatggtatgagctaaaatgtgccacttagccaatattgattttacacttttggaaggacatttaggtaataatatttagtagtttacagtttattttcttaatgatggattttcttaagtttaaagtggaatttgtgttgacattgaaacttcttactgtaaatattactt

SEQ ID NO: 115555 - DNA, 1052 bp, Homo sapiens
taaaaattaagaatcctaggccttatctgagacccactaaattagaatttccaagcgaggggcctgggaagctgtacttttaatgaattccagaggaattcataccaaggaaatgtaggaaacactgctttagcagatatgaatgatttgctgctctatatgtatgccttattgtttccattttttgtgcctttcttgatgttctttttcccacctgaaatgtcccatcacacctctggatatccaagtcatatttgttttcaacacctgaaatgccatcttttctaaatgtcttttccagcttttaaaaatcttttttttcttacccaacctttgcctttcttgtaatactgtacatttgccttttaaacacatcttttttgctttattacagaagaagcatatgactgtgtttgcattgtacactagtccaaagtccaacattataccctttactttataacttattaattgtgtagagtcctgggctgtgagcttgttgtacatagagtctgtgtcatctttgagtggcagtgtgctagaatagaaataacatggatttgggatcatacaaattcatattaaaactttaatttcccctgacaccctgtgagctttgataacttagtctctctgagcctcaattttcctttctgaacaagaaaatagtatgtcccacttactgttgtgagtaaggatatagttttaattttgatttattatacaatactgaaaaatgtctttgaaagccaagtgccttaaaatatactatacattataactggtattttaatctcagataactaaagaatgtaaaatttctttaatatgatcataaccattatgtagaatcttatgcccttatgcccaatctagagggctggtgagaaatttcattatcagctcagcctttttgggtaggaagccacaatcttgacacaattggcctagtggccttcatgagcactcccattgagtcctagatagtggcttgtgcagcccagcctcattattacccaccaacaacccattcttcacatgcgattggatct

SEQ ID NO: 115556 - DNA, 1196 bp, Homo sapiens
ccagcactgttcaaataccttggtaagaagagggaagactagcttgaatgttggaaaactgtggctaatagaatatatttcttcaaaatttagctttactatttttaagtgtatgaaatgactggagccaaagccaaataagtgtctgttctaatgactaagaataatttgcagtttcagtggttgcatgaaattaaatatttctaaagggcttaaaaataattgtttcattcttcatttgtttatcaagtttcttttttcagtgactgcacagtattaatctttattccagaacctttctgcccgatcacaagttaataattggtaaagtctgaattgaggctttactttatgtgaaaggagaaataagattagagtcctctctggtttatggattatcagtgtgggattacagacaccccttcaccccactcacttattcatgacaaggtgcctctcccacatgggttagctttccttcattatttatttcagtatctttctactacctgataaaatctcttagaatcatagaattttatagctcaaagggattttgtccaacttcttttctttatagatgaggaaactgagcctctggttaagtgacttgccagactgacttcatttcctttttgataggattgcatgatagggagatgccataataatcgtatcttgagttcagaaaagcaaattgtgagactctctcatgatattcttgtagacaacaagaagaaatgtgatctgggagatagtacagtcagatagatttatagctaattgaatacttctgaccaaagggtgctttgttgtcaactcatgccaatttgaactagtaatttgaaatgtaataggagtacatgtaaattctgtacttgagttcaataaaatcagctgaataggtatgacataatagcctgtgagtcctagttgaattactaagaataagatctctggaataaggattttaacatcctctgcattgtttagatcatacttgcagcattttatccagttgtgaacgtacttaaggaagatcttgacaaactagatgcatccagaggaagggaaatggtggggaagacgggaatgatgccaaaaaccacctaacatagggaatgcaatgaggaactggatataataatactttagagaaataaaactaagtgaaaatatgatcctagacttcaaat

SEQ ID NO: 115557 - DNA, 1091 bp, Homo sapiens
aattgtttcttccttgggaaacctcagtttttgctcttaaggccttcaactgattagatggggcccacccacattatggagtgtaatctgctttctcaaagcctactaatttaaatactaatcatatctaaaaaaatattttcatagcaacatctagactggtgtttgactaaacatttgggtaccattgcctagccaagttgactcataaaattatccacacagagttagagattgagccccagaccttccagtttcttggtcaatgttgctcctgtgtcccttcctcctccctccctccctccctccctccctccttttccttcttccttccttccttcttccctccctccctccctccttttccttcttccttccttccttcttccctccctccctcccttctttcctccttccttccttctttcctctctttctgactccctcccttccttcctttcttctctttctctccctgtctcccccgtcacttcccccaccccttctcctctctccctctgcccccttctacctgtattctatttagtccctactgttttgctgcctctttgttcttggatatgaagttccagataacataatttttctgtgtccctctgattttcatttttacatttgtttgcagatagttttgaattttctgtgaagcccctaacactgaattcactaaatatatttagtatttcattcatcagctaaaccttttaattagtcaacttattttaagcaatttttaaaacatttaaaaatatatttggtgtttgttcttcctttaaattcactgttacttgacggtataaataagaaccttaaagtaggtcattaagaaagaataggcattaaagggaaaaatgtctgaattcattttcactctcttaaggattgtctcctaatttcttcagttcatctccaatttgctttctctccctgcaggattcagagtctactgtagtgggaagagaggcctaacaatttggcttttcatatatttctatactaatttaattttaaaagttagttaaaatttgaaatggtaatgattattaaaattaaacacaggttcctcctat

SEQ ID NO: 115558 - DNA, 1841 bp, Homo sapiens
caagtctcaaattaagaatcctgcttcactacgactcaccagatcaaagaaagaatcacaaaagaaaaatgatccacttggggttatttcttccttcttctctcccctctttcttccctttgttcctccatctgtcaatgctgggcactattctaggagttgaagatacagcagtaagcaaaacaggccagaattttagctctcatggagtgtttgctgtaattggatgacagacaatacacatgcaaataattaaaatatatggtgtatcagataggtgataagtactttggaaaataagccagggaagatgaaagagtactggaggtaagtgtgtggttctaccattttaataggttaatctcatcaccaagagggtaacatttgagcaaagatctgaaggagatgaaagagcaagcaatgaagagatatctggaatagagtatttgtttcaggctggagagaacaacaactccaaagttggctagtgttggtgggctggagttgtaggagattatgtcagggaggtttagattgcatagggccttgagtgagttggggacccactagagggttttcacaagagaagtgattgctgtgacttggattatagaaatctcagcttctgcactacacctcttctacttgaattgatccctgttgaggtcagtatgctggccaactgccttcaaaagccacatttcccactgagataagaataggaatatagacagaatagcccgagtgacacagagggagaagtctgctgcacaaaggagctgggcatgagttgagcgaacagcctttcctggggtatcccataattacatagttggcttagagcagaacccagggctattcccacctgtagcagattcttcaagggcttataattcaaaacaaaagaaaacaaaataaaaaaaaaaacctagtttagaatgcaataaggagattcagtggatgcaatagatctctagaaatgaaaggggaaattgagcacctggcaaatactcattttccatttctacaggatggagaagatgaaagtgcagagcatgatgaatatattgatggtgatgaaaagaacctgatgagagaaagaattgccaaaaaattaaaaaaggacacaagtgcgaatgttaaatcagctggagaaggagaagtggagaagaaatcagtcagccgcaggtgagtcagttactgtgctagatatcagagtttttgtctttttatatttcactttaattcagattgaatcctctcttcagctaatttttaaaatactattttcataatgtttgataaacataacagttgtacaaattggcccattagcaggcctaaaataaaatacaccaagcttaaagtaaacataacaatgatcctatgagttcaattccattttatttctctctgatccttttttagaaaggctctatactttcatatatatagggtaataatgtattagctagatgtggaagaatgcatttgttaaataccaatgagagcagtagagtaattgtatagaaagaaaagagacatcctcaaataatttcggtaagcaaaatttgtcaaaactgatgaagaaaatgagtgagcctgaaaacattcttaaatatcttttcaagtctgatttaccaaataccatatacctatcctaagctcagtagtatcataaaataaatttcagcaaatggtgaaaagtttactgtctggtgatgaaagtttgttggatttatgactcaacattttattctcctgaaattcaacttaattgaaaaattatctcttttgtgattctatttcaactttatagtatacattttaaataatattgc

SEQ ID NO: 115559 - DNA, 1024 bp, Homo sapiens
tttgtataagaactaaagttcatttttaatgtacctttcataagtgtctttaaaaaattgtttacctaatattaagaaaagtcaaagtttgcattttccaaaattgtgttcactcttacaattaagggttattcttaaaagatttccttggctgtagtatgggcctgatgaccaaacatggcattgatagctagatttaggaatctgatctatcatgagaatactggagagccactgaagtttttacaggcaaatgatatattgagattgtatttagtatggagaatggattgatagaggagtgttttgggctattatacaaaataccatagactggatgacttaacagacatttaaagcttagtttttatggtaatttcttacataggaacatatatatccacttacttatgtaaacaatttttctctttttataaatcagtataatttgcaaaattaaaatcacataatttgtatattcactgtagaggaaaaagttatattcaagtgcattgcaagtctactaagaaaattaaataaatttaaaaagtacgttaaatacttttctacttagaaaagtaaattaaataagaagtctccaaaggtggcttgaatattttaggtaaacatgagtattgtggacattgttggattcttttaggtaaaataattggcaaagtgtgcctttgtaaatggtgcagacagcacacatttatttataactgttctgttcccccacattttcattattcacattctctactctccctccttcatcctatctgtcctacctacaaagagaaacaaaagaaaaataaggtcaggatagaggagaaagtacagaatttcaaaaggaagaaacagttttttcctctagtgtagaaatttccatgattgtctcatgaccacgtatttttttcagttcataaagttgccaaaatcagaccctggcatggtggctcatgcctgtaatcccagctgctcagcaggctgaggtgggaggattgcttgagcctaggagctc

SEQ ID NO: 115560 - DNA, 1008 bp, Homo sapiens
tctcaggtttaatgaaatttacatgctaatttttactagaacttgatttttatttttgtatattttttcctaaccaatcattctattctcaaatatatgttattcgtgttcccagccactgtgtaagaactggtgcgtgccaggaagtggtaggctccaggaacatgaaaataaaggagatatggtttctatctggaaatgttcacaatatagtgtaagaataagaattgtcaacaattaattacaattcagtatgacaagcgctctgctagacgtgcatacaaagtgctatggatgttaagtaggcagtatatatttcaggaaaagatcaaaataccagatttaaaagggttgaacaaaaattgccatttttgcaaatcaaaaacagtcaaatatcagcaatttcatatgtatgactctgatgctaataaaataagtcattttttggagctactatttaaaaggaataacactttaacattatattcaattatttaaataatgttgcataatctctcaatgtagactaggtggtttgttttaattgcctttaccagttatggttaaaattttggaatagtattaattgtaatagaaaccatactatatttagcatttctggcaagcttccatttttcttctgtttggacattaatagcaataatttttggatattctggactaaactgtttcttgggccacttgaaataaaaataccacttttaaagtgcctattcagttcattgagaaccagttaatccgtatccaaggaatcaccttcaaaacaaacaaacaaaaaaaatccttgaacttcagctatgtatatcagaaatatgacaaccctactgtttttacaattagattttgtatggcagacaggaagcagtgaaatgcacatgtgggagaagcttctcttgtcaaaatagaaaagaggtatttgcatctctttagaatgtattgatttatattatccttgagagttagaatccattgatctcactgcatcag

SEQ ID NO: 115561 - DNA, 2136 bp, Homo sapiens
tcaaatataccaaaggtatattccagatgactcctagttttctggcttggaagactggctaagaagtagtagtaataagcattgagataggaacactggatattcctactcctctcctcagatatttttgccctgttggtcctttctgatatacctctgttttgctacacataaacgtatatcctgaattgtttcttattcaattgctttctttattagtcagctatattaggttatgcacccaaatctcagtggcttaaaaatctcagctaatatttgttttcttgctctggctacatcctgatgggcagctgtggatctgctccacatcatcttcattctaggcctgggatgaaggaacagctcctctctgaaatgtgctactctcatggcaggaggaaaagagtgatgaaggaatgatatgctggctcttaaagcgtctgcttcgaattggcatatgccactttatttcactggccaaagcaagttatatcgttaagcctgatgtcaataggatgaagtataaacctttcatagggaggagcagtgaactgttggaaaagataatgcaatctactacagtctctacgatttaaacagaaattgctgtctacatctatgactatgtagtaagtttgatcatcatattcctggcagcctggaggaagaaaatggcaaatataataaaaattatataattaccattacctgaatttttaaaaaaactatatatcaattcctagttatttcagacttctagaagtacaaaattctaaaggaaattttatcttatcagtctttacacccaagggtggagaagaatacagtggatatcttccataatttcacagatgaataacacttcatatacatacaacattaaattgtaactttcttattagatatcttaagaatcctttggttataaggaatagaaacccactcaaattagctcaagtaaaggaatttctgtatgaaggaataggggagttgtatagaatccagataaaagaattgcatacagtcttttcaagaaagcaagttgtcaggaagttacattttctctctttttttgcagcttttctcttatacttttcttttattcatttgttccattatcctcacatacctgttttctccatagagctctagtctgctacttgttgcagttgagttcttcagaagtaaattgactggatttctgtgtccaaaatctgaatatttgggagagagaatcttattggcgtggcccaggtcaggtgtccactcaattatgccattgatagaggaaatggaaagccacgaagtatgcagatgtggcaaggatgggtagctcctccaacatctatccttccttccctcttaccagaatgccagtgtttaactggagtcatggctgcttaactgaaacacattcatcagtctccttcattgttaagtatggtcgtatgaccaaattttggctaaagaggtgaaacagaaatgtgtcagacattcaggccgtcttttttaaaggaaggaagaaagaagctagccctctttcgtacctgcctcttcctgtcagcctggcacacagatttgatgacttgagctaaggacggtagaatagagaggagcatgcgtccttgaagacttcgtggaaccattgttgcagcttgaaatgcctacctctggacatttcctatatgagataaactacctttcaggttgattcagtcacattatttgaaatttctcttatgtgtggtagaacccaaaatgatacaaggcagctttttttcaggcctgtgaatagagcaggttctctaagatgggaatacagcagggaggaaacgaatggctgcatcattatttctaatagtttttgtagttgattttcttgtttttcctggaagagagtcatatcactttgcaacacccagcatctctacccctcttctcacttttggctgatcaccttgtatttcattaagaaacagaagcagtgagagagaacttgttccttttcccaccaccaaatctacctatctgcatctgaatctattttcttctggcaagggcaaccccttcactctgtgtcctggtcctcatatccttttactttctcatatgttttggccgtgctattacccactt

SEQ ID NO: 115562 - DNA, 1115 bp, Homo sapiens
tctgatggttttataaaggggagttcccctgtacacgctgtctttgcctgtcaccatgtaagatgtgactttgctcttcctttgtcttctgccatgatcatgaggcctccccagccatgtgaaactgtgagtcagttaaacctctttcctttataaattatccagtcttggttatatctttattagtagcgtgagaatggactaatacggggacaaaacacctattatagtacttaagcatggcctgcaacacaaactgacaacttaggactcttgcctttagaaaggaattacaacctaaggatggttaaattgcagcatcactgctttcagtctttggtattatggtcatagtttgggagaatgtttgaattaccttaattcatgcagtttaaggtcattcagagctttttgctattaatatgtataaaaacccctactaaataattttcataaaactgataaatagtgtttattccaacaaagacatatatgagaaaattttcagtttattctttcaaaagttttaactaatattttaagagtgtttgaaagttgatgctgtgtatttatttgaactgttcttttttttaaatactgtaactgctcaagattactttagatgaacacctggcacctaaaccgggtataaacaaaatggaaacaaataaaaccttacaaagctgtaaatctgacatggaaatatactatgccaaagggcacacttcatctgggctctttaaggtgaaacaactcccagttttcagccagagcagtgacctggccttagtatattgtgctattgtacaacagtctttatctgcttcacatcactcaagttctgtttaactttttgttgttgttgttgttgttatattttcattctaattcttagaacaaaaagaaatccttttacagagtatgataccttgaactagaagagccacttaagtatatgtgaaccaatatctagagtgtgacatacctattaaatcttaaagaaggaaaaaaaaagaaaagatggttaaaagatagagagatagatcagtgggacagaatacagagtccacaagcagacctacacaaatatagtcatctgatttttttgacaaagg

SEQ ID NO: 115563 - DNA, 1004 bp, Homo sapiens
ggaagcttagttatggaatgtgagtatgggctgaaatctagctggggctctactcaccaagccttctgcactggtgtgagggtatgtcagtcctaagggtaccttcttctaatccttcagtctagaaaagttttgtgggttttttttttttttcctctagaaggcaccccccaggggaagtgttcctttcttttctcttttttttttttttttttttttgagatggagtctcactccgtcgcccaggctggagtgcagtggtgcgacctcggctcactgcaacctccgcctcccaggttcaagagattctcctgcctcagcctccctagtagctgggactacaggcacgtaccaccatgcctagctaattttttctatttttagtagaggcggggttttacccgattagccaggatggtctcgatctcctgacctcatgatccacccgcctcggcctcccaaagtgctaggattacagacatgagccaccgcacccggccagtaagtgttcttttctaattcacagaaaggtgcctctcaaggtagcctgtggatacatttaagaagtaaaagaaaatgagcaagtaggtataatggcatgttttcccaaaagctacagcacagtaaatcaggtgtgtcaaatttttagtaacatataaggcaacttggagaccgtatgttgcaatggaaagagctgtgggagggagtttggaaaccatgcttatagttttgcatgtctcttccccaactatttgacactgggtgttcttttcttaaaaatgaaagaattgaactacctgctacctttaagggtgcatctaggtctcaacttctgtgaaagttatatctggaacgtggtaagcagggagaggttggaactaacaatttaccaaattggcaagtttcctatgttattaaaagtccttgagatatatgtttacatgatctgtattagtatggcttgaaatcatgtagttctccaacttccttttttctacttattt

SEQ ID NO: 115564 - DNA, 1663 bp, Homo sapiens
accttaagcaaatagtttacaattaaatttaaatattgctgaagcccctctttttcctcaaagtgcttagaaatgttacacctttgaggtaacctaatgttcatttgtggctctagaagacaatggacaggaaagagaaaagttaatctcaaggcagtcaggcacaaatagcactgattgcctgttactttgcaaagcattatgtggtatgttctatttttaaatttcactttactgtttttactttcattcaattgttaatcagaaatatctcctctgtggagatgtttttatcattcttggaactgcatggagatttccctttaataatactactgtttgcagaagtcccaggcatgtgaccttaaaacaaaacaaaacaaaacaaaaaggcaaatcattttcctacttttagtatgtggttaggaatgagttggctcattcacatcaagcctaatttgatgtgagttagtatgaacctttgacaaaatccatggtttagaatttagactggaaggagacaataaatcttactgtttaaatcacccaacagagtaacagtactgtttgtaacatttctccagccttctttcccaaatctgttactctgtgatgtaaagccttggttacttttcagtacttttaaatttgtttgcagaaggtggaacccagaaaatgtgcccatcattgagtgctctaagtttagctgaggaaagcaaggacgtggtaatatttctgttccaaagagttgtatttatctgagttacaggactggtttacataaatgagaaactaagattttccatacaccaggaaaagtttcaaaaggatggctttcgtgcttgccacttcatacccaccaaatgttacaaacaaatactcatgtctgcagtaagacatttgtgggtgtgcgtaattgcggttcacaagtcattcaagctcaagtcttttccaggtacaaatgagaaaccctcagaaaatgaggctctctctgcatttttggaatgagttcagctattaggtttaagaatttatttttttgcacaaaagtagatatatcagagggtcttttgtttcaagaaggagttctaacacctttggtgtaaaatggcattcttgtaatctttatcatatgtaactacatttttggttgttgagattaggagttgaagatgttaagctcttcaatagcctgcatagttttaattaacttttaaataagcagaccttttgtagacagttaagtttttaatgtgactccattgcttactttggctactaaagtgtcaaatttggttccaaaactcatgagaagattcaaaactcattctctttttttttttgtgaagaaaccagaaaatatttcaataaagttactgggtttaatatctagcattagtcttatctcttttaaatagcaaaatgactttgtcttagcaagaatatgaagcaagttcagggttaaagaaattcattttaccattttaccactgtattttccattttgacattaaaaaaaaagccaaacctcacctcacgggggtctctcttatttagaggtttacaacttagttaagctatgtaattttgctgaacattttcaaactacaaaatatgaaatagttgtcgccgatcatagaaacctctttactttcaaagtatt

SEQ ID NO: 115565 - DNA, 1005 bp, Homo sapiens
tagctaagcaataccaagtaaaaatctttactcattttaattcaagatgtattgaatacttactaagtgcaaggaagtatgcagaatgctcatttatttgatactttgttggaaagttaactatattgaatttatctcactcgttttcttttgtcttttaaaggtgagaattctaactcttttagaaactaataacagtttcaattaagttcttgaaaccagattttcagaaaagtttataaacaactatttcagtgtatgacatagcctttcagtataatttggagagcatgatattgttacctgaattacttctctttctactactagtagataataatcttctactagtattaaaacacagaaatgttcttagagagggaaacataagtaactggttagagtgcttcagtaattttgtatctgctactaactaatgcctcgtatttggtcatgtttttatgtgcacaaataaaccaaaagatcacagtgactaaaaatgttttaataactttaggttgtatacatactgaatggctaaaatctccagcataaatgaaaatgaaataaatggctactaataaaatagtatgcctctatcatattcttcagcccaaagcatttttgctgacagcatttattagatatctaagatctacttcagggagggacaaaagagccaaacagtgttttcagagtcagatgcttaaaggacgaaaacctttttttttttttgagacagtctgtctctgttgcagaggctggagtgcagcggcgtgatctcggcacactgcaacctccacctcccaagttcaagtgattctcctgccttagcctctggagtagctgggattacaggcacctgccaccatgccccagctaatttttgtatctttaggagagatagggtttcaccatgttggtcaggttggtcttgaactcctgacctcaggtgatctgtttgcctcggcctcccaaagtgctggaattacaggcgtgagccac

SEQ ID NO: 115566 - DNA, 1092 bp, Homo sapiens
ggactgaaacttttggttttcataatgtttgctttataaagttgatcttggatagagattattaatacagtctatgttctgtgcttcaggatgaaataaagacacatcttagaaatagctcttcttacggctgttactatatttcagttttcagcatggatgttgatttttatgtgttattctcataaatacccatcactgtcctagcttagggtcataagccatcatggctttagtaatctgcttctctccttgattctaggaatttttttttaataacacttgggaaagatagacatgctaattcctctgtaagaagactatttagtataccctggaattaagggttttgaagttcttttttgaaagatttatcgtcaaaaaaaaatctagtttagtatgtctagaattgtgttgtttactttttctctttttgcttcctcccctgcaatgcctacaggctgatatgagatcactggtgctgagagccaagtttacagtgaatgtggtcatgtttaaacttttgctatctttaataaatgcttggtaacctcaatattaatggtctaacaattagcaattctagacctgttgaaaaagagatgttgttgtcatatttgaaaaaaaagtgatttgggaataaataagaaaagagcaggaagttttcatctccaagtaattattcagaagagtgttttcagtagtattttatttgcagtgagtgaaatcagcattctcagagactagtgtttgcaactagaaaacatgtctttctctgaacatgtcagcataataaacagccaggtgctttgtagctacttcccattatatagataatgttgatgtagagcaagattcagtgagttctatgtttaaaataaagagatttcagttaatttattgcttctttgagagcaatataagaaatgtgtaaggtatagttgtcctttacctatgaatcaaaactaagtgccatgaggaacaagtagaacgtcttttaaacttacagaagtaaatgtttgttgaataactacccaagcaagcctacacaaagaggagttggggataatctggtaatactattcctactta

SEQ ID NO: 115567 - DNA, 1010 bp, Homo sapiens
gtttttttgtttttattttttagtggtgacattttggaataagaaatttgtgacttattgctctctttgtaaacataatttcacaaataatttagggacttggatcattcagggataccatgtttattggaagaaaagattatattaagtaggtggcagtttaaagaggttgaaattaagttaaaggtaagcatttggaagaatatttggaagcagtagaaattgactaacttagttgtctacacacagccatttctataataaattccatttttttataactctgaaaatcaattctgcattaaattttactatttcggtaaatgatcttcatacagtaacactttgtgatggaccagatgttgctagcttatgtaattaacccaggtgaaaatataagttatgctgttgaaaatctttaaatgtataaaagcaataaagaatagtagtattttagtaacaaagagaaacgtgtaggtttactgcatcttctagcccattctccctgaaaaggtaccatattggagatgttataagctcatgcttgatttaaggtttgaataagttaacagctgggcaatatgttgttttaaagaataaagtctaggcagcaccatttattattagtttaaatttcagtattcaatttattcatcactgcctaataaagaccctacttcctttttcaccagttttactcactgactgatgttctatcactgtctaaaagaagacaaagacagatgtctctgtgcaggcagaagatgctcagtcaggatagctgtgtgatgtctaccaggtttaacaaatttagcaatacaaagcataaaaaagtggactcctgaaaaagatctgctgttaagtaattcaagaatcacaccctcaaagatcctgtttgtagtttttggtaacctggagggcatatcgagtaggcacctattcaacataatgtctaatttgttgacactgaaaaaagagttcaagattatactcaatatatttgtataaat

SEQ ID NO: 115568 - DNA, 1914 bp, Homo sapiens
agcagaagggaagtggaagagagaggagtgttttaggtcatgaggaatagatgttaaagattatattatacattctgagaactaacaggattttaggatgtgggaatgcatgcaaaaagtgaggcaagagataaagatggagaatgaagcagagctgagaccatgaagaaccttgcagtcttaaggagtttggactttgagaattaagggtcactgtagcattgaagtgatgagatcaaatttctcatcactttaaatattgtttaaaatattgttctggctctagtttgggcagggacttccaggcaagcaaatcacagagccccaaggccaaaaagatgtgatacacttgatttgggcaggcatctgtaccaaaagagtccaagcctatcagttagacaaggcagtaagaaaaggcaaattttaaggtcaggtgagcaaaagcactgtttatctaattgctcttctgtcttgaaaaagcaagcaaaatacttcctgggagacttggaaacttcaacccatgcagtgaggaaagagcctggatttagaatttgaaaaatgcatcataacaatagtatcatcatcaacatcatactgtgttgttattatcaggaaggccacatttaggtatacttgattatagacctaaggtaaggataaatatagggagcttgtgcatcagtattgagagttcagaaaagtctttgcagagaatatggcatggaagctgagatctgaaggatgactttgagttatgaggagaagggaagtggaagagagaggagtgctttaggaggaatagatgtgactcaaacagaatgactcattttatgccttattcttgaatagatgctcatgatagatctctcatgcataactggttcaggacccaggtggaatgggcttgcatgggaaggaggcacttcaatgtctgtacctgcactgtatgagagaggcagggccaaaagttcctaaacgtgaaaagcttcagtaattcaagaggatcacttatatgcagcttcatttgtgaaacgctttgtaaagctttatgatatcctagaagccattttatataattttgatacatgccgatgaaagtctagatgaatgccagagaaacttccacctcatttttttcttatttaatctataccatgtactatatttaaatcatttgtccatatattcatttttttacataatgttgaaagtgttttgatgtcggtaaagcaaatttaacaaggcaagaacactataggaaatgggaaatcttaaagaatttacataatgcttatctgttaccaagtatggctttcacaaaaatgacctcatcctctttaaatcctgatcgacatcattctatctgatgctcttatctcagtgatttttattctgtgtgctatattttagacgtctgtcttcacaacaaaatttctcctcttcccaaacccccacatttccctctgatgggtcccagattagtattctgtactctttctcccttagtgtatgcctatatttatttagcaccaacaacatactgagtcacagtgttggatactgtgataaatgtggttcattaatatttttcctaatgacttcagtttttcatgaaaatgatgcctactcagtataaaaaattaaggcaatagagcagaaagaaaagaaaatagaaacccaaaataacaacacacctaaaaatattctgtgaacacggaaggtgtacaaaaggaatgcataagcttttcgttttgttttgtttcgttcacttagaagcattattttaaaaatagccaaagaaagaaagcttttttccaaggacagtaaaggtcagtcaattaaaggaagtctattaatgtaatatagcatattaataaattgaacaatagtatttcaatttttaaaatacatcaa

SEQ ID NO: 115569 - DNA, 1032 bp, Homo sapiens
aataatctctacctcaaagaccttagtgttcggaaaacatcatctaaatgactgaattacttaccaaattgaaagctatacaaagtagcataataaaaagataggaatgtttgatggagtaaatggaagatgtgtttgctgttccctgtgcagcggctacccagttccatttttatgtcatgccaagtaaatatgggatatctacagttgtgttcatatagctttaagaaataggaaataattgtacttacctgagaacacataatgacagcctaaactaggcattgatggttaaagtcaagaggagctgttatatgtgagagagattagaaaatgatgtacttcaacactgattcaatgaaaggaaagggagaagagtccaagggaaatttaaagtctggtcattcaaaagattatggttccatgatcaaatagagacttcaggagaaggaacaaatttgggcaagaaggagacgatttcaggtttggacataaagaatttgtaattatgttgagatgtccagcctgctgtttctctagagttgagtccttgaaatgaggctagtctcaattgagatttgctataagtgtaaaatgcacactgtattttgaagacttagtacaaaagagagtgttgaatatcacattaatattctctatattggttttatgttaaattggtaatattttggatatattaagtatgtaaaaattaatgtttccttttagttgttgttgttgttgttgttgttttgagacggagtctcgctctgtcgcccaggctggagtgcagtggtgcgatcttggctcactgcaggctccgcctctcgggtttgcaccattttcctgcctcagcctcccgaatagctgggagtacaggtgcccgccaccccgcctggccaatgttttgtattttttttagtagagacggagtttcaccatgttagccaggatggtctcgatctcctgacctcgtgatccacctgccttggcctcccaaagtgctgggattacaggcgtgagccaccacac

SEQ ID NO: 115570 - DNA, 1051 bp, Homo sapiens
tgggattacaggcgtgagccaccgcgcccggcctcaatttgcttttatgattgttaaccatgtgaaaatatttttatgccataattagaaagagaattatattagtaagtatttttctgttaactttccttatatcatatagaaataactggattttctctaaatccaaatgactgttaaaattagcttcacccaaaattgggtcatttgattgatattgtattttctcatctcaaaatgtgccattttatttatttacttttcgttgttttattttgaaattattttagacttacacagaagttgcaaaaataatacagttaccatataactttaatgttaaggccttccgtgaccatagattagtgatcaaaaccatgccaataatgttggaacaatactattaactaactatagaccttatcagaatttcaccattttccacactaatatcctttttttttgttctatgattctatctaggattgaactgcatttatttgccatgtctccttagtctcttttgatctatgacaattcatcaatcattccttgtctttcatgaccttgacactttgaagagttttggttagatactttgtagaatgtctctcaatttgagtttgatgttttctaattgaattatgattatttatttttgggaagattaccacagaagtagtattccttctcagtgcattatatcaggagtaacacaatgtcttctgtcttattgttggtgatattacctcgatcccttggttaaaatggtgtctgctgagttgctgtactataaagttactctttttacctttgagttttataaatatttaggggaaaatactttgacactatacaaatattctgtttctcttcaagtttctctctactaactttagcatctattggtagatggtagatcttgcttattggcaacagttatttactgtggtgttctaatagtgcctttctagttctctgatttctattttaattacttggaattctgtaagaaagaactttctcttctgttatttacatccttacttca

SEQ ID NO: 115571 - DNA, 1272 bp, Homo sapiens
gagatagagttggtttcctgtcttggctctgtcaggttctttaataaactatataatccttttcattaaatcatgtctctaagtcttttccagatttctttaagtttcatatcaaaaccagtaccaaactgaacatagtcacatagagatgacaggtttggacatattctctaatcagctttaaagagataaggtgttaggtcctctttcaaagttctaagcagacaattcctgctctatgactggtgccagaaattagaggagaagggtcaggctgagcttgtaaatcaagaaaaaattttaaagccttttcatgaaacatatccctgaggtgcctagtacctctcaagttgcactgggttatttcacatttcttcagactatctttttaatactggatcaaatcagactagagtccctcaggcttgataggttgtgaaagtatatagtttttgagtacttttcatctgggtaatatatagtattaaactagcttggtcttagttggtataagaaacaaaaaccctctttgagtgttagctctgtgttctacttaataccatgtaaaattttcttattgagcaaactggttctcttttccaaagcagttaactttctttaggtactgttgagttattttttttttcttggaacccagaagtatcagacctatttttcttcgtagtctactcttaatctatgtgctaatttttactttatttacataaagtgaaagtatatttgcacttgactcattggatgcatctcaggccagccatcattttctagttcttcttactttgggcatagccactaataaattgattatctggttttctaagctaaaaaccaattaaagtataaaagtgagggagcgtatactctaaaagggtgaattttatggaaagtgaagtatatctcaataatttaataaataaataaacaagcaaaagagaagccagaaaaggcactgacctgtggacctttctagcccagtattttattgggctaacaacaaattttttttaagtgtgagagaaaagcatggctagagacattcattcattttggtagcagcaagaggtgatcgccaaccagctgacactaggtcaggaaacacaagaacataagagtcaaatattatggaaatacttgttaaacatactttactctgaatgtgtatatctttaaaagataaagttatccctacctattgtaatgggcctgattcattaagagaagtttaaattgtatttattattctttaataag

SEQ ID NO: 115572 - DNA, 3290 bp, Homo sapiens
tacaggcacgcaccgccacacctggctgacttttttatttttagtagagacggggttttgccctgttggccaggctggtgttgaactcctgaccttaggtgatccggctgcctcagcctcccgaagtgctgggattacaggcatgagccaccactcccagctctgttgctactcttattaagaaccaatgtatttaggatatctctctgcatccctttgctgtcttaacacagttttctaataacctttctttctggcctggtggttgtaatttcaatgttgagaatttgacaagagcctttagctatatttttagtaactgcaatttgtcctcctattactaatatctgtgtcattcctgacccagtaaaaatagattgcttaattcatacaggtaaatattagttgggggtcattactgtctctttatttaaaaaaaaaagctgtatttcttacattataaaagtaacatttattctttgcaaaaatatcagaaatgtagaaaggcataaaggttaaaaagaaagattaccccataatacttcgccaaagataaccagttaactttgtgatatttattttttctggatttgtttcttttcatgctataaacacacgtgtttttttccccataatgtcattttgttataattttgtttataatattcctttttaaaagaatgtttatattgaaattgaccaagaattcttaagggggcaacttgctttaggagtatgtcttcttaattatcttacatcacacaacgtgagatatagaggatgatggatgtaaagaccgtacaaatgcagttgagacatgaaaaattcccactatttcagctctggggtttagactatgtgggagcaatgatagccagggactacatttccattgctgatgagaattctttatctctcgttctttaaaaaaaaaaaaaatcatttaaaaagtcattaaaataaatcctgagctcatgttgtagtctgttacctctttctcagctggccactaaaaattctgcaaggaaagattacattcaggttaggtatttggagcctacattgaaataattacaaatttgtccactcttggaaagtagaagaggtgaagggtatgtgtatgtgtgtgcgcacatatgcacgtgtgcatgcgcacacacacgtgttttattgttttgttttgtttggatatttagattgtctccagagaggaactaatatcatcattaaaagtttgattataaccagtgttcccatttgggaatggagttgttaacttttccagactgctgtcaagaccttattttaagtaagatgttttccttttatgtgacattttctgaggttttgccaaaaatgacatcaaacatataattcattcgagtgctgagtttcttcaacatcttgcagcacttaatcaaatttgggaaagatattcttttcacaactttatagtgtaaacctgtgaatatgttgcattaaaccttactttgtacagtttaatctgcatggtatcaggttgatttttaaaaaatgattaatgcaatagctgatagtttttaatgattatattttcaaattctgcacataaactccaggcagatggtacagttgcagcttttgagtattagtattttttcacacaaaactcagataatccctaaattatattaatagctacattaaacaatgccagaaagaacaaaaggaatactgaagttctcagaaaactaacaagatgcccaaatactgagaaatcattgagaacctattttgatatacaaaaatattttaggttttttaaagaagactatggccacgccagaatgtaagtttgtttaaaacattatgctgcagtatgttaaaatgtgaaagtaagctagccttaacgaacgtcttactcattagaaactctgatcttgcgtgtgctctatttatatttgttacttctgtgcaataatcacagtcctgaagggatcatctgggccaatccctccttttttttttttttttcctagatggaatctcgccctgttgctgaggcttgagtgcagtggcacgatctccactcactgcaacttcctcctcccaggttcaaacgattctcctacctcagcctcccgagtagctggaattacaggagcccgccaccatacccagctattttttgtatttttagtagagacggggtttcaccatgttgaccaggctggtctcgaactccagacctcgtgatccacccgccttagcctcccaaagtgctgggattatagatgtgagccaccgcgcctggcccctccattttatatataaaggaaacctagagcttgccagttaaggtgcttacccaatattacagagcaaagtaatagaactagaactcaggacccttagatttgtgtccagtgccctttatactacttgtttttcaatgtgatccaaccttgagtggatgtagtctatataaagttttaattggtatttattaaaatctactttggttttggctagactaattgtttctaaaacccccctaggcaaacttagagtcttttggagagcacattattatcataaatctacacctttttaaagattacacatgtgatttgggaatgaatgacaaaagattattatgtaatggaacacatcaatttctgtcactatggcagcctaggagtccaaactgatcccctcactaaaaacaacgaaaaatgttggatataatacaaaaatatcttttgatatgttcctatgacttgcaaaaatgcaaggaatacttaaaccagggaataagtaaaggtatgaactaagataagttagtggagcactaggtcaggctttaaccctaaggacatttgttaaattgagtgaactggaacattgctttttgaaatctcacaaagttcatggaagattatgtaaaacttaaggttttcccaaggtagcgagggtctaacaagactattctgtgtagttgagggcccaaaggaacacatccttagtggcaggaataattagaaataagcagggtcacctcatttccatcagtgggctacaagggaaattacctatcttgaatcatggcacaaaatatttgggagcaagagcatctcttgggaactctagcaacaaggcagccctcccatcagttaggagtctaaattcacactgcctgagtggtctccaaatcttccagccaagaatttagttgcaatgatagtcttggagaaaaatatgagcaatatgtgttcacagataatatgtgaacaccctatacaatgtaacag

SEQ ID NO: 115573 - DNA, 1019 bp, Homo sapiens
aacaacagatttgcctgatctgagtgttcactttgtgacaaatcattgagctatacttttttaacttgtgtactttccagtatctctgttacatttcagcaatgcatacaagattaaacacacacagacaggcaagagatgctaataaataactaaacattcttatgcattagatacttttatccttttggttcccaactatgtcttactcccagggtcctctcagcagccttctctggttggccctgtaagcatcatcacatgactcagtttaatgacagctccaaaaatagcaactaccatttcataaatgcttactatatgccaagctttatagtagaagctttacacgtattatttactttaattcttacccaaaaaccctataaaaatacatactatttttccattttacaaataagaaaacctgtatcatggagagagtgatttgattatgtaatataattgtggagctggaagaatctgaatgttttgttctttctattgtatttacctgtaacagaaagcctgtgctcttttcactttgttcatctgctactctggaaggtttttaaaggttttgttctcatttcatctcactgattgagaaagagcaaagctcaagtaccattttcttatacctttggctgttccttttatacaacatccaaataacccaagtttaatatgcccactaaagattttcccgttcaacaatgaaattacattttatagactaattttacaagattttccatatttgcttaactatcttccaaaattttgcaaaagaatccaagatataaaatcaagagaatgttttactttcttttggtggcaggtagcattacagaataccagttttcaaaagccaatggagtatcatggtcaagagtacagcctttaaagtcagaaaaacctaggtttgagtcaacttttccaatttaggcctatgtgatcttggataaattatacaatgtatctaggtattcatgtttcgtggccataatgaagtacaa

SEQ ID NO: 115574 - DNA, 1034 bp, Homo sapiens
ggagtaagttgaagagctctattatacaaaatggtgactatggttaataacaatgtattatatcctcgaatattgctgagagtaggttttaagtattcttgccacaaataaaaaaaaactgtgtcaggtatgtgaggtaatgtatgtgttaattagcttgattcagccatccaatatatatttcaaaacatgatgttgtacaccaaaatatatacaactgttgtatatatattcaaaaagggaaaaaaagaaaatggagttcttaatttagcagatgatgcttaaattctttttaatctagaaagtatctatattattctaagatacaaaaattaaaataagaccagttggtctttactgtttttctcagttttaacaaatgtaatgcaatcttagcttggatcttctctgctcttttttcttcattttttctgtttaatataatagtatctctcactttcttaaatggttgtatgttactgctatgttctatggaacatctaccagagtcctgtccaattctctacccacccacctccacgtccatccctcagtgattccacattgaacatgagcaaagccattcttccggagtttataaaacccttcaagattattgaaaatgaatggtgttatataaatgtcatgttgtttcatagcagttcttaaaacaatgagataatgtctgttaaataattttaagttccatggagaaatgcagggcataaatacaagtcattttttattatgtgatttccatatatttttgctgtacaatttaaaacattataatctctaaagatataaatgctttctttgtgtttctatatgtatgtgtacacacgtatatgctgcctatataaaattaataaataattttgttgcttcgttttgtcatttgggcccagtaaatttgtcaccataaatactggccagagaaaaattagaaatctaaagcagtttcttttagtattagacatagtgtttacttcttaactttgtacttgtgtattactgaaatttttttcttttct

SEQ ID NO: 115575 - DNA, 2708 bp, Homo sapiens
tccttgcatttcaaaggcaagggtagctaaatctgcctcagccccttagcgttctgtactacccttatcttgccatttacaacatgaaagtataataatctatttacatgctggtatataccactatgagtttctgacaaacatggcacatcttggtggtagttcatttattctacaaatacttattcaatgtctactatgtgccaggcacacttttggacattttggatacatcaggtaagaatataaatacctctgccccatgaaccttacattctacctatattgcaaagttcctagcacatcgtagatttcttctcatggtcataagatgtctgcaccaattctaagcatcacatcttcatagaaaagcatccaaaacaggaaggaaaaattagaagcaaaagggctttctccttttgggcctttcttttcataggaaagaaaatctttcccagaaccctcaaacatgtgatctggaccaaacactggctggcaaagagtggaatttcttaagtctgagcaacaagaagaaaaccgttaccataactaccaactcacctgcatctgtgccatgtgcttgcctgcccacctataactaaggatgagctgtttgtagtcttaggtcaactcctccacttgtgccttggatcctgccgcacgcccccatcacctacttgcggacattactccaacagttcttttctttctgtcctgtattatcaaatttctgttcttactggattttcatgctctttcatcattatgaaagcatgcagtaatttcttcattaaaaaaaaaaagtatatcttgtctccacatccccctctaactactgtcctttagctctgcttccttttctagaaaaaaactccttaaagaaatatacatgcttgtcatctccaattccccttttcctgtttactcttaaatttactccagttagacttccgttcacacacaactgcttagccctcttaagtgacctattaccagattttacactgttggtcactccctcctccttgaattattgtttacttggcctctagttttttctctcttatactaaatttatttgaaaacatctttaaatctcatggatttacatatcatctattgctaataatttccaaagtgtttaacatgcatctgaaacttaacatgtcccagattaagctattgatcttatatttcaaacctgctcctcctgaaatcatccctgtctcagttaattttggaatcgttttttgttcccctttcttttctaccccatcaaattgatcagcaaatccaggatctgtaggccaacaatttccactggtagtacctggtcagccacaatcatctcccgtgtagattagtgcagtcgtttcataattgatctctttgtttctacaagtgacctctgaaagtctattctcaacatagtatccaggatggtcccttaaaaatatggcagatcttgtcactcttttttttaaacccaccaatggatttcttaaaagttaaagcctctatgtttgtctagtagactctataaaatctgtactctctccccttctgtttacctctctgatctcatctccttatacttctctctcattcatgctgttctaggcacagtagcccctttgcttatctgagtacacatttggcatgttccctgcctcagggccattgctcatgctgttaccttttctggactgtggttcctccagatgttcacatggctcattcccttacctctcaggtattttcccaaatgtcaccttctcaatgagactttctttgaccacttctacctgacactcccaaattgttcttctccactttgttccttgtgttactaccttgtaatatactatatgtcttattaatttgttgtttgttttctgccttccccagtaaaatttttgtccgttttctttattgttgctttcctaacacctataacagtgtttgacattctccaaaataaaattggaggctgaataagtgaaccaatgaaagatgaactctaaaaggcttaaaacatttataatacatcctttgatactgagcattaagttgcctaaaccacttctccttttgttaacaaaaaagaagatagaagaattattacttgggcagtctactgtgtctaagttcatacttgtgaaaaacttattttttcccctgccttttcctctcatttctctctgacaagagcccatgagaaaggtaggataacaggtattttgcacaaagaagttgtgactcagagaagtaattgatgtttccccaagagcactaacagagctgataggacctagattgcctgacagcaactgtagtcctctttccataatggtaacagtcaatatgaagtatgatattttgtagaatactgtataatccttcatgtgagcttagagacgaaacctaccttcagaaaagtgattatgaattgacgttagtggggttttttaacctgtcatttgaatgaaaaagaaacttgctgcatatttaagattctgggttttttctatatcttgaatcaaccaactttcataataattgataagtttgttattgatatcttatttactgccagtatattcttttaatagagcagaatagagaatatgttgctttgctatcagatttctccacattttgcccacatcattcccatcttttcccaaccagaagttatctcctccagc

SEQ ID NO: 115576 - DNA, 1059 bp, Homo sapiens
cctgctaacatgctgccaacaatctctgttgctaatctcaaatcctgccaatacattctgtgtgtggcttttctgaaacacaaacacgatcatgtgtcaatccccttcataaagttctttaatggcatctcatttcctgtagcgtaaagtcctttgcgtggtatgcaaggccctatatgggctataatttgcctgccacactaagctcatctttcactatggatcccatgttccatgaagactagatttttctacatacaaatttatttcacaccttggcttttactgtcatggctcccttttcctggaatgccttttctatctaatgaatattacctcaatattcaagtagttgtttaagatcatttctctaagattcctgtcctgatactctttcatcattggaccagtgtttctcaaacttttctgcacattagaatcacctaaaaattccaaagcccaggggctgaaacccaggcatcggtactttttgaagctccccaggtaattcttagctgaattgaaatgtgaccagtttaaactgagttgtgctataaatgaataccagatcttgaagacaataccaaaaaatataaactagtttagtaataactttatattgattacatagtgaaataatatctttatatgttgaattaaattttaaacttataattaatttcatttgttttcttttaggtttttaatgtaactactagaaatttaaaattctacttatgccttacattatatttgtgttggatattgctggtccagaacaaatcacaatgatactaaactattatataaattgtaactaatagtaatatatggtatctgtctaatgtacacatataagtgttttttttccaatccttttctgcctcattgaaaaactaaacttaacataaattttattatactagaattttatcatgaagtattaattcattaagttgttaattcaggaaacatttgatgcttgttatacgtaaaatactctacaaggaaggcaaggaaaataaaaaccaaaataactatgtaaaattgaaaagttac

SEQ ID NO: 115577 - DNA, 1095 bp, Homo sapiens
caactagacattagtagcattaacattttttatatccatcaagtctattttgttaatcaaatgatgtttactgttattaccacatcacctttatttagttagcaaaaattttcttgaaatagtaaatccagagacatttaaaatcatttataagcaggcttattaacagttgctgtcacagaatagccactcagtacacttctttttttttaagagattgtctcgctatgttgttcaggctggctttgaactcctaggcccaagtgatcctcccacctcagcctcctgagtagctgtgactacacgcctgcaccactacacccagctcaatacactgttttttttttttaaatgaatgaatttgcagctacttagagctgatagctccttgactctggtcctgagacaacagagggtataagtataagctcttttaatctatacagtgaaagctgtggatagataacattggttcattaggtaggtagccaatgaagagactcaagtggattgaagattaagtttctgactagctcctagggaaaggataagggacatactttataacatgcaggaacaaatgtgcagtacttaacttgcagtcttacaaactaagagttggaatacaagttttagcccaggctctgctgataactcacatgagacactagctaagtaatgtcacttacctggtccttagttgcttcatctatcaacaggaagttagattagaagatcctcaagctacttcctagctcttgtgctctagtaaactgatggttatagtgatgttggacatttccttcccaagccctttcatatatatatatatatctcctatttttatctcatacataactaatatatttttttaattttattttaacgccatagcataggtaatctttaagtccccaagatgcttgtattatatccgtgaatccacattttgatacttacattgtaagtgatatttttcatgtatgttaagttcattttaccctttaatttctggaatgaaaagcctgtatcatatgttttacatttctttcaaagcatctcttagcataagaggcacacagaagacactgtgta

SEQ ID NO: 115578 - DNA, 1642 bp, Homo sapiens
taaaaaacaactcctgaatcacttgaacccgggaagtggaggttgcagtgagccaagatcgcgccattgcactccagcctgggcaacaaaagcaaaactctgtctcaaaaaataaataaataaaaaacataacttctcaacaactttagaagctgtcgctctctttagagcattctttatttaaagcagtatgggagcatttacagctgtataatgatagggaacaccctgtgatttacccattctgccctgaagcaccaagtttttgagttcttaacttctattacaaaatccaacacagttggctgtgttgaagtcaaaaaggtctcacccataatcagaggacaaaaagtcaagtttttatacactttccccctttggaaaccaaaagctgcagtaaggataagattacagtccaagactttgtcagatgacagttgagttagcaattgaggcatagacaacattctagagtttggtttcattctcagtccatctgctgaaaattgtttaactggagcttcattaagaatggaatataataaacaggggtagatggaaatagtattgaaatatgtttgaagccttgtgaaacaagagttaccttacttatttgatctgggatcatttaaatcataatgaaaagccataaaattttacccaactatttccttagcatttttcaaagcaaaactggttttgcaatcgattttttacttcagttagagaatattaagtcttttctttgtcattttaaatgtagatcctatcaccaaacagatattttcaaacagatcctacaatttacgggtgaattttattcattctttagatgcttgccatcactaccactaattgccttatacaaaacatttatgaagctggttatgactatacattaagaagaatgactaatgctacaatattaagatattatcagggcaaatacattcaggaggatttgaactacgtgcctgtgttttcattatcatggctagaaaatataaaaagagtgtttggtttcataaatactaatgaaataaattgatacatacattaaagttgtcttaattagcttttcaatataggttaaaatgtgagaaatgcaggaggaagtaaaataaaaatgctaacatgtctaagagcatctcaactggaaaatccttataaccacttttagaatgtgtatagcttcataatctagcaaaaaaaaaaatagtttcccttttccctccatcaatgtaagaaattcccttatatgaaagaaatgtatttgtatggagagggaaagagaaagaaaaacaagcttgacttgtgcaagagtctgtgatatcctttgaaagcttatcacttaaaacaaagaaaaacatatagagttagcacataattgtacagtcagtgtgagtgtatattttgatactttcataatttaatctgaatgagatagtaataatagtttgttaggtgtttgccacatgtcagacagtattttatttaatcctcacaacagcaagtgaggtagatattatcatccccagtttatagctgaagaaactgaggcacaaaaagatgacatagtgtatccctatctcactcatatagtaaattgtggaaccaggattcagatcagtctcacccaaag

SEQ ID NO: 115579 - DNA, 1076 bp, Homo sapiens
cttgctaaaagggaccgtgttcaagaagatgcgtgtgaaacattaaaataagcaatgctgaatctgttttgaaagttgtaagcttaacttacctatgacatgagatagcagaattcatctatatcttttccatttattgcaaaattcttaccacacataaaggttttcaatcttttttagctgaaaatgtaagcaaagaacttgtcctttctcttttgcatttttttaaccataaaaacattaaacagttctactgatacccatcacaattttccttagaattttacaaacttctgccctaggaaatggcagaaaataattattgactccctaaatgcaatggaacaggagattccaggtgcatggcaaatgctaactataactgaggctggcgaggggaagagggcaaattaccctacaccttcttattttccccttcttcaattacattattacttcatttatttgactatttattgaatcacttgccaagcactgtcctaagtgtatctttgaaagatacacttaagaaaatgaaatgaggacatgaaatgaaataagaaaaaaaaatgaggacaaatatgatttgtcctcaaggagttaatgtctagtgagtttaaagaagagtaaacaggaaatcgccataaagtgtgataagtgctaaagggtgctttggaagctcaaaggagagacatctaaaccagacttcaagaacggaatcagaaaaggctcactgaagtgccaaccaagctgagacctaaaggaggagccggaattaagcaaggagaattaacaagaacggagagatgaagtatttgcagtatccctgaaggaagaaaagcatgtgcaaaggcggatggttggtcaagagagcagggtttaagaatactagttatcagccaagtgaaagcacatgaaggtggatacggcaaaggagttgtctcttgagagacgtaactggaaagcaaagcattaactgcctcatgtagggatcctaagtcatcttaaagtgcttgctctttatcccaggacaatgcaaatctaactactgtaggataagaagaagagaggtattc

SEQ ID NO: 115580 - DNA, 1009 bp, Homo sapiens
gccaaacatgtattttcaaaagttgggtcttctgtcttctatgtaagcaaacttttgtttcccaaatcagaaaatagtcacctatctctgaggggaaatgtcagtgcaaatccaaacagaatgatgtcaaggtttattaatgtcattattgcagcctaaaggtagttttgttctttttgttcaaaatcaaacattttgttttacatccaagtaggatatttccttttctaccaaacttaagcatctcttttaaaattatatttatctttatcagaaaacttagcagtctaattgttatttcagacccttgcactgctgaaccagtttaaatctaaactcactcaagcaattgctgaaacgcctgaaaatgacattcctgaaacagaagtagaagatgatgaaggatggtaagggctttgatttctgtatattaaccatgaacaaatagtctcagagcagagacactactggggcatttccactatatcatccttttgttttcagagtttaccatcaccattataggacctcggcaacttttgactttatttcagttcaatataaagtaaaataaataaacacaccaagcactgaagaaacaagcatttattgagcacttgatgtgtccggcattgtgctagtcagtaaaaaatgcacaagaaatatatgacactatcccagttctaagtaactttctaatattgtggaaaagatgagactcacattaaacaactcgaaaacaaccttagaagataataaatcaataatttctcacattttcccacaaaccttttagaactcagtaatctatttcataatccgactaacttcctcttcaaagttatgatctacaggatcctagcaactcatacatagttaattttatttttatctttggatatttttcagctttttaagagactgataaataaagtaatgacatatacatatcctttgcttagaactttatcctatactggcaaaaaaaaaaaggaataaaaattgtgtt

SEQ ID NO: 115581 - DNA, 1450 bp, Homo sapiens
gattgcttctaagacatttttatgtgtccacatgagtggccacacattgagggatcattttcattttctgtcaagatagaaaccattaccaatttgttatgttttcttttacttggcaaattattctattcgcatttttggctgagctgctgtattggcatggtatacaacagacatttgggtaccattcagcagcattatactttttatgtaaaaaaaaaaaaaaaaaaaagagagagggagagaaagaaaagaaatatgattcaattgtaaacagtgcgtatggtgtttgaaaattattcccagatttcactaacaaggcatttaaagaagtgttattagtagatctaaactgaaatgcatgatagaaatttttcactcagaattactaggattcctcctttgttcagatatacactgccaatatttagtgatagtgatggtaccagattccagtttagcaggtagagtggtctctttgtcactatattccttagtcccacagtatacagactcatatagctgtagacccttctttgagcatggattttatgaaaccgattagacacatggcaggaggaatttgcccagggattcatatgaccatatggatgaagtccatatgccaaattgggtttggttagatgaagcttggtgagctcccaaaaaagttacaagaaagatagccacctgctccttacacaacaaaattggcatttctaaggagaggagaaagattaaatctatgtgaataggcttcgatcttatgcacattaactcttcactactatgtttcattgaaaatttctttccagattgttaattctaagattaacttgaaacattacagcacatatacaagataaaataataaacagtataatggtctgtctgccttcttcctctttctcttcttctttctctcccctccgtcactttcttccatagtacatacggtatttagtattataaaaatttgaaaaaataccaacaattgcatggttgcctcaagtaaatattttactgattattatataactaaaagatgttcattgtggccaggcatgctggcttatgcctgtaatctcagcactttgggaggccaaggcaggtggatcacttgaggtcaagagtttgagaccagcctggccaacatggcgaaaccccatctctactaaaagtacaaaaatttgccgagcatggtggcgggtgcctgtggtcccagctactcaggaggctgaggcacgagaatcgcttgaacctgaaaggtggaggttgcagtgagccgagctcatgccactgcactccaacctggttgacagagcaaaactccgtctcaaaaaaaaacaaaaaaatgttcactgtggaaaaatcagaatgcagacacactcaaaaaaggtaaatgagaattacctatgatcccaaactcaaagataaatactgttaattt

SEQ ID NO: 115582 - DNA, 1110 bp, Homo sapiens
agcctcccaaagtgctgggattacaggcatgagctaccacacctggcctttagttgttttcattcttatatttgtgcctagcctcttcaattcacaaaataatgtcctactgattctaagtgcttcacatgcacttgactctatggggtaggtattatttattatctttatttacacatgaaagaactgaggcacagtgaagttaaataatttatctgctttttggtcctcatagtaccgtatccagtgcctggttcataatgggctttcaaaaaatatttgttgatgttatgtgcatcaagatctgtcccatggaaaacaatggttggctatgtaccatactgttaccactggttagctggagatgcaggtgggaggataacaggtacaaatgggcatggaaagaaggtataattaacttctttaaatgtctttcaatcatttcacttgttacaatgagcaatccagtagtaatttttaatctgtcccgtacttgcttgccttctgtattttcttttggatgaaatgtctgttcaagtcttttgcctatttgggaattggatttgttttcttactgttgagtttcaagagttctctgtataatctacatccaagtcttttttgggatatgttatttgcaagttttttatcagatatgtgatttttctccaataatatttttcacggagtaaaaatatttaatattgattaagtccagttgattgatttatttccttttacaggttatgcttttagtgttatgtctaagaattctttgcccaacctaaagtcacacagattttttcctaagttttcttttaaacattttatagttttacattttacaattagatctattatccattttgaataaatttttgtataaggtatgaagtttaggttaaggttcattttcttcatatggatgtccaattattccagtaccatttgttaaaaagactttgaactgactttgcaattttgtcaaacacagttggctatattaatatgggtcttttcttggactctctattctgttgcatcaatctgtgtctttatcctttcaccattaccacattttcttgattacaacagatttatggtaaattt

SEQ ID NO: 115583 - DNA, 1052 bp, Homo sapiens
cacctctttttcttcctttttcttcaggatgaagacagctcttctgtcttaaccctgcgctttcatatggtttgccctgaaataagtttctgtcatgttggggaagtttgctttgtttgtggatctgttttgagagagatagggagacagccatgtaccccagctgcttaccaggcctttttgatagggaatctcatcttccctatggaagacagttgttctgttagtctactggctgtaggttaaatgttattggctgagcagttgctgaaaccccagggcaggtgtaagaatgcatattacagatttgttctggaaaggctcttaaatctttccacctgtgtcctgctgagtgttaagcacaatgttagataggcaagaaagctgagaaactgtgcattcccctgttgctaaagatattttgaaacctacgtctttcatatttactccaacaatactaaatatttacagaagacactatgaggatttcttttttaactaagggatacaaaagacgtgttttagagttagcctttcaaaactccaaactgagggggcaatataacattcctttaaagttcagaaacaggagatttttccatgatagtggtgaacagtgaaagaaaagccactggttttcatcttcgttttcttttttcaaaagtcagtttccattttcctttttgcttgattttcctaatgctctatttttctattcttatttttttgttcaagtattttaaaattttttgttcttatttttctcttactgttgatttttaatttctcttttgagttttttgtttttttaccatttgtatctgcatttttctctgcttcctttaactatttctgtttcctattctgaatcttctttcatcttttgcttttctccattgatctctttctctcctttggccttttctattactcaaagtcatccctgctctgctaaacatgaagagttccagtggccttattttccagaactttttttttttacatagtttgatctctgagctcattcacattttgtctgtctgtgtctcttc

SEQ ID NO: 115584 - DNA, 2252 bp, Homo sapiens
gagactttctgcagaatctggtagatgttttagggagtttatcatcaaaatataagacagtctctacccacaaaaggaagttgactcttagcttagcaagccttctagtaccagccaacaggcctgaccagtacaaagggtctgaaggccttattcccaacacaaatcaccatgtttggcaccgggaatgcaacagtgaacaagactcaaactgtctcaaacaactgagtctgttcacaatcaagtaaacaggcaattacaaaatggggagaattgatgaaagaaatgaaataaggttggtgagataggaagcaccagttgttggaggacttttaagggtagactgaggtatttatttcagtctaatatgataaccagtagtttctgatcaaaagaatgctataaaagaaatgtggaagaaatattattttttaagctttggatctgggaaggaaatagtacagatgtacaacaattaggacacctgcaacaatcgtagggttgggtgataagttcctaagttagggtggcttggatgtgggaagaagaggtttgtagacttcccaatgaaaaagatagctgtttatattatataagtaatttaaattcatttaaatcggaaatgaattgctaatgttggaattctatattagactacttattgtgtgtctgagaatcagttcctctcttgatatttcccattgatacaaatagctattgtatcttagtctatttcacaattgtgggagaactttaaaaactggataagaagttagtgaagtcagtcaaggtctagtcctttttgaaaaatcagttgtttacttctgtttgtaattttacacagccccataccaaaaaaacaccaaaaacaataacaaaaaaaccactttcctgtcaaacacaacctctctgaaaatagtaaacttccatattttaacatactatatatataatatatactatatactacaatatataatagattacatattatatatgatatatataatatataccatagagatcagttatatatagtgtatatactgtatatatactatatatactatataccatatgtataatatatagctatatattatatataaccatagattttatatatacactatatataatattgtaacacactataaagtcaatgttatttgagaatctgagcctatgtgaaattttttattaatcaaacctaaatttttgtctttgccttcaagtgaacaagctctacaattttcatatgtaaatgatcagtgtgtaattaattccaaaaaaattcactactttttttgggccaattccataaagagccgcagagtggatagtattgagttattgggacatacatgattgtaaactatcagaccccctgtactcaaattgagtccgtattctaaatcttattgtgtatcctcataggagactgtaaagtgcgggcatgctttcaattcgtacagtctgtgatttatagaggcaagtaggtcaggaatttattatgctgaaaatcataataactgttttgttttgcttttcacaatgaagtgaccaaagcatgttgaaagataaatggatgaagcattttgattatgcttgtatttctattaaaggttaaatattattgccaagtaactagccatgctaagtattatgatattaaagctgaagtagtttgtaagctgatagccctttctttcctctgggtttaggtttgttattaatcaaaatgttggacttgcttagtgcagtggtgtatgaaacaaacagttgaaaaagacagctcctttaactcacggctctctgctttttttcaaatttgtaaggaaatctgtttcttcttgtggactttatgctgttattcatgtgtctagagttcattttttataccagagccgactaaatccaatagttgcaagattctctcatggcatagaaaggaaaaaggtgcctttttatattcttaattgacaaattctgatcaagtcatttttgaaacatggagaatccctactagaaatggatattacagaaaaccatctgtatttctgggcagagaaaaggataattttttaaatagaagaatatgtatatgaagaggtattaataagacagtaagtttgttttctcatatcaatccaggagtattgatgaaagtgttttaaagggcgtatgattccagctacactggtgttggcttagacatcaacacagccagcccgtaagcacttggaacgctg

SEQ ID NO: 115585 - DNA, 1258 bp, Homo sapiens
atcagatagggctggcttattgtcttgagttttgctctgcaacctgactcactctggctaaaggaatgtgttctttaaaggaagcagacagtgtcctctgagtttactttgaggaacacttctgtatagaactcttttaacctcccaacaggggagaaacctcaagtgaagactgaggcaaagagactctctactagaaatacaaaccagcagaacaaactccagacatgtttttcaaatttaagggttttctgagaagttggtttccatgtggtgtaagcaccagtaaacaacaaacccatcttggtgttctgtatgcttatgtttcattatgtcgatgatagtagagtatagaatttctactgtaagttcccatgcaagaaatcactgaaccatctctctccctatttaggatgtcacatgtacttcagtttgaggataaaagcagaaaagtgaaagatgcaagcatgcaagactcagatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccattgttcccaacagcatcacttaggggtgtgaaaagaagtatttttgaacctgttgtctggttttgaaaaacaattatcttgttttgcaaattgtggaatgatgtaagcaaatgcttttggttactggtacatgtgttttttcctagctgaccttttatattgctaaatctgaaataaaataactttccttccacattacatgttaaccattgcagactgcaagcctgtttgtgtccttttaccctaaaatatatgaaggcttccttttcaagatttttttataagaagttcctacagaaagaatatttgtgggaaacctccctttcactaacttcagaatataataaaatattataaataaaatatagaatataaatatggatggggttttttgcatataaatatttcaaaatatccaagccagcacaactcaatatcctcatgccttcagtcttgaggaacccccaagtgaacattcacacctccatgcaggccagtgcctgggttttatgggcacagtcaagatactttaacactctaagtaacatcagccaggctcactgcatgcccagcctgacatctggccccctgcccactcctctgcccttctcagcacagcga

SEQ ID NO: 115586 - DNA, 1051 bp, Homo sapiens
cttttgatattggcaatatctagtgaagttaaaaatgtgtatatccaataacccaaaaattctaattctaggtcctaggaatcctaaagaaattctcacatattgctcaaggaaaggagtactaagttataaactaaagcatcaatcaaagaatggataaataagttgttgaatagtcatactatggaatactttacagaggtgaaaatcagtaaaccagagctatatgtagtagcagatctttaaaataatgtggaaaaaaaggaaaccgcctatataaaaattaagacacaattcattatgatatattgtttatgaatgtacacatatgtagaaaagtttaaaaacacatgtggaaatagtgtttgcctctgagaaggaattcacagggagctcacttgtgtttgtaatgttttattttttaagtgctggatggtagatactcagttctcattttctgtacattttggaatatctgaaatatttcacaatttttttatgattatatctggaacctgaggtgagaagacagaagaacccccagtactaacaagaaccctttctatttgcttcaggaagaaggagagagcttcaaagaggaggagagggctatgattgaggtgttctgagaaaatgtcaacccactcaaatgcagagtggtcagactcaaagccaccccaaaataagccagtgcttggaagtgtgtcccatcttcccctcaccataaaggttataatattggttttatttcagataaaacagaatttcatcttccaaactcacaaagtctctgttggttattctgaaacatattaccactaaatctgtctgtgttgaagtaccctgtggtttctctaccattcctcctggattgtgtccaccttaaccagtgcagtgttatcctggaacagaggaaaccacagacctccagggcacacattagagaatactatttgcaggtttaaaaagataactgaatgacaaaattaaaaccagtttggttgaatgtttctcatcctgttttaaccacaaggagcagaaagatctgaaa

SEQ ID NO: 115587 - DNA, 1066 bp, Homo sapiens
ttatacatgatattatgtgaggactagatccatttcagagtgaaattccataatgtccatcaaacctaccatgtccaaaatgtaactgtcatctacacttcccagccctgcctccaccaaacctgcttcctctgtaattttcccatctccattatgggcaacgtgataattgcattgcccataatgcaatttccagttactcaggccaaatagcttggattccagtctttatctcacacattcagtctgttatgatattctgttgactccaccttcaaaatatttccagaattttaccattatttgctacttcccactgctaccaccctagtcaaagggaccatcaactgtcatgtggactgctataataaactttcaccctttttttcctataatttattattaacatagaagccagttacactttataaaacaagtcatgttgttatacttatctgttcaaaacccttcaatgattccccatttaattcacagtaaaagcctaggtccttacaaaggcctaaggctctttgcagttaccacctcttcctctcagtctctctgactttctctcttactaccttctccatcacttattctgcaccagccacactatccttcctgctgttcatcaagtaagctaggtgtgttccatctcagggcctctgcaatggctgttccctccacccagaatactgcccctaggatgtccacatggccaactccctcagttccttcaagtctttactcaaatggcaccttctcaatgaggcctacaataatcactctactttaaaattccagccacccctcccacacgctcagtctctcaatctccctgtttagttgtattcaatagggctattaactcccacgtactttgccttatttgcttaattcttacaaacaaccccatgaagtagggactcttgctatcaattgtatagatgaggaaactgagccttaaagaggttaatttattctttatcatccctctcctgccctagaatgacctccatgaaggaaaggatttctgtcagttttgttcactgttgttccagtgccc

SEQ ID NO: 115588 - DNA, 1051 bp, Homo sapiens
ataaaaagacaaaacatagcgatttcagttgaaaagtattatacatgtagaaactaagtgaatgccagaatgaagcaagagatgggtttagtgggattaatctagaactgctttgtggcagacagaattctgaacataatttgaaagaaagggaaaacatggcattgaggagacaggtcatgttccaggtggggagaaggttgtgcagacaagttattaagacaaatgtcggagacagcaatgtgtctacatgatgccaaaacatctggtcaattcagtttaaaaaaaaaaaaaaactttcatcaatgcagtgaatttcttcagtcaatccagatgtttggcatcttgtagacaaaacatccagatgattaactgaagatttgacagaattgactggattaaccagatgttatagcattgtatagacatagtgtcaggccgtttgcttggctgaagcagagtccagctgtagaggagatagaaggcccaagcagagaggcgggatttggaggagaggacctggagattggatttgatgaaattggtagctgctggaagaggagggtgatggaaatgatgcttaaggaagataattctgtgtaaagagggggaaaaaatgctgaaaggaaaagttgtagacaggaaaaaggatattagaagagtgcaggtgtgtgtgtgaggtaattaaagcctggaccagacccaggcctgggaaggcaacaggaagaagcagatctgaaaaacattacagaaaaagaacaggaagtcatgatgggctagacaagggagtgaaactgcacatcaccccaaggctggaaactctgaggcctgggaaagcagccgctgtcagcctcatcacagtaatgaaccaaaggacccctccccacagcctcacatccaagggctacagccaggcctacagccagagggaactcagagaccacaacacaaccctcatattcaggttccttaattattttaatgctacctaaattgaattccctttaagcccagtttcatgaagtgatcaagaatgctagattaggattat

SEQ ID NO: 115589 - DNA, 1012 bp, Homo sapiens
gttgatcttgtagtcacaaattccactttattaggatttaaactgtaatagttacatgatagagtatactccatcttattttttaaaattctcaatatccatacacttgacggttttgcaattttgcagtttcaaatatttttagccccaggcctatcagcccacacagccagttgtgtgccctttataaatacacccagattttctcaaactactcctttgtttatttcaacagagaaagaaccttcaatagagactaatctctctttgttcatggattggtactgcactgagaatctatctccatcctgctcccgacaacacagaatgtgaaatcgtaaatgtattaatgtgcttcagaatcaccctgcaggaagtggaggggcaggaatcttgtcaaaatgagtttcccaggcctcagaaatgacaagtccgttgatctgggtaggggtccaggaatctgttgcgtttgtttctttttgaataagcttactcaactaattctgatgcctattttctgaaaatcagaaatcagacttagacactgccctagagcagaaaactgaaagaatgaaaaacatcaaatggacatgagaatcttaaatggcaaaataggcttttttttttaatcaaagactcatattctcttaggtatttctttatataatgagcccctatgtaaatttaccatattctttgatatgcaaaatttttcacagaaactgcataacatcaaatacacctatacaatcagagaagccaagaagacaagtaggacagcttgtctgttcccaattcccagaacttcctactacaccccttcctgaacataatgtttacatgatgggaaaatgcaattaatgatcttggtaagtctttctagtgctccaagtttaagtcagtcacttatttataagacagaaaataaaaaaatttcacatcactgaaacaatgagtgatttctccaggtatttaaatatagccttccaatagcaattattttatagtaaag

SEQ ID NO: 115590 - DNA, 1043 bp, Homo sapiens
tgttgagcttactgagatgataccatgcaaaagatagactggctcggtaaccaggcagacccttttgcagtttgttgacaattacgatgagttccagatgtcccttctttgatatggtagaagggcatttatttatatgagagcaaatgtgtgtgtgtgtttgcgggcgcttttaagtgtgtggatagatgagtgtgcttgcacataatgtgctatttctgtgagttttaaagtaggcaagggataataaccaaagaagaaaatttcatgaagactagacatcataaagcataattttaatagtcactcaaccaagtattttttattttttatggatactctgaatggcaattaaatgtgaaacccagtttcttgggcaagtcaaattctggaatcacatccacctaaattaaaatgactagctcgtattttccccatcttcaagtttcacatcctggtcatcaaaagactcgacagcaagacttagaatgaaaaagggtacttgtttatattaatattttttacttgaacacgtgtagcttgcagcaggttcttgatgaatgtgctttgtgtccaaaatgcctccccattgtacacaggtgtacaccatgcatgcaccaacacctaaaactcaaaactaaatggctattttgtaaggttaatactttcagttaaacagcatgtttgacttgattccatcatggtgctcttaaattacatgtcagtgcatcacatatatcatgatctaatgcagatgactaggctttttccaaaaggaagacagaccctcagacaccaaaagccaatctaaacaactcccaggtttgctgtggacaatcagcatggaatgttttctgcactctcagtcatgaccatctgtatcttgttacctgctttctctctcaacaccacagttctcaaccctgagccttccagagagagctattgatgatacaagaggaatcaccagggcccggatctaagatgcccttagaagaccagcccaagtgccgtcttagccattcagtgaagggcaaacagcc

SEQ ID NO: 115591 - DNA, 1055 bp, Homo sapiens
tcatccttctaattttgtcaaagaacattaaaaactttatcatagagcaataccaatccatgccatttgggctacatgtctgactataacctacattttcctctgaagtgcccatgaattctaagtgattattatttttttataaaaccaacataatgcctggtgcatagcagattcttgataaatattctagaatgagttgggaaaaagctattacttttgtattgccaggcattcctcctaactgattggaagttgaccccataacattagagattccaattcaaatttacagtgtcatataacagaaatgtcctttagtggggactgtggataacttctctctccttccttaaactcaagagcaagcacaaagacccaaatttcccttacagagccttcccaaaacaaaatttaggattatcaaggggattctaacacacaggtgctgatttattaattcacagaggttatgaaactaatcttaataaatcttaacttctatcaggattcatgagtatgtgaaagagagctagagctaagctggtggatagtaaaaagaaaaaaagaaaatcattctttctcactatacttcagcacctcctatattttatttagggaaatctgcctactatgatggttgccatgcaaattccccaagaggcaaacaatttcagcatccatttaactttattagagcctggaacctatgttaggctgcttattcagcaactaatatgcatgtgcaaatgaaactgacatacctatgcaaatatatcatccatgttctaggatttagcagtttagagaaagaagtgtatttctgaaagtgtggaattgatctcaagttcatttaggaagtctacttcttgtttacttggtatgaaatgaaattttctttttatctttcaagagagtatcctttaaaagaaaaaaaagtcttgggaaacattccgaaattggataccagtatctttcttattcaagttgagattcaaattgcaagatctatctgaaaactcttcagagccttctccatgactagttctacattt

SEQ ID NO: 115592 - DNA, 1158 bp, Homo sapiens
ttttttaaaatccagtgctattttgatcagggattgaggttacatttatgttttatagttggctagaaaaggctcataacattttattttagcttctcttctcaagaaaaagaatcttgaaagatgaattgtttaggaactgcagcccagccaacaaaacgcatacctttctctacttagtagctgtataggccaaagatgatggtggattttaacaatgagctttctatgatttatagagattcacaattcactatgttcaactgaaaactattccatggccaatagaatacaaagtctctcgtgtcattctaaaacactagatgctattgatcaatcaggagatggtgtttaccaactcccaatattttttttcagatttcttaaactcggtgattcaataagtggttcatgaatcgcccagaagccgtcctgattaaataataaagaacccatttccgttaaaatggacgtgttatgccagcttctgatgttttccggcgacggctttgcaggtagtgtctttcctatctgcctgcgggactgatttatttatttatttagactatagagaaaggtgaacctggtattatggctcacactcattgatgactatggaccaatttaccaggcagtggaagacagccagaagtaatttaagccagtttttcatacattttccaccacttagcaataatacagaataatttcataaaggtttcaaaaattatgggggctctgtgaatcaactcttgctctgttaaaattaaagtctgttaacttttttgaactgtcaaagatccatagcaaaatttcctacagttccaaattaaatacagagtagacattttcacagaaagaatggaagctgaacgtattaagagaagcaatgttacagtcggagttgacctaggaagaaaggtgattgtagatctacaagagaactgatataagatgagcaagatgaccaaagcacttacatttcctctctagcaatgaccttcaaaggtcaacatcagactattatataaaaaacaatctttatagatgggacctttttaaaaaaatgtagaatctaagagcttggcaaaacaggtttctcctccttctgtttatctgatacatttgggtaaccttactctaaccataataactttg

SEQ ID NO: 115593 - DNA, 1046 bp, Homo sapiens
cattattgtgtatggtatggggagagtctaggtcctagattctgctaggcaccacccttattaaatacattcctacctaagttcagtatcttgaattcactttttaaagtagattgcatataaagttcaaaagtagaattaaattccaaactctgttttagaaaacacatgagcaaattgtaataattatcctattgggtaaatactaaatctaaaaatgtttgccagatgtgggtatagaaggttctgactgagtacatcccttaaattctgtcttttctttactataacaagtgattcatagtcaagctcagttatgtataagaacagttctctaatggaaaatcattctaaattaagaatgtccttttattcccttggttttttttcttttctttctttttttgctccaatgggaaagcttaactttgagatttttacagtggcacagtttagactatcattgtctcatcattttaaaaagttgcttcttaaagaaaaaattaatcatattaaacagcatgaggaaactgttctttaatctggtaattttatgtgtgttatctctttgaagaactgactgatcatctatttattttttcctttggaggcagactttaaaagtacatgttctatgtactagtgattgtttaacaaaatgcttgacagagtttaaagtactatgattatctaacaaaaacaatgatgttgatatattagcaacatgattatcttcagtttaaaaattaagattgcttagacagaaaaatttaacgaggcattttaagattttccttcgctatacagatcttctgtttggtttgaaaacatctgttatgattttaaaaagaatctccagactaaatgcaaattaaatttacactcagtaggctatgtttgctctttccattcttacaaatctcccaacagaaccaataagaattgtgtacctaaatcaagagtaagctattattttgtggtacaaaatgcattatgttattttcacagtgttaggggggatcatataatataggaggaaatgacac

SEQ ID NO: 115594 - DNA, 1048 bp, Homo sapiens
agtgttgtgttaaaaaaatttcctgtggatttgagatgcttggcattcattaaatcaaaccttaaaggactttgaaatagcacctactttgtttaacatttaaaaaattacaaggctcctgagactagtccttgggatagtctttagtgattatccagagtataataaaaatgcaagattttcagaagagggtatttaaaaagcaaaatagtgtaacacttaggagcataatgtttaatatacacctgaatcttggttccttagagagtggcacacacagactctgtgtcacatggtcagtgattagagtataatgtatcatgtgtgttccatacacatacttagatcttggctcccaaatcagggtagcaggtctagtcttctacttgcttgaattaaatactttttcccctagttccttaatcctgagcaatttttgtaacttttctgagactcagtttttttctctatgacgctctgctacttcataggattatttataagatcatatgaaatcaggtacgtgaaagcactttggaaattatcaagtgttaaacttactatatataatattattactagattagagtagataagacagaagctaagactctgtaagtttggagggtcaaatactggaaacatagctctacttaatgctgctgctaactctttttagtagacctaagttagatttaccacacatgcatcatggattttttcctttggattttatattagatccatatcattgaagagaatttgaagaaaactgagagccctgtggaaacttgaatgagaattaagtgaacattcagcatgacttccataccttaattccctacttgagcaatcctcctcaacccaatccatgttattattcattattcactatctggaatgctgacatgtccagctttttattgcttcgtgataagttgccccaaaacttggtggcttaacacaacagcaatcatttttattattgctcgtggtttctctgggtcaggagtttgggaagtgctcagctgggcagttctggctaggt

SEQ ID NO: 115595 - DNA, 1011 bp, Homo sapiens
cttatttattgctgaatttaaattgctgaaattttatgagatttttgcttctgtgttcatgaggaatattggtctgtggttttcttttttgtgatgtctttgttaggctttgatataaggttaataccagcctcagaacaaattaggaagtattctctcctcttcaaaagagtttgtatagaatagtaattttttattcctgaagtatttgtttgaagtcacagaagaaaccatctgggcctaaaattttctcataaactgaataaaaatttagagatgaaaaaaattttcatctgtgaaaatttgtaattacaaattctatttctctggagccagtcatatttcttatttgtctaaatgagctttggtagtttatgtctctcaaagaatttattcatctgatttgtcaaatttagtgacaagattgtcgataacatttctccattatcattttaatgtttgtagtgatgtcacctctctcattcctgatattggtgatttatgtccttctctccaccccataattaatctaattttattgaccttctcaaaaaaccaattttcattgcttttcccttatttttatttttttattttgtactgatttaacttctttgttgttattattatttcctcaacttactgtgggttttatttgctctttttcatatttcttatgatagaagctgaggttattaatttgagagctttcttttcttttaaaataggcttttaggccgggcgcagtggctcacgcctgtaatcccagcactttgggaggctgaggcgggcagatcacgaggtcaggagatcgagaccatcctggccaacatggtgaaaccccatctctactaaaaatacaaaaattagttgggtatggtggcatgcacctgtagtcccagctactcgggaggctgaagcaggagaatcacttgaacccgggaggcagaggttgcagtgagccgagatagtgccactgcactccagcctaacgacagagcgagattccgt

SEQ ID NO: 115596 - DNA, 1045 bp, Homo sapiens
aaaaataaataaaatgaaaactgcacacatttcgtaaaaagttgtgtattgtcaaggcaggtggatcacttgaggtcaggagttcaagactggcttggccaacatgatgaaatcccatctctactaaaaacacaaaaattagccaggcatgttggtggatgcctgtaatcccagctactcaggaggctgaagcacgagaattgtttgaaccagggaggtggaggttgcagtgagccaaatagcgccattgcactgcagcctgggtgacaagagggaaactctgccttggaggggagaaaaagttgtatattatataaatggagatggaaagaagtatcttagaaaaccgcaaaattaaattcttgatttttgagaattaactaaatatatgtgtaactttgttttgttttgtttttgtagcaattcccttgactgaagacgttctcataacattaggaaaagaagaggtaagccactcaatgaatttgtagtgaccccaaataatttctaactagatctattttagataagttcatggcataagaaataggataaaaccactctaaaaccatattaaattttctgcttttatttatgttttattgaacataatatttgattttttttttttggaaacggagtctcgctctgttgcccagtctggaatgcagtggcacaatcctggctcactgtaacctctgcctcccagggtcaggtgagtctcctgcctcagcctcccgagtagctaggattacaggcatgcaccaccatgcccggctaatttttgtatttttagtagagacgggatttcagtatgctagccaggctggtcttgaactcctgacttcgtgatctgcccgcctcagtctcccaaagtgctgggattacaggcgtaagccaccacacctggcctaaagatttgaattttgaactcggtttttgcatcagaactattactgaagttagtggttatatgtaaaccttaatctcatatctagtttttagttaaacttcacaataaaagcaaaatattaaacatcgctta

SEQ ID NO: 115597 - DNA, 2341 bp, Homo sapiens
tcccagtaaagtttcagaactggtcaaattagtgaggtttttctcttttcttacaattatttttaacataaatacttggtactttatattattaatgtattttcaggataatttttataatccccccacctttttattttttgcttcaggtattttttcagtatagaagtttggattttaaaatgacttaaaatttgtatagagaaatgctgcattacaaatgagcagaaatagaatttactcgtatttttatctcatataatcatcatgaacagttttggacttttttaatggcacagaaacaatgtctcctgaaggctttatttattttcttaggatttcttaggatctgaactatcttcttacttgttatttttctatagtgctttccctcttatttttttatctcccactttccaattatctgacttataattcattctagctattagtttttgggtttttttttttcctcttcattctagtgtctctttttacttgtgatgtattcaccttgggacttgtttggctgccttaatcgtcttacatagtgaggaatttcaataaactcttctccatcagatgtttgtgctttagaagagtgttatattggcctggtagaaaaggagaggggaagggaattttctgtgaattatcgtgtgtgacttgcctttttttactttttaaatcaagtgtcagaataaattatcacttattggaactgaaacactcaccgattcaaatgctcaggtatgaatctttttcttcctaaaaaatacaaggtaagtggaattaattgtattttggaaaataaatatgtgtgtctgtatttttctcaagtttaatacctttgttaatacctgtatgcttaatcatttggaaaacttcttactcttcctgctttaagaattgaaagaatattctaaaaactttctagaacaagctattataaataagagagtattttctttattatttgtcttttagcaactatacatatatttaacaactgagtaaattgcttgttagttgctattacgctgccttgttaaaattagaacaaagaccagcctggcctacatggcaaaaccccgtcgctaccaaagtacaaaaaaattagctggtcttggtgatgtggtcatatgatcccagctactcaggaggctgaggcgtgagaatcacttgaacccagtagatggaggccgcagtgagctgagattgtgccattatactccagcctgggcgaaagagtaagactgtctcaaaaaaaaaaaaaaaaaaatagaacaaaggcggctaactttgtgttaggtataatagtcacagatattttactatctgtgtcgaatctgaattgattttactcttggcctaaaaaaaggactgacattcattataataatcagaattatggaattgctgtaggaatagatcagtggatcagtgaaacagattaagaattaaaataaagttgcctctggagcagcgtgagagttagggatgccacccccctgcaaagttttaaaatattaagaatgtttatattttcatctatgaataggtatgaatagtccacagaaaatgactttgttttcttcttttgtagctatcattgttaattatgcaagtaaaatgtttaaccgctgaactcagtcaatggcagaaaaaaacacctgaaagtaagattcttattttaaatttgaattttttgtaaacctattaatagcaaattaatttaataattgtaggaaaaattacaagatccatttggcctttttgaaattgcccaaatttcattgataccgagaagccactttttttctgtgaattattttgtacttcttttattattattgataaacatatcttacattagattataataagcttgattatggagacgttattatagctattatgttatcctcatagacactgccttatgctcgctagaaatggtaaattgttcctttttttttttttttttttttttgagacagggtctcatcgtgttgtccaggctggagtacagtggcacaatcatggctcattgcagccccgatctcccgggttcaagtgatcctcctacctcagcctcctgagtagctaggactacaagtgtgtgccaccatgcttggttagtggttggtttttgtatttttttgtagagacggggtttcaccatgttacccaggctggtcttgaactcctgggctcaagggatcctcctgccttggcctctcaaagtgcctggattactggcgtgccagtgatttgtttcttaatgaatgcaatttacctagtggaagagaaaagttataatttattttagatacttaca

SEQ ID NO: 115598 - DNA, 1062 bp, Homo sapiens
attcctgcatcaaggcctttgcacttgcagttccctctgtctgaaccctctgcccctcttcatccttgacctcatttctttatcttcttcatgtcttcttactcagttgtcaatttctcagtaaccttatatgaccaccttatttaaaattatattgtccttgccctagcatttcctatgtttcttccttgtcttttctccatggcacttataaatcatttgatatactacagtatatatatgttttattttttattttattgtctgttttccttacttagaataaggttcacggtaggagggatttttgtctattttgttcattgctatattcttaccccctagatgagtatctggcaggtaataagtgttcaaccaatactgctgaatgaataaatattttttgctttagtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaagtaagtttcaaaagatagaagtgatagttaatataagatttaaatcaacttcaataataaatagactcaggaaagaaatgattgtgctagtttccaaaagccattatgtatgataaatatttatatagcttttagacctatcagcattcattcaagaaactttacactagatgagctatagaaagaaaaattttgacaatccatgctcccaaggagattacaatcttatggaaacaacagccattatattatgttgtaatacaatattagatgtattgtagaagtacaaagactatacttagcaggagtgctaaacccggtgaaggggtcaaggatagctttctgaaagaggtaattactgggccacgcctgtaatcccagcattttgggaggccgaggctgggggatcatgaggtcaagagattgagaccatcctggccgacatggtgaaaccccatctctactaaaaatacacaaattagctgggcacggtggtgtgc

SEQ ID NO: 115599 - DNA, 1038 bp, Homo sapiens
ttaaaaaaaaacctattatgcacaagtcagattcttagtgaatgattgctttgggaatactaagtgattcatagatctgtcttagaaattaacttttaacatttcatatatgcagaacagattttattattactgccagtcatgatggacatgtcaagttctggaaaaaaatagaagagggaattgaatttgttaaacattttcgtagtcacctgggtaagaattgcacctcattttcttgtagctctttcctaaactatactaattaaagtttaaattttttaaattttttttctttgaatcatgcacacttattttactgttatttactagaatgttttaatttcatttattgaaataggagttattgagagtattgcagttagctctgagggagcattgttctgttctgtgggtgatgataaagcaatgaaggtgtttgatgtagtgaactttgacatgatcaacatgctgaaacttgggtgagtctttttaaaagtatatatattttaacttattgaagtaatttgtaaatcagactttaccatttaataggttatttctaaatagtatattaccatatctttaaataaaatgtgctgttgggttttgcttggaaaattagatacagcgaagccttataatgtttggaagcatctgctatgatttgttatcaatcacagaaatttctaaacagcatcataacaaggattccttatatccaaattgacattacttagtaatattactggagctctgtcatatctaattactggtagttacagttaacttccttgctttacttatttcagtaatatagaattgagttcctataagatttattcacatttttggaattaaagctatttattggtgactttaaactttggaatatattgatactaaaactatggttagattgtacagtattaagactgatactttgttttaagcatgtcttttttaagataacatagaatttatacacatctaaatgaatgtcagcttgaaagtcataacagtgtcagaaagttttgg

SEQ ID NO: 115600 - DNA, 1207 bp, Homo sapiens
gagaaataagtgtgctgctatatgcagttcttttcttatgttttgacagatccttagaactatcattatactgatgaggtcagaaagagaaaaaataagtaactattcttagctgttcctccccattctgtgtctctgctacttttgagcaaggaatccaaaactgtctaaatcaccagccaagacatttttggtagtgggatagggagggatgcttgcttgttgtgctgacctttttttttccctctcaattctttacgattttagctattttcctggacagtgtgagtggatctattgcccaggggatgcaatttcttcagttgctgcttccgaaaagagtacaggaaaaattttcatttatgatggccgaggagataaccagccacttcatatttttgacaaactccatacatcacctcttactcagatacggctaaacccagtttacaaagcagtagtgtcttctgacaaatctgggatgattgaatactggactgggcctcctcatgaatataaattccccaaaaatgtgaactgggaatataaaactgacactgatttatatgaatttgccaagtgtaaggcttatccaaccagcgtatgtttttcaccagatgggaagaaaatagctactattggttctgatagaaaagttagaattttcagatttgtaactggaaaactcatgagagtctttgatgaatcactaagcgtaagtgtaatttaaatttaaccgtactttacttttctaaaaatgctttattttatgccttttcttgaaagatcttttttctacagatagacatttagatagacttatttttttcttagcacattagagatattcaactgtttctgtcttgtagtgttgctctttgaaagtctcttctctaggggtttatgatgtgcgtttttcaagtcaattattgtcttatttttgtggttattttgttttttacaattttgttttgtttgcaagctgttaagatcctcaaaactcattctaggaccccttatcttctcactctttattcactcctgtccctatgactacttctaaatttacttctctaaccttctattacaagcaaacctggtgctatctcttgtcctgtcttcataaatggtgccagtatccatctagttgctcaaaccagaaatctaagagttatccttaactcttttacccttctgtgtaattcac

SEQ ID NO: 115601 - DNA, 1006 bp, Homo sapiens
gactggaatctcaaggaggtggtagtggaggagggtagtttctaaccagtcggaatcctagtttaacagaaaagaaattgaatgggatggtgtaaattatcttttagtatttattaaccagggtcactatatatggctgtgcagttgaatatcacagaagccctgctatgaagtctagagcactctgaaaaagattctgatcaggtacttaccaggttggataacatttatggaatacttatatagggacagatgaccacctacagaccttatgccttaaaaactgagtcttctctccggcagaaatgatcattagcccttccctgcaaaatgtgtagtccagcatcctaggctattcctggcacatgaataagcagcgtaatatgtatcagtctccctgtctttgagactagagacaagaaaacctaacaactaggctttttaactgttctgtaagaccttgaccttgtgcttataccctaacacacatacctcattttgattttttgagttttgtatatagttctaaccttatctagaaaacacaagattatggttaatataagcatgaaataaggatagaattagatgggacagaagtctggcttattttcatctgcaatggagagctatttttgaatgctactgtttgatgccctgattgtgtagaaaagaatgtaaagatcgttactcttttggaaggttcataatatgttaatacagttattgagatgtgatgcctatcttgaaatttgtgtaatatcaaaagaaaagtaaaccaaatttccaaactataaaggacacttatagaaatagtcatgtctactaaataacatgtacctaatggtaatctcactgccctgtgtcagaataacttgagacattttctgaaatattatgaatttgttataaattagtgagatgaattcattcagcaaaaattgagtgcttgttatgtcaggcacgtaaccttgctcaaggacctcatagtctatagctgcattat

SEQ ID NO: 115602 - DNA, 1303 bp, Homo sapiens
gcagtggcgcaatttcggctcactgcagcgtctgcctcctaggttcaagcgattctcttgccccagcctcccgagtagctgggattacaggcacacatcaccatgcccggctaagtttttatgtttttagtggagacggggtttcaccatgttggccaggctgttcttgaactgatgtcaggtgatccacctgccttggcctcccaaaatgctgggattagaggcataagccaccatgcccagcctgaaatactattttttagtgattggacttactaatgtctatttcatattgtttagaatccctcttaagaagtacaaacagttagtggctcttaatatgtattctgcttctatttaaattctcattgcatatatagatagatgggttgatatagatataggtatatgtatatagagtttttgttactaaatggtttatttcctagatgtttactgaactgcaacagatgaggcaacagttaccagacatggaatttggccgacgaatggctgtagaacgtgagttggagaaggttgatgctgtaagattaattaatatagtttttgatgaaactggacacttcgtgctgtatggaacaatgctgggcattaaagttataaatgtagagacaaaccggtaagctttaatatgaggtatgttttttaaaaatgtgtttgtgggggaccatttcctccatcatgggaacagtgggagtattgtttgttccaagaaaagtggaatggccccaaatgtctaaacttaaccaaatgttttgactggatttttctgtggtctcttggttgtttataatcttatgtagaaagtttccactcatgtttgtaaaagaaatggaaagaagatatgcatagtttcaagttgttgtgtgttttttttaacaagtttgtctgtcttttgcttattgatttaaattagcctggttcatgttaaatgttgccaaagattttaaccacagaattcagcattacttcctgctagacataaaatcaaaagttaaaatgcatgaaaccacagtaagccttttttgtgaaaacagtccatttggtcttagtacaaaatagctacaatcagatactctcactgaatgtaaatgaacagaacttaatattttaaggagaaaaaaatgtcctgtacatttccatgtataaacatatttatattgtagttcttggcaatacaaaatctttgaagttttgcagaacagttaacagacatggaattttaataagaataggttaaaactgtataaacaaatgattgattgtttttaatagaccttac

SEQ ID NO: 115603 - DNA, 1931 bp, Homo sapiens
ttgttgttttttattgagatggagtcttgttctgtcacccaggctggagagcagtggcacgatctcggctcacaacctctgcctcctgagttcaagtgattcttgtgtctcagcctccctagtagttgggattacaggtgcctgccaccatgcttgaccaatttcttgtatttttaatggcgatggggtttcaccacgttggccaggctggtctcgaactcctgacctcaagtgatctgcctgcctcggcctcccaaagtgctgggattacaggtgtgagccaccgtgcctggcctcatttctgttttttaacctgaaaattatagctgcctaccagtttaaattgataccttttggggggtagagaaacacttttaaaaatctttcactagttattttgtacatagataagatagttgattcccagcttttatctgtaaagttgtcataattggaattaacttcggtgattctgttgtataaaacattgttatatttttaggtgtgtgcggattttaggcaaacaagaaaatattagagtgatgcaattggctttgttccaggggatagccaaaaagcatcgtgctgcaactactatagaaatgaaagcttctgaaaatcctgttcttcagaatattcaagctgacccaacaatagtctgtacatcattcaaaaagaatagattttatatggtatgtgtaagtactaggagattagacggtaatgttccttccagtttggtttgacttttctttgtttgtaccttcaactgaagagaatgttggcactaatagcagacttcctaaacaaccagaataccatcttacattaatattgtagaattttaaagtagaagttgattttaagtatttctgtactgttttccatcatgttttgaaatttttcaacctcgtttccacaactatttgtgttgttttagatagtaggaagttagtggttatagtcataattacatccaaaatagtttcactgtgggattttaaaagtgtttttattttttcagcctttactcttgaatataatttatcttccccaaattagcacagcttccttctctaaatgcatttccttttttaccttttgacttttattttaatggtgctaccttggaattatatattcctgtggaattttttttttctcttctggagaactaaaagtactttgcatgttaactaagactgagatagttaaaatcaaactaccgtgccatgaaggagtagcacaattttatttgttcatccaagcaggaaaatcaaaagtatagagacctatgcccttgcattctatccttcacaatggaatcagagaactttttaagacccaaacgtgactcttattttctgcctaataccctttaatggtgccccagctatctatgctggctggccctcctcacttctgtagctttatctttcttcatttttcattcatttgctacacgaaccatactgaaagttcacatgtagttgagtgtgctttttaaactctgggcctttgcacaggctattcattctaccagccacacacctctctccaactcctaactcatacttcaagtttcagtttggaagcccctctgttttttggagatggcatcttgctctgttgcccaggctagagtgcagtgacgtgacttcagctcactgcagcctctgcctcctgggttccagcaattcgcctgcctcagtctcctgggtagctgggattataggtgcatgccaccatacccagctaatttttgtatttttagtagtgacagggtttcaccatgttggccaggctggtctcgaactcttgacctcaggtaatccacctgactcagcctcccaaagtgctggaattacaggcgtgagccaccgcacccagcctggaagccctttttaacatcaagtctgagttagatgtgc

SEQ ID NO: 115604 - DNA, 1110 bp, Homo sapiens
cttcattgcaaggtatgtactgttatcatcatatatgagtgagggaagagaagaaatgaattcacatccccaaagtcgcagaactggaattcaaatccaaacaatctaaataatgaactgagcaacaaacaggtggcatgttaggccttactagaaggcataagtcgagagctaccacaaatgaaacaattattcttgttaaatgtttgcccaagaaaatttctaaccaaagaaattaaattccatttgaaatcaatgtgttcagtatgttatgtggatccttttcatattagacaatgtaaaaataatttaattgcctgacacatcctgtatgggaagtgattcctgaaataaggattctgatgtgaattcttacatttcttaagtacttcattagaaattctattgttcataaaatttttaccagatgaaaactttaattcgttgactcactttttactttcctccttgagtttaccaaacgagaaccagaagatacgaaaagtgcagattctgatcgagatgtttttaatgagaaaccttctaaagaagaagtcatggcagctactcaagctgaaggacctaaacgagtttcggacagtgccattatccacaccagcatgggagacattcacaccaaactttttcctgttgagtatgtataacaactgtttttattggcttatgtaattaagaatgtaaatgtgtatatctgaagaaaccatgcaacttaaaattcccgttactttgacttaaggaattttgaagaaacgtttgataaaaaacatctattcctgagctttctgataagtgttacggtagaaaatgggaaatttttatgcatatatactttataggttcattacgaggacaaaatgtattggctatgaaagtgctgagtgtaaactgtaaagtgatacacaaatgtgtatcactgttactgttaacagcacatctgaactctaggttttgtggattgctttgctttcctctcaaagcaaatccttaagagaaagataattatgtttccttaccaacagttgctagatacctactatctctttatagtttcagtagctctgtgttttaaaagtgaactacaagctgggt

SEQ ID NO: 115605 - DNA, 1040 bp, Homo sapiens
gttagctatggtcaaaccactgcactccaacctgggcaacagagtgagaccctgtttctacaaaaacaaattacaacaaaaccgtaagggcttcaattgaaaaaaaggtgaacagttttctggacagtttaaaagactgtaaaattaacatacaatgtcaaatacagtagagtatctctggccattcttgacccaaaaaatgacatcttttacaacacttttacttaaaagttcttatttattaacattttgaatatgaacgttttataccatatcttggtactcaacaaataactaggcagctctagactcttggacagtctcactttaagtgctcaaaacccatgtactcttcggccttgtttgctgatgtacttgggtacaagattctcttggttcgtccatttccagctcttagaagtattacatggtaatgaaccgtatgaaataattgcataattttcagttaatattattgagaaagcttcgtactctgagtgtgattgtcatttaaagttgaataaatttagatgtcatttctatgattaaggttttggccaagagtatgtcgctgtagcataacaatgcttttgtaagaaaatgacctttcccaggaacttaacctatactactacatgcagacctataatactatatggagtaaactaacttaagatattgggccaggtacagtggctcaggcctgtaatctcagcactttaggaggctgaggcaggaggatgtcttgagtccagaaagtcaagatcagcctaggcaatatagtgagaccttgtctcttaagaaaaaaacatatttttaaggtgctatggctgtattttttttgactgctaaatgaccttgaaattttaatactgtcaaactcaaatattagttaagcagtcatgttctaaagataactaagttgaacaataagaatatactacttacatgaccctccgtgcttgtcctgagattagagattatgaaaaaaaaaaacaactgtccttctgaaacattcagaagacatggaaaggaaacat

SEQ ID NO: 115606 - DNA, 1094 bp, Homo sapiens
gtagccaagctagcatttgaactcccacctgtctaatgccaaagtatgtgctgcataaactatttcaaactgcctctgaataaactgttcaggtaagagtcctccagagaccttttaaagccttagccacaattctgtaagccatgtgaagtaacttacctttagggaagatcttccagttccctttggtctgaaagatgcagatatttaattaaacattatactatgcttctattttttttaacacactggaaataacttttaaaagctgctacatttttattgctgagaaattattgtacttctttttaaatatatgctaaaggggagcgtaaacttaaattctctttaatttgctcaaccagaggatataatttaaagaaattggggtttaccaagattttccatttgtcctccaacacagccttggcttgataataagcatacagtatttggacgagtgactaaaggaatggaagttgtacagaggatctccaacgtcaaagtcaatcccaaaacagataagccctatgaggatgtcagcatcataaatattactgtcaagtaaaataagatttgttttaatgtacttgcaaataaaaatacaatattaaacagattattttacattaggaagcttaggacttgctgaatatacagatcatgtttcaaagatacagtatttttgtattttttattaaaggctattttttaaaaattacctttgacttttctcgcaatatttctaatcctgggaggtgataaattgaaatggactaaactcaggcaaatagcactcattataggtaatttctaatcagcctcaaattaaatattaaataattacagtactctcctccaccccctttcccatggttttctttctactgtcaaccatgatccaaaaataggtgagtacaatacagtgagatattttcagacagcaagaccacattcactaacttttattacagtatactgctatagttgttctattttattgttgttaatctcttactgtgcctaatttataaattaaactttatcatagatatatatatatgaaaacacaatatatatggggtttagtatca

SEQ ID NO: 115607 - DNA, 2843 bp, Homo sapiens
gtagcacatgcctgtaatcccagctacttgggaggccaaagcaggagaatcgcttgaaccaggaggcagaagttgcagtgagccaagatcatgtcactgcactccagtctgggtgacagagtgagactctgtctcaaaagataaaaaaattacttaggcagtatgtttccttttaggttgcaaggactttattgatttcattgttaagctagccttacaaagtatatacatacacacacatataaattagttaaaccaaactaattttttctattcttattaatctcagaataattactgaaagatgaatctaggttttttgtttaggcttctgttagaacactgtcaacaaatttctctataaatggtgataattagaaaaattataatttggatggactgataaaaaatatgtgtatatatctttcaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaaataaaaaaggtgttgtattgcttgtgagaacttgaactgtttactagttaattgaagaaaaagtgtaacactaaggtgaacttgcttcccttttcactaattttgctaaactttgtaatgcacattcttagcatataactgaacacagttgaaaaattgtgcctgattataatgtatgtataatggtaggtgtttgtgtgtgattcatttttaaagaaatatttttctcaagctcctattactatttgtggttgtattatttcactaatcattagttaagactgtgctagtcttccctgggaaactaagaagagagcttttttatatacagtatattagaattttcctagtagctgaatttctgtattaggtctaaatattactgtatgttatataaagcaggtatgtcaagtgtatagccgtagtctataattcaggaatgctttataaccatcagaagccattatttgcactacatatatgataagtatagacagcaataaaatgttaagatcatttttaagaagtcccatcattattcttgaaagtctctttcttgaaccatctacctaatattattgctagttgtaaccaatttaagaagtcattatttgtgctgtggttaggagagaaaataaaacaaaatgggtatgggttggcatgcctgtca

SEQ ID NO: 115608 - DNA, 1054 bp, Homo sapiens
gccaccgcgcccggccacattcagctaatttttaatttttttttaatagagataaggtctcactatattgcccaggggtctcgaactcctgggctcaagtgatcctctcacctcagcctcccaaagtgctgggattataggtgtgagccactgtgccctacaaaaatgaaattttgaatatgaggaatggttgaaagtctggagatagttaacttagacataatactttggagaaataaaaatggtgatggtttttatcttttagtcttttattcaaagactaaatattagaaaagtagtattcgaagaacaagtagcatccataggtagaggatcatgaggcatattttgaaattcgttatgtaaaaagttatttgatatacagaccaatttgcatttgatagagcaagtgttgtaaatcctttcctagatggggaaactaaacctgagaagttatgtaaactacttgaaatcatactgttaattatttgtaggtgcccctgccatactaggcaccctctgtgtgaaaataatgatggtagacaaactctaaccataacataataatgatatcattaaatatttggttcatttactgaactttagcaagtgactatttttgttttttttatttttttttgggtagctgttgtgtttgttgtagatagcagtcatagagacagaattagtgaagcacacagcgaacttgcaaagttgttaacggaaaaagaactccgagatgctctgctcctgatttttgctaacaaacaggtaatgcatttttatattggaatatttattttagtagttttgtgcatgtcaaaaggcaactggaaatatttcagaagacaatcagttcaatagatatttatagtttcttctgtgtattttgagtacaatctatgtgaaaatgctgtgctgggtacctgggagtatacaaaatagaaataaggtagttaatgctcaccagaaactcctgtgtatgcatatgaacacataagagatctgaatacgaagaagactgataagtaacttaagtaacacagtgttacgg

SEQ ID NO: 115609 - DNA, 1018 bp, Homo sapiens
atccagagtcaaatgttcaaagcaaggtttattcagagaaatctagcttttatgcctggtccttctaccctttttacttcattccccatagaaaatcatttagaattttttcttagttttagtcatcattttaaaaagtatagagacatatgtttatatatttgtatgcacaccacttggatttaaaaggtggaataccttacacactttttttttcctgctctttttacttagctgtacatcctaaacatcactctgtagcagtagaaagtgacattttttgttcctttttccagctgcaaggtacttcattgtgaggatatgccacatttatttatcgtagtaaaaaacacataataaaaaatttgctatctcaaccatttaaaaatgtacaattcagtactgttaagtatattcacattgttaaacagatatccagaaatttttcattttgtagaactgaaactctataccctttaaacagttcccctctgccccctctcatcggtccctggtaaccactattgtatttttcccttatgaatttgactagatacctcatataagtggaatcatacagtatttgcctttttgtggctggcttattccacttggcctgtcatcaaaattcatccatattgtagcatgtgaaaggattttcttccattttaaagctgaataatattccattgcatgtgtgatatggtttggctgtgtccccacccaaatctcaatttgaattgtatctcccagaattcccacgttttgggagggacccagggggaggtaattgaataatgggggccggtctgtcccatgctattcttgtgatagtgaataagtctcatgagagctaatgggcttattaggggtttctgcttttgcttcttcctcatttttctcttgccaccaccatgtaagaagtaccttttgccccctgccatgattctgaggcctccctagccatgtggaactgtaagtccaattaaacctctttttgttcccagtttcgggtatg

SEQ ID NO: 115610 - DNA, 1082 bp, Homo sapiens
gcatgcagtgttgtgatcaccactcactgcagccttgacttctggggctcaatcaatcctcccgcctcagcctcctgagtagctgggactacaggcacatgccaccacggctggctaattttttccattttttgtagagacagagttttgccatgttgcctaggctgaaattttaaatatttcacaggtaaaatctttattaacattacagttgcttaaaatttattttcattttcttaggtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggtaggtagtttaaatgtggttagggacttagttgtaagtttaagtagataattaccagaggtatacattagtgtgttttattaatattttgtgtctgctgtatgcagtaactttgtgcttaggaaatggtctgcaaccttgaattatttcactagtatggaattatcagtgtcgttcacgtgcctttcccaccataagccatgggttcttgaggccttctaacttcttgccattcttcagttatgccaaatccttttactcttctttgccaagcatatatgtagttttttttttttttctgcttggagtgcatatatctctcttttctaatagtggaaatcttccttctccttcaaggtccagcttaaatatttgcctttctttgaagctttctatttgttggtctttttttgagtgcctctctaccatgtactgcctacgtctgctataattcagtggttcttcactgttagagcaaacgtatgttttgtgatggttgagataccataagaaatttgttacccagtttgcagatgacttacttttttaaataaatgagattcagttattctaacacaaatgtcagctttacccatttgtgttttggatctgttttcataagtgtg

SEQ ID NO: 115611 - DNA, 1111 bp, Homo sapiens
ggtagcatgaaaataaatgagagatttaatttctgaatgttataaaaaaaaaaaaacttcaaagaggcatcatgattcttcacaaaaaaatagctttcgagcaggaaacaaacattctgtttgcttgcatgttttcataatgcaccagattgttttgacaatatttatgtctgttagctcttacttaggatatgattttagagatagtctcttggttttttgtttagcaataaacggacttccaaattttaaattacttctttgcagtacagttttcttataaaggagtgaaagtaaattagtatttttctgtgtcataaaagtcacttgtggctgatgcttttttgtattaatagggatttaaatagttttttatattattagtcaatactatgagttcttttctctaattatggtacattttatagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtatggattttttttcttcttcactttctcattcttttttatttttcatattttcaccttctactaagtaattaatgggcaattacaatttgccagtattgcaccaatcattagaaagttttttaaaagtccctgtctttcaggaactcattcatcatggaaaagagagagtttgaaatatggtaactattttatggaggagaagtacagggtgctttggcatcacaaaacagggacaatgatttatggaggtcagagaagtccttatagaagaaatggtgtttaaactgagatttgaagaatttcagtcagggaaaagagcagaacggggaatgagttgtcccaagaagggaacaatatgttaaaatgtttgtaagtgaggattgtacatattgtagagacttaaagaagctcactgtagttagagctttaagtattgaatgggacatgacaagaaaagaggatatggagagttcaaagccaaatcatgcaggatcttg

SEQ ID NO: 115612 - DNA, 1050 bp, Homo sapiens
gcctcagccttcttaaagtgctgggattacagatgttagccactgagcctggcctatttttttttttatttgcttaaatcagtggttttctgccgtgattgtgcaatagactcacctgtggagctattaaaataacatggcgtataattagaaaaatatatacaagtctagggttcatccacaacctgttgaaataagaatttctcttccagacagctatgtttttaaaagcttacagctaattctgatgcatactcctacattttctaaatagcatttgtgcttctgtccttcctatacatcatcatgacaactaatatttaaagctatggggatgtatttaatatcagatttttgtagttttacagaaagacttttgacttctctatggtttagtttcttttgtgtaaagtgaggggatttggtggaagagatctttgcaccgaatatgaatctatgagaatagttctatttttggcttcaaattcataacatatattggccagttaatcttggaaatagcttcttacccctagaaatgaatgcttctcagatgagtattgaatgacctttgttcttaatgaccaatatattttcatatgtaaatattgttcagttaagcaaaaaggattatggattctatatttaaaaattcgtcatgttatactgattgggttcaattttaaggcattaattttttgtttatcagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaaggtatgaatttaattattaatcagttggatcactgtagctactttaccagctcagtattcgtt

SEQ ID NO: 115613 - DNA, 1466 bp, Homo sapiens
gatcctttaatgatttttcctctcgaatccaaaccagccagggcgtgaactgagggcggtgagggggtacgggcatctccctgcatgcaacgcggtttttgtataaactacaaatcccagcatgccactctctctctctctcttttttttttttttttttttttttaaaaaaaaaactccggcaacgttggcctttgggaggccgcgtattgttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgccaaacgcgaggttttccgtttccttccggggcaagttgaacctgtccagcccccgtaggctgtgggtcaaaagtgccggtcaaaatggaagtgaatccccctaaacaggagcacctgctggcgctaaaaggtaaacttttgcgaacctgattcccccttttctgtttccttgcattccctacttatcgaagcctttgccatgtaggcctcatccttcttaaacactcagtgctcgccctcctgctctgtcctttgccgccaagcgggaggaagcgatttctcctggatgctttttaggtttatgggcccctttctagaacgaaatagatacctggtaaatcgttctttctgatctgtgctgcttcagtcacgagattttagccgcagaagctgacgtcccgctcctaccgtggagatctctgtgaattacagcgggcatccaaagtgctttttccttctgtctcttgtttcttcctgtggcactgacgaagttaatcaggcttcagcttcccctgtaaaattagtattgcatgacagtagtgcagagaatttagcaatacatagtaatacaacatataacttagatttattcaaaacaaactgcagtttacttcaaatcactgtgtatgtgggaaatatgtccgagatctaatgtcaactctcattttttgtacacagccattttgagtaagtttggtgatttaattagatcattatttaggaaaaaacagcagcacttttttttttaggacaatttttttaatgcctattttctggaaaccttttatttgaaatcttttcagctttattttatttgttttttactacaacaaatgcgctttttgtttcttggatgccttaatatatggttaacaatgacttcttgaatgagctgaggaaatgctcaataaacattcgggttcaattgaattgcgcttactttacttatggcatccattttgaggaacgccttatccttcccattatgatgtagtcatcagactttctagaagctcatcagtctcatataatgatgcctgtgttagcgagattgtctc

SEQ ID NO: 115614 - DNA, 1025 bp, Homo sapiens
ccaacatggtgaaaccccatctctactaaaaatacaaaaattagccaggtgtggtggtgcacacctgtagtcccagctactcgggaggctaaggcaggagaggctaaggcttgaacccgggaggtgaaggttgcagtgagccaagatcacgccactgcactccagcctgggtgacagagttagactccatctcaaaaaaaaaaaaaagaaaaaaaggtttttttatatctattatgtttttggcacttcattaaatgcacgtttgatacaataatttttaattgtcattaacaagcactaatgaatgcctacagttataaagtattatgttaggcatgaaaacatttttcctattccacaagatttgtgattgcttgggtgagaaaatgtactagtcaaagctaaatagcagtttagtatttgttaatgtatgtcattaacatggaagatgaaagatcactggagattatgtcaatctggaaggtttcttgggggagagggaatgcgaagaggatcttgaaagaatgggaggatacagataacaaggcaagggagacatggtaatcagaggcagagacatagtggtacacatgtgttcttttaacagtgaacaaatttcacttggtaagagtccgtaaggtggtacagaggaatagtagctgtattagtccattttcatgctgctgataaagtcatacccaagactgggcaatttaccaaagaaagaggtttaatggacttatagttccacgtagctggggacaatcatggcggaaggcaaggaggagcaagtcatgtctcacgtggatggcagcaggcaaagagagagagcttgtgcggggaaactcccatttttaaaaccatcagatctcagccaggcgtagtggctcatgcctgtaatcctagcactttgggaggccaaggcgggtggatcacttgagttcaggagttcgagaccatcctgcccaacgtggtgaaataccatctctactaaaaatacagaaattagccaggagtggtggcgt

SEQ ID NO: 115615 - DNA, 1053 bp, Homo sapiens
ggacctctaattagaatgagtttgaaaatgatcatagagttttaaagttaacaaggacgttagagagcaaatagacccaacttccagaaactggatgcaaatttgtgcatacacgtacatatgtttgtcatatatggatggggtctctgcctttcattaaattaggagttgacaaactacagcccaaagaccaaatttggtccattgtctgtttttataaggcttttgaactaagaatggttttcacattttcaaattattgaaaagaatattttgtgacttgtgaaaattacatgaaattcaaatttcaggccaggtgtggtggctcctgcctataatcccagtgctttgggagccaaggcaggaagattgcttcaggctacgagtttgagaccagcctacacaacatagcaaggcaccgcctctacaaacaaacaaaaaagaaattcaaatgtcagtgtccttaaataaagctttactgacacacagccatactcatttgtttatgttttatctgtggctgatttccagctaccacagcagagttgtatatagttgaaacggagattgtatggcctctaaaatctaaaatatttgctaatgacttcagagaaaaagcttgccaacctctacattcgattgtgaaaagatctgattttcaaaagtttgagaacatatacttttgtctttctatgttgtaaatattgaatttcttggaattcagtaaatactggcaattcagtaaattcagtaaatattgaatttatttttataagagattaataaaatagcaaaggcatatactttaagatgtcagtactataaagatcaaagaatacagtagtatgcatgttctaaaacatgattttatatttcatgcctttattcacttttataataataattataagcagtgtagtactcactaggggtcttaggctcaactagacattcagactcatgatatataataatgctatttttctttttctttctttttttttttgagagaggatctagctctgtcacccaggctggagtgcagtagcatga

SEQ ID NO: 115616 - DNA, 1059 bp, Homo sapiens
ccttccttatttgtacctttttttttctctgaaggtaagaaacctgtctcttgttatccacaatgtattattttgttttgtcctagtatacacataaaatggtgaaaaaacacgtgtcgtagctagagtatatttgtgtaccattctttttgtctttagccatagattacagttaagattttgttttccaaacttacttaggttagttccacttttacccttccctctgctatagcccgattgtattcttcatttgtaatgcagttaggttcatttgttactgtttatattccattttgaattctccctaattcctgcttgatcttatttatttatttttttggggttgggggggtgtgccattgccatggttctaagcatcagagctatacagaaaggtttacacataaaagtgttgctccccctttcatccttctttcctaattcttattcccctattctttccactcatagccatgcacaccctgtaggtaaccagtctcatttggactttttttttttttttaactttctttcaaggctgatcttcagacaagttctcagcgtttaaatctttcagcctccaatgctgcagtggctgaacttaaaccggattgttgtattgatgatgtcatacatcatgaagtcaaagaaattggaacacacatgtaaggattaattttattagttctcaaaggtttttacttatatatgcctttgtttgaaatttttgctttcttttcattcaccatgaagcataggaacctacttcaaaaggaattttatgttctatgttggcatgtttaccagaaataaagtttaaaccaaatgtttgttttgtagggagaaaatccagtttatcatcatttatctctagttttatttttttacatctacaatctctaaaaaatgaaaagctgtacaaaatgtttaaaacccaggtagcactctaaaagtaaatttattgtgttttgaaatgctagtaactgatgttcatagtgtttatttttaaattcagtttttcagttttgtatttaaccaggtatatgcactctgtcc

SEQ ID NO: 115617 - DNA, 1471 bp, Homo sapiens
tgcatccagtagaggagactgacatgatgcaactataatgtaagcccctcccacacatataacccaaatcgtgaagtaacacatcctgggtacctagagaggtgaaaaatgatttccagctatgcatttgatggaggtgacatttgagattgctcttaataaaacattgaagaaatatataagttttaaaaaggctaactatgaaatctactaagaagaagagaattctcaattttttcaagtggttcagccccacattccctgaagtgatcaacggaactctaattgcccaagatattccttagaaagatgattccattattacataaatttaagagaaggtatacggtgtatatctattctgaatgtggaggatagtatatattcatcctaaattatctatgaagaattgcaatgttggtaaagaattatagaactagaaagtcatggggtatacctctctgctccaaaatgtgcccttaacagtttgctactgttgagtattcagccatagggttcttctctattccattgtcatttaaccttagcagtttcacctttttagaaaaatggtttgtcatatttctttatgttgcttcctgtttactttcttatttactaatgctgtcttgtttagtaatttaaaaaaatgcagaaatgcattttattttaaagtaattcttttttctttaacatttaactctgatttttctaattattcttttttatttttccattagagtgacctcagttctgtggtaatttgattttttattataaatttttatacttttcttactcaccactttttgactctgcctaattaatctctctttacaaaacatagtggaaaaacagttagttgtgaataccacctatgtgacttcagaaagattatatataattttatgtactttttaattatatcaattttctattccgtggggcaaaattagctcaaaagttaaattgtcatactgaaacaattctcattttcagtgtttcttctttagattttttttttaaagaggtatgttaccttgtgtcaaatggccttgtgattttcatcatcttactgtaaaatacccgattatcctagccttcagttctttgagtagactgtataatcgaaattcattttcagatgcacagtggttttagttttaagtctgggtcaggtgatgatggccgcttgacaaaatgaaacagaagaaaagcaaattttcccaacttggctaaaattttgttttcaaagttatatttacaataagcagcatttgcttatatcacattacatatgtaataacatcaactgccttagcactgaattcttaatttttaaaatatcaaattgctttacactaactgttcaaactaacttgattttccattatgctgcttgtttttctttcgttttatctaagctcttcctaaatttatgcagaaaattgcagtttttaaattgaaatgt

SEQ ID NO: 115618 - DNA, 1024 bp, Homo sapiens
ccctttatgctgaatattacctgttttgacatattccaaattttacttttctttccactgtttgaggcaataatttttaaaaaatgatgatgatgattcctgggcccacttaaatatagccgttagttatttttctgccatggcctgttccaagccttcgtgttgttataatccatcctcatctgtgcgtcttgtaaaaagtcatgattttcttcctggctcctttcaacatcatccccctctttctttagaaaataactttacctatttagagttacacacatagaagctacagcatctggaaagtgtcccttcaactccctgaaatttctttactgactacttacctgtgagattcatcttaactctactgaacatggaataattatataacaaaaacagtccaggtctgccaggctattccacaggcagtagctgcaaaagaatttaaaatgagagacaagtaaagtgaatcagaagtattttcttagaacatcagcttggaaacccaacagctgttgagtaaatgtgctgctgtggtgccttcattaaaatggaaaggttttgtgatagatatacattaactgtgttgcttgttttcttaggctccaggttatggagatgttaggttgtctttggaggcaataccagataccgtaaaccttgaagaaccttttcatattacctgtaaaataacaaactgcaggtaatgccactgtttgtagatggatgtcctttctacctcacctgcctagaagataattttaaaatctttttgttactatctccttttaagttttcctcttgacatacagccttctctgatgttgatattgagtactgtaaaattcttcatctggtagcagtataattacatatttttaagggcctattgtattatgcatcttctgtattttatttcattcatttgtcacaccctatgaggtaggtattcattgtttatacttccttcaccaaaacatgaactaataggttcttatgtattaatatattatgaattgaa

SEQ ID NO: 115619 - DNA, 1120 bp, Homo sapiens
ccagaaggccaacatccagacaggcagattagtctgaggctattttaagtgctagaaggtgtgacttcctttcatcttcctggttctatcttaagtgacataaaaaatgttataatagcttttctctttctggtttttattctcctggatatggagaaaacaagtttactgtcactagtagaaatattgcagtacctctttgtgaaatgaacaagatttattcctattattctgattcctccagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaagtatgctgtcttttcaaaaattccaatatttgggtgctgttaacttacaagtcatttgtgatgtctgtatttcctctgaatgaatgaaaacttagactcatctctctctctctcaatagagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcactt

SEQ ID NO: 115620 - DNA, 1277 bp, Homo sapiens
agaggtttctcagacctgcaaacacctaagcacctgggccaaacaaagctacaacgaagatctgtatgaagatatatagttctgcagaatttaaaaagagcacaatttaagtcttcggccctcagaagttaaattcatattccatctaagccaactttgattttcattaagttagaatgaactcctagtattccagtattacacagaacgaagtactactactaacacatagaagtcattactgtgatataaaaagcaaaatagatccttaattaaaaattagtcactcatattcagtgttgaataagaagttaaagtttctagcataactatcttgagtgcattaaaaatgcttttagagcaataagataagcttctagctgactgcctagaaaaacagaagatacaaattcagtgtcagaaatgaaagggaatacactacagacactatagttattaaaaggctaactagaaaacaccatgaccaactcaaggattgtatatttaacaacttagatgaaacagattccctataggatacaaactagaaagctcactgtagaaacagataacctaaacagaaccatatttattaaggaaattgagtttgtggttaagttaaaaaccttccagtaaagaaaactacaggcccagataacttccgtgatgaattttaccaaacacttaagggagaaataatatcaattctaaacaatctcttccaggaaacagaagaggaggaaatacttcccaactcattttatttgaccagtattacccagacaaagatactataagaaaaaaaactttaaaacaatgtcttcatgtgctaacatctgtagttaaattagccattctttttacatgaaataatgggaattggtatatttcttccatttcatttttctatttctttgctaatataccacctgtaacaaattcaatctagatgctatctgtccacttgcctacatttccattctattcaagccatttttgctcttcaagtaccttgatcactttggaatcatagcattgcaagctatttcaaaaaaagttgcgtggttggattgtgctagctacttttaaatttataaaaaatgccccatatattttcttgcttgtctgggaaatatagttgctatctaactagaaaaataagagggcattattaaagtaactctttaagcatcgtactaaatgtttgacttccattaaccatatttcttgtagtagctgtagctattatgatactgtgtaaaacagaacaggttcta

SEQ ID NO: 115621 - DNA, 1021 bp, Homo sapiens
agttcttaactaatcttgtctgcagtttggtattgataatattagcatggccacttatgctaaatacacaataagatacatttagaaatccttaatgtactggttaggtcagtggtacaactgtttgacttaattatcacaatttccccaatggtaaccttaccttggaaactatcaaatataaatatactttaactaagccagtgacctggtcctaagttaaggattttctaaatggtatttaattgtgtgcccataaacactgattttttttaaaaagaaaacttagtaattatttgatggataacaaaaagcatctatcactaacattgcttgttcatgtaatcttctgtgataatttggcttggcatgccagtcttataattaacataatttaaatttgatgcaatttaaatataacaggagacttaaaatattttattataaattagatgccatattagttagtggagaaaaggggcattaggtattaattgcatgggtctaactacattgatgatgagagtttaattccaactagagtatattttttgtttattaataatgaaattggtgctgacatgtaatgacttcacaagttttacgagggaaaactgaaaaaggaagtaatataaattttgtggggtttttttgagatggagtcttactcttttgccaggctagagtggtgttgcaatgtcagctcactgcaacctccacctcctggattcaagtgattctcgagccttaagctcccaagtagctgggattacgggcgcccaccaccacgcccagctaattttttttttttttttcttgagatggagtctctctctgtcgccaggctggagtgcagtggcgcaatcgcggctcactgcaacctctgcctcccgggttcaagtgattctcctgcctcagcctcctgagtagctgggattacaggcacgtgtcaccatgcccagctaatttttgtatttttagtagagacggggtttcaccatgtttgccaggattgtctcaa

SEQ ID NO: 115622 - DNA, 1033 bp, Homo sapiens
ctttatcctcaccatgtcttcttaatgccactttttctagtaccttctctctttttacattcccctttactttgcatagcacactgaaactctacaaaatgttagtgcatacatgatttagctttcattcttctaaaaaaaaaatctttgctaagatccctacatattaactgcctttaatgggaggtgctgtttttcaattccaggcggcaagtttaatgcagaaccctcaagttcaacagctgtaagtatatagaaagagcttattacacttccccaacccttccacttgccaggctcctaatttgagcacatcagctcaaaaatgatgaaactgttctgaatgacagtcagttggagcttaaagccacacacatttggcctagcctctggtataacatgggtattttattaacttttcctcgtccagttgtcctatttgttaagaatatataccaatcccagtgatgtatttcttgtgtactctagaatgtcaggaatgatgacaaatgccattgggggacctgctgctggagttgggggcctaactgacctgtcaagcctcatccaagcgtaagtattatttaaaacagaaatagtgaagatgtattttatgttttacagcctatctctatggtgaggggtcagggctttctttttaaatgtttatcttttaccgttagtaactttagcctccttaatgttactaaatctgaaagaagttcatgaattacaaccactttttagactgcagggcaggaatccatacctagatagtctggccagccctgtctgttgagaaaaagaaccatgtttattatgcttccccccacccccacccccgcccccggttcattatgctttattttttgggactttcaagtaccagcagaatctttttcttcttttcttttttggcaccatctcaataaggcaggtgagggacagatattagaaaagtagataatttatatccctacccaatggctagagaaactgaggtacaggttagtgacttactaaggaacccata

SEQ ID NO: 115623 - DNA, 1035 bp, Homo sapiens
agtgaatgagagaaagtgccaggggactgggatatcacttttacttgtcgtttaaccctaccattaaagtgataatagcacaaccctctgtgtagccattcacagcaataactcactctttgtgcctccatagtagccaagatgtcctagctttttcacttttctgtttggacaaactagaaagggtataaataggtagaccagttgtatgacttacatatttgtcctttctatagcaaagcaaacagtgaaaggcagcctgcatacttttttctgcacagaagtttctgagcttttttttttcattttattacataattatcttagacagtttgacttagaaatttagtgggagtgatctacaaattggaacaagaaaaaggtagtattattagtacctgaaaatctaaattagtgccttgaaaactgcctttaataaaattctgttttctttctcttagggctgctgctcagagcaaattaggtcactacacagatgcgataaaggattgtgaaaaagcaatagcaattgattcaaagtacagcaaggcctatgggagaatggggtaagttctgggaggatgttccaagtagtaccatgtagcatcaggtatgctgttcttaatggcttggttttgaatttcctgcttaatgttttaccctctgaactaataagaggataaataaaacataagggaggaaatgactacaatttctttgactaggaagtgagatgattgatgactgatttgattgttggagaaaattatataaccgtaccacaaatctcagatgagcactcaatattgcagacagttaggcagacagttctattatttttccttctatagtcacctttccactcgctgatgtgacgatttcatacctcttcctctcccttcaaatttccactaccccctctctggtgactctcaactgatgctattgccttacacttaattgagaagctagatgctttttgaaggaaaacaactcattttcctccttgcaaatccatcagtctgcctacatttg

SEQ ID NO: 115624 - DNA, 1023 bp, Homo sapiens
tggaatgcagtggcgctatctcggctcactgcaagcgccgcctcccgggttcacgccattcccctgcctcagcctcccaagtagctgggactacaggcgcccgcaaccacgcccggctaattttttttttttatttttagtagagacggggtttcatcctgttagccaggatggtctcgatctcctgacctcgtgatccgcctgtctcggcctcccaaagtgctgggattacaggcgtgagccactgcgcccggcagaagtggcactgtttcgcatttttgcaaaactaatgtgtgacataatagaaggtaactggattcttatgtctgcctctgcatttaagctgctgcactgtttcattttggtttaagatgaagaaaatcccacctcacagtcatatgaagttggaaagaagaatattttaatagctttttaaagataatcatggatgttctttgatatcacatcaaagtttgacaaatcgtagctttttaaaggttagttacaaagtggaatttgaaactatatcaatgtacttgttttacactgttacattaatatccaatggtgtaccttacactttgaatggatgttgaatccatgcctgttttttaaaacattaagcataagtccttcggaaattttagtggttcactgtgttatacagttcttcctaatgttgacatatttcattatacagtatcaaacaatcactttccttaatgtcttcctatttagtcggaaaagtcttcaagtattgggaagctgtcaagctcacagtggcagataggattttccaaaattctagttttcacttgaaagctagaattttatcattggtaacacaaactgtcagttgttttacttgaagtgacaatctcactttgttacatttttgacagaatttctgccacatacttaagtctgaataaccctggtttgtctgtcagtagtttttttctggtaaaaatggtgttccatgggctgggcacggtggctcacgcctgtaatcccagcactttg

SEQ ID NO: 115625 - DNA, 2076 bp, Homo sapiens
agcattgtgatcttaggcaagaatacttaagttctccgtatctgtttcctcctcagtaaattgataattgattggctgatttcttcattcaccaaatatttattgtctattatatgcgaaatagtattcttggtctggggatatagcaatgaacaaagcagataaaaatctttgcattaatggaacttacattccagtgggagagacaactaaggaaaatataaagtaagttagatgggaaaatgtgctgcagagcaaaagtaaaatgggaaaggggaatgctcagtaccgataggaaggaaattgtagagtcaacaggaaaggctaccaagaaagtgatattaatacttgagtaatgatctaagagaaatgagcagttgtgctatgtgaatacctgaggcaggtcattctaagcaggagaaacggcacacaccaaggctctgaaagcagggctatgcctggtgtttttgagaaagtaaagagaccattgtgactagcatggaataaatgtcaggcaagtaagtaggagatgagacagggaaaaattggactcatccttttttttctattttcttctttttttttttttgttttattcgtttgtttttagatggagtctcactctattgctcgggctagagtgcaatggcgcaatctcagctcactgcaacctcctcctcctgggttcaagcaattctcccacctcagcctcctgagtagctgggattacaggcacccgccatcatgcccagctaatttttgtattttttgtagaaacaggggttcaccatgttggccaggctggaactcttgacctcaagtgacccacctgcctctgcctcccaaagtgctgggattacaggcgtgagccaccgtgcctggcctgtactcaccttttaagattgaaacaaatatagaacactttgaacattgcctggttatatccattcctattaccacaaaaatgctgtataacaaactgaatttcagtggagtacaatgatcaatgtttatttttgctgacaaatctagattttggctgggcagtttttctgatcttaactcattcatgctccttcagtcagccatgggttgtgtaggcagctctgctgatctctgctatcctctctcacatgtttggtgatgtaggatggccacagctggggctatttggccctctttcctgtgacgtctcgtcctccaagaagccacctctggcttgttctcatgtcagtggcagggttccatgagagagtggaaggcagttggaactggaacctcattagctctgccacattctactggtcaaagcaagtcacaaggctagcccagattcaagaagtggggaaacagactctatctcttgatgggtagaacagcaaactcacattgttaagagacatagactcatagcaggtagaaaattgaggccatgttagttatcagtctaccacatcggcacataataaaatctcgagaaatattagttactgtttttacttgtgtgaattgcctagttttattttgggatttttaaaattaggattattactttgtaagagcccctcatagatgtttcagttgtttttgatctttgaacttttggggtagattattgttgctttttgcttttttgctttatccctacaaaagtttaaatttttatacagtcagaaatatcagtcttttcctttatgatttctgcctttggtctcattcctagaaagtccttctccaccccaagattatgtattttaaaaatcacctacattttcttttttttttttttttttttttttttcagacagagtctagctctgtcacccaggctggagtatagtggaacaatctcatctctctgtaacctctgcctcccagtctcaagcagtcctcccacgtcagccttccaagtagttgggactacaggtgtgagccaccacacctggctaatttttgtattatttgtagagacaaggtttcaccatgttgcccaggctgatctcaaactcctgggctcaagcaatccttccacctcagcctcccaaagtgctacgattacaggcatgagccaccaca

SEQ ID NO: 115626 - DNA, 1039 bp, Homo sapiens
aacaaatatttactaagcaccagggactacattggggattaatttataaacataggctttttgtcttacagataaaaaaggccaaaacaatcttcaaaagaagtatcatttatttttaaacttcttaatacagattatatagaacaaatagttaaccgacatatagatcctgatgcattgcatttaaggaactttcagttagaagtaactgtgtgtaacattttctagaatatacttagaaaactttccacaaatcctggttgaaataaaataaaagtatgttactctacatcaattccattagctgtttatttgtagccaataatgataaaaaatatatacaaacagtatgaaagaggagaactgagttctaaggttatgtctgtatgtgcagaatgagagatggagaagaaactcatagttatggaaaacagaaaagaatggccccagaatttcttgcaagacttagcagccaccaatattcagaactgtctttaagccccaacctgtccatcatcttaatacattgtgcatcagaaatttccaacccaattaaaccatttttgtttccttcattggtttatttatgaaagtcactaaaaagacacaaatctggtctaacctattttagccttacctcttatccctccacatcccattaaacccgtgtacccaccttacctcatagagctatcttgaaagactcagccagtttagaagttacatcctcattgaagtctttcctagattccccaaggcagagtcacacacactgtcctcttcattctccattgccttatttatatagaatttgttacctgatattctgttatttcattattatttttagagacagggtcttactctgttacccaggctggagtgcagtgacacaattgtggctcactgtagcctgacctcctgggatcaagtgagcgtcccaagtagctgggactatagatgaggtctcaccacgttgcctaggctggtcttgaacttctgggctcaagtgatcctttctctttggcttcccaaattg

SEQ ID NO: 115627 - DNA, 1013 bp, Homo sapiens
ctgtaatgctgtataaccattaaaatcatggattacaagcagtatttaatgacatggggaaaaggacacagaagaactggaagaaaataaattttatcaatggttttgttaggattctctagagaaattgaacctatagggtgtgtgtgtgtgtctgtgtgtgtgtgtgtgtaagtatatatatatatataaacatatgtatgtgtggggagagagagattgattgatagattgattatagggaattggcttacatgactaaggagtctggaaagtccagaatctcagtgggggctggtaggcttgagacccaagagagctgatgttccagctccagtccgaaggccagtagcctagaggcccagaagaaccagtagtgcagaagtctggagactgcaggaggattctcccttgttcagggagtcttttaggccctaaactgtttggattttggctaccacattatagagggcagtctgctttacttcaggctcatcactctaacgttaatatcatcaaaaacaccctccaagttaacacataagattaatcatcagaatgtttaatatatcaggtgatgggtttatagctaatttttactttcctctttatgtatttctctattttctgtattttctgcccttacatacattatttttataacatattagacccttcaagttataaggagtgaagattccctttggttacctctaagggttggacatactttgtagaataattatgacagacaactttggctgtgtatccaggcttcatacaagaatataagatagctgcagaactggatattgtaaacattcgtgggcattttggaatttgaaagatcatcagaatccagcatagccctagtgacctggtcatctccttgcccccactatcccttcatcaccaagagttctctactctatgtttcactgtaaaaaggacttggctattttctcttatctcagtgtttgttggctattttctcttatctcagcatttgtttc

SEQ ID NO: 115628 - DNA, 1333 bp, Homo sapiens
ctgctcgcctgggtccttaacaacttacccagctcttgccaggcccttctcaccagggattcctcccaagtcccctgcacataactacagcctggattctccccagctctacagcttgcagtatcacactgtctagagactcctgttgctgtgcttcacactacaggacagacttcctggcgctactaaaggcagcctagatcaacccaagttaatcacatccgcaggaacactgtgattggagctgctggccacccctgagggaaccagcccatagcccagttatctccctggccattgtgggtttcctccctttgcaggcacctgctgctagcatcccattgtgcactgatactagctagggagggttccaactccagtcatgccagcatgcacaaattctccagggatacaaagggaggttgctgtagaaaaaggagcctaactattttctgcctccactgaggataacctcagagtaaatatatgcacaacaaatgccttagtactgtaacataaaattatttgttggccaggcatggtcactcaaacctgcaatcccagcactttgggaggccgaggcaggtggatcacttgaggccaggagtttgagaccatcctggccaacatggcaaaaccccgtctctactaaaaatgcaaaaattagctggacgtggtggcacatgcctgtgatcctagctacctgggaggccgaggcatgagaattgcttgaacctgggaggcggaggttgcagtgagctgataatcgcaccactgcactccagcctgggtgacagagcaagactgtctccaaaaaaataaaataattttttagcaggcaaagtgagatacagttggctgtattaagtagtatttagttaaaatacaactctgttacctgctgcaacaaaagatatacaattacagaattattgcagcacagatctagcaccaacaatctaaaatgcagtctctaagctaaacacagtccttttacagatttaattagttgggaaattagggatgctcagggttgaacagcctgggtctgtcatggagagaatctttaaccaatagaaggcctataaggctttagaaacaagtccctcattggctttcaaccaaactgaatccattacacctgctgaatctgtccagagtccatttcttcttaggaaccactaactacccagccatccagatgtgccatgtgtattctgccacctgctttagagaaacatctggtgtctttattaccttgctgtggctaggggagttttccattcccctccatggccctctgttcttttgagtgagtgttgtttgtgctgct

SEQ ID NO: 115629 - DNA, 1109 bp, Homo sapiens
atcatgtacatgactttagtttcactagtgcttttttccctgaataacattcttcagtcagcgttctctgagataaacttgagctttggtgatgaattgaggaactcatggcccagttctgggggtgttaaaagaaaaaggggctaggaccataaaatcaataaccccgaagagcaaagtgtgcttccataatacagcctgctttcctccctcacgtttttcctcctcctttacctctttccgccttatttatctgtattgagtactgcaaaggaggaagcaccatgctaaaacacaggtggtatttatgagtatgcttgcttccaaaagcaagtagatcactaacttttccttttccttacagatgatttaagccagaagttaaaacccttgggtgaagcagaacgagagtttattttgaatttgaagaaaaaggaatgcaaagacaggggttttgaatatgatgggaaaatcaatgcctgggatctatattactacatgactcagacagaggaactcaagtattccatagaccaagagttcctcaaggaatacttcccaattgaggtggtcactgaaggcttgctgaacacctaccaggagttgttgggactttcatttgaacaaatgacagatgctcatgtttggaacaagagtgttacactttatactgtgaaggataaagctacaggagaagtattgggacagttctatttggacctctatccaaggtactgaggatcacgttgttggaagggaccttagggattcagctatgcctactttaagactctactcttggccaggcacagtggctcatgcctgtaatcccaacactttgggaggccaaggtgggaggattgcttgaggctaggagttcgagaccagcctgggcaacatagtgaggccctgtctctacaaaaaatttaaaaattaggtcaagtgtggtggctcatgcctgtagtcccagcactttgggaggccgaggcaggtggattgcttgagtctaggacttcaagaccagactgggcaacatggcaaaactctgttgctacaaaaaatacaaaaattagccaggtgtagtggtacatgcctatagtcccaggtac

SEQ ID NO: 115630 - DNA, 1162 bp, Homo sapiens
acctacaaatatgcatgaaattccaaaaggctcacagacccctcgaagccctcaccataatgaatctcaagttaagaactcctgagttatagcagtttccttcttatttgatgatttcacaaggaagcattttggtcttttaatcacatttattaagataatagtgatcttcaaatagggttttcagtgctcttgatgcatgttcgtttttcaggcacagtcctcttatcaacttattatcatatgcttaccatgtattccatcagttctccacaactcattccattgttcccattatttcttacattaattgtgatcttttgagatagtcactttagtactagaaagatcttttcttggtactctgacattttagagctgtctgactcgtgactgaactattaatatatatattgcattcaccagcttagtgtttctctcttgaaacagtagacatattcagttcttaaagttttgcctaacctcatccatgagcacaaatgtgtcatactgatgaataatgtgttggtacaattctttacttggtcatatcttcatgagattatctttgaaaaatctcttcttgtctattaatcctttcagatagcctgtaatattttaagaacttttaaggtcatcacaagtgatcactacttttgtttttcataggcaccgatccatatatttgcaaatttataatttcaaagccttttgtactgacctaaaatggatgatagtgaaaacagagattgacaacttctatgttcactaatacttccagcttacctaagaaacatatagtgaattaaaaatttgccatatgtattcagtacattggttttaagaaatggcagctcagtgtttgagctctccactgtggcagttggcaggtttcatgactagaagggctcgtttgagcttgtcatcgtaatatttaaacatgttggcaagaacatcccgttttcaaacatgtagatgcactagttcaatatgtctgctatctcttcattcaggacgtgagtttcactcgtattacgtttacagggtaggtaggtaattttgaagatagcaatcaagaggtgatatctgtagtatctgttcctgttgcatggctttattgtggtttgagctgtcagtaatcactagcctttgaacttctgta

SEQ ID NO: 115631 - DNA, 1051 bp, Homo sapiens
tgcccttatgtgaccatatacccagaaccctctatcattaccttttctcttccagctgtcaaggtagcagccaaattactgatccctgtggttccaaggaacttgcaagtgtaatagaagcaattcctgcattgtcttctctatacttcctcttattctcaggcttcacagtttggcaggcagccatactactcttatttagacaaaggtgctgggttgaacttagagaaagcatcatcccaacaacttggagttaaaacttgtgatgttgaaaacaattttcagtgttactaaaattctggattcagcagtgctgttattattagatgtcttatgccataaggctggtgttaattccttcctttacactttttcctttcctttcaaatgctctgagtatcatggcacttcctgatcctctgctgtcacagcaataatggacctggctccaaaagccaagaagaatcccttggcccctcaccctcacaccctttgcagatactaaaagatgatttttaaacaaacattttgttccctcctacaatatactatttggggttttttgttggtggcggcgggggatgttcttcaaaaaaaaacccacaaatatttgctctaaaataacacttgccttacaaaatacaggtacccagttattaaaaattaatgctttgggacaacaatcctagtctccaaaaaacttagatcattattatagctatgtgtgatgaagagaaaaagaaattcttttgttgtcccaaagcattaatttttggtaactgggtacttgtattttctaatgtgagtgttactttagagcgaacatttattttaaaaagaaaagaggaagaagaactccccccacaaaaacaatgtataccacggaatacagtgcagccaagaaaaagaacaagatctgaacccagaaggcagaggttgcagtgagccaagattgcaccattgcactccagcctgggcaacaagagtgaaactcatctcaaaaaaaaaataaaaagaacaagatcatgtcctttgtagggacatggatgga

SEQ ID NO: 115632 - DNA, 1038 bp, Homo sapiens
ctagttttgatagcagtaaacccaaagtttttttcagtggtgttttagtctttttctgtttactttttttcccggtatttttgcggtacagggaggtgaaatacaatactgtacttttgaatatatattgaataaatttggtaatcctgttggtaggtatatcctaaatatatattgatgtttagattgcctatgctgtctcacgtaatgaccggaaacccgaggagagagttgattttctttagttcaaagagaaaaaataagttttaaagatcaggatcaaattatttcacaatttgttctttgctacttcagcttcattaagtacatctccaaaggcagtcctttatttattactgtagttttgattttttttttcctccccggggcatggtctcaggagattctttttttttttcattgttggtaagatttgtgaaccatggaataattcttgttaagtcaaactagctttatcaaagaatttaaagtgcataactcatctactttatgattttggaacgtatcattaggctgcaaaagaggttattcttgggcatctgaaagaggtgaacaaaataaatggcattgaacttcagtttccttatatggcttatacttggcttcaaaagcaacaaaaccttaatagagcaagtcccttacagagaattatcgctttatgaagatggttatttattagtaaattttgtataaaaaaagtattgtagcacttgaaaatgactatttaagcctctatttttagatttagttcttgattttttttctcaggagaagagtagtatgtttcgatgcagacaacacgttttatgaagtgaggtgttcacctttgtgtttcttttttttctcctcaacaaggcataatttacttcgtagttttcttggaattctgttagtttatcaccgaattaacttaaattttaggttttatactattgtgaaactataagtattttcgaagctttgtttaaactgtgacaaaggtttgaaaagaggttaatagaggagtcatccgttaaa

SEQ ID NO: 115633 - DNA, 1001 bp, Homo sapiens
tatgatgacctagtctctactgtattggtcatttaaatatatgttcccagcccaatgaatccttcttctggctttggtgattgcttagaagaggaaagggagaaatatttaacgagtttctctttgaaggtatgtgggtagcttgaccttttggtacaggtgcttactgttcctcaggaggcagtctccttttttcataatcacactgtccaagtgtcacatctcctacatacatagagctgtactagaggctttagctacacagtgttttactatggttttgctctctggctgaccgctcaggatatgcttctcttaatccttcttgctaagaaaactcatcttttttggagatcccactttcttcttgttttgggtgtctggttcctcaagtgtattgcattttgttatttccccgaccccagcctactttgtattctttataaattccgttctgttcttatctgtaggtatacccctcccaggttttcagcactgctatagatatttttaaattaaattttaatttttgaaacaatgactgacatatggaaaagtttgaacattttttttcctgaaccatttgactaagttgctaacatgatgccctgtcgtcatccctaaatatatatttttttttatttgagagctctgtcgcccaggctggagtgcagtggcgtgatcttggctcactgcaagctccacctcctggattcacgccagttctcctgcctcagcctcccaagtagctgagactatagacgcccgccaccacgcctggctaattttttgtatttttagtagagatggggtttcaccgtgttagccagggtggtcttgatctcctgatgtcatgatttgcctgccttggcctcccaaagtgctgggactacaggcgtgagccaccgcgcccagcccgtcacccctaaatattttaatgtttatttcctacaaacaaggatattctcctgcatataatgacatcattaccatcaaaatca

SEQ ID NO: 115634 - DNA, 1065 bp, Homo sapiens
taaagtagtgtgtaattcttcatgatctcaagttttaaaaaatagacttaaggctgggtgcagtggctcatgcctgtaatcccagcactttgggaggctgaggcaggcggatcacttgaggtcaggagttcgagaccagcttggccaacatggtgaaactctgtgtctactaaaaatacaaaaattagccgggtgtggttgcgcatgcctgtaattccgcctactcgggaggcttgaactcaggaggcggaggctgtggcgagctgaggtcacgccagtgcactccagcctgggtgacagagcgagactccgtctccaaaaaaaaaaaaaaaaatagactttaagttttttgagtagtttcaggtttacagaaaaattgattaagaagtgtaaaaaattcccaaaccctccttctccatttcccctattattaacatcttgcattcatgcagtatatttgttagaattgataagccaatagtgatacattattattagctaaagtctattgtttatattaggcttcactctttgtgttgtacattctgtgggttttgacaaatgtatacatgtccctgattgttgctgataatggcaacaatctgttcagtagttatagcttatggatgagcgaaatgaattacaggaatgttagaagggatgagaaggaggaattgggaatactctctaatcaggcacttgcattacctaagatcagattacttttttactgacagcatatgtgggaataatgtattactgatgttgaaattacctgtattgaatctttggaagcagatttttaaagttatctcttctttaaaaatgattatcaacatttggtaatccatgttcacaatttctggaaaactgaaatttgaatgttggcgtgttttcattctgagaaatgatttaaatgaaagtagaagctctcccatcattactttttttaagtcattgctctacagctcttagttggcctctttgtgtacatcctgttcatccaagtccaactcaagtaccattatttccactgaaacttccacccaatgtttaaaatttccc

SEQ ID NO: 115635 - DNA, 1034 bp, Homo sapiens
agcagtatctggcacataataagtgctcaataagtattatgtgaatgaaaaaataatattaagataaagaatttaagctgaatgagaaatctgtcgtgaggccttgatacgttcagttaaataacttctgtaattttgaagttggaaatggtgtgtatttttaggtcctctgcagagaccagtgagtagtaaattcagtaggcttagtcaccatagctattttagagcagtgtttcctaaacttttataatttttgtaaacttttgagctcaattaaatgaaaaacaaaaaatcaaggaataccacctcaatgttgaattttcaaaatagtggtacttaaatatctccattcgtaaagctatgtataaagtccttgtttttagactgtggttacagttataacagcacaagttaattgtatataaactataacatttatttaaattttcattaataccaaattcatataacaaatgatgttttgctgaaatttaattggaggttgtatcatgactgattcatttgtgtttgacacatgtatgctgttaagtgccttatgatgttaattttcttgtctttctcttggaactgtcgcaagttttggacaacatgtcatcgtggatttactttgcaagtttgaatctgcatttatagattttctgcttgtgtgattttcccaatagaatgtaaatacaattcagacattaggactcatgttctgtgggatgactgccagacagatggccctaagtataattgaacggtatacctgaaaagtcagaaaacacaggatactcttatttttatatctgttatattttcacataaagaatcattagctttttttttccccccaactttcagacccgttcactggtgctgaatttgaagcagtatattctattaatctgggggaaaaagcaccatagatatactacagagagtccacaaagtctggaataacaggttaaatactgtattatacttctaaaatttttatttttattttttaaagagatgggctctcactatgc

SEQ ID NO: 115636 - DNA, 1035 bp, Homo sapiens
ggtgctgcagaaagctagttgtctgacattttttaccagagagttgttgtaaaaccaagtaaggtttcttataagttgtatatattttaagttaatatctgaaagaaatgcctgctagagtaattactagagtgcttgactatgtcgcattttttaaagctatgtggatggaagagcaattgttatttgtaaatgtataatgtatattaaagatgatatctgaataaagagaatcaagagtgagtgcttttacatttgaatgcaaaagttctataggtcagtgatttccttcctgacttgtgtcccaaaatgtatataaaatgtgtttgattacaacatttcttcttttcttcataaattgccattatgaaaattttattgggaaattggagaaattggctattaagctactagaaaaatgtcagaatccatccataaggcttcatagtttaaaatacaggtttacaaatgtgtatgtgtgtgtaatttgggtgtggaataactaaaaccaaatgttaggacttatgcaacgtgagagaagaaactgaatttgtatactatggttctgcctaaatctccgtagctttttactataacatagtgtgttaaataatggtatatttatatttagacatttcataaatgaaggtgtttcatattcctgcttttatatttaatactggggaattaagtatcttaaattattttccccctcttttagtaattttcatcagggcccacaattttcttcaaacataaggctcatcctgaggttagaaagataaacaagtaatacttgaactggcaaaattatttttccattactaatactctctgtgtaactatgcacttctaattaaagcctctttaaatctgatattgttcatcaatgaacagtttggtttagtaatactaattaaggatggttctaaaatttaaaactttgaaaattaggattgtttcatttagtctaatgcttttgatttgtaattcttacagtggttgttcataggatattaacttttccagttacca

SEQ ID NO: 115637 - DNA, 1031 bp, Homo sapiens
aaaaaaaagcttattattgtgctcattttctgggtcgacactttcttcttcgttgtgattagaagattcttatgtctacagtgttacttctgatttataaagtggctcttccttatcacatacctgaaattctaatgagcagttcccatgttgatcaattcagttctgatcaggctaggctttcttccttttggattatttccttgtgttattctgtaaaggagaatcagtctttggatactgttactcatttacttctctttcgtatgttactttcctcctctgccctcaagaattaaggttctcagcctttcttatcagtcagcagtttttagtctataccacttccacttgcaggcctatatagatttggtgttcgtttttatattggcaccaggcccactgaatttgatctgaggtctaaaccgctgtctttgtagtctctattcacagaaagttttcctttgagatttcaactctatttagcttcctagagcccaatctaatctttcttttctgaattcgttctcctttcagagaagttctgcaatttctgtttgtctgtctgcaacatgattagctctacagaaaaaaaaatcggaaattgttatatctccatgaacaattacttgaccctataaattgtcttatatctcaagtgccctacatctttatatgttatctttatatgtttggacccagtatggtccagtggccattaagtgtttacatgtgtgactaataagctgaatttttaattttatttgatttagcttttaatactaagtgtaaatagccacatgtgtctagtggctaccatactggacatagcagatagaattctttcccattcttaagtgtcctcctaactcagtatcagttgtattcttaaaatgtctagaacaagaaattttgtattcatttttggaatttttaaaatgatctcataagcacataggtaaaatctaaattctcttctggcgattaaaatcttattagatgaactgtttattcttactgataaaatatgc

SEQ ID NO: 115638 - DNA, 1022 bp, Homo sapiens
gactacagtaagaatggattgttttacacagaaagaattgataacactaattatcattttaattttatttattcctaaaattgctataaaattgccaatgtatttgtgtggtgtttgatttttttggtttaattttatcttagagtatgctgcacaattcaaatttttaaaagtcgatttttaaacttttatttcttcaagttaattgctttattacttgtgcaaatataatcttactttgctaatataatcttagcctagttagaattaacctatgtatatacattgtgtacttaataaagttggccctgagaatgttcactaattcagaattggccttttccctcaattaatttgaaatctgttctttatttaagcaagtttttgcaccagtgtgtaaccttaaacacatttaagacatataagttctttagaaaaactatatggccaatatttaattgaaacaaaatatacttggggtaggtgggaattttcatgtggaaacttggacttttcataggaaggttatagggtggttgatccctgatggctggttaagaagacctgaaaatatcttcgcattcccacttcctactcaaaactgcacttaatcatgtccttaatgaagactcatagaactcttactcagaaattaagtaaaattaaataaaaatcttcgtcttattagagtttttcttgttgagtactaagaagcagactcaaagcacagttttttttgtttgtttgtttgagtctcgctctgttgcccaggctggaatgcagtggcgcgatctcggctcactgcaagctccacctcccgggttcaagccattctcctgcctcagcctcccgagtagctgggactacaggtgcccacacctcgcccagctaattttttgtatttttaggagagacggggtttcactctgttagccgggatggtctcatctcctgacctcgtgttccgcctgcctcggcctcccaaagtgctgggattacaggtgtgagccactgcgcccggc

SEQ ID NO: 115639 - DNA, 1035 bp, Homo sapiens
tctttcaagaattatctttggttatttttatatctagaaatatgatattcctaatattgctataaagttgccaatatatttgtgtggttgaattttttggtttaattgtatcgtagagtatgccgtacaattcaaatttttaaaagtcgattttaaaacttgtatttcttcaagttaattgcttttatacttgtgcagataacgtaaaattttgtatttaattttagttgtattgtagccattaaggtaaataatgagactaaataatttctggagtcagtagatttaactagagcaataattgaaattaatgctgtcttttcctacttttcataagacattaatgtgtattgttataattgagggcaattgtccttttaccatatcataattttattgttaaacagcttttcttgagttcatacagatattgttttcctccatttacaatttgtttggaaaggttttggaggacttaacatttctgaagtctagtaacaactgaaaggagaaagttggtttgttgccatgaaacaccttctcaagttatcaccttgtttttttttcactaaacttttttcagtgtactttttcttcttaaatcccagtctctcattatcctatttcaattttccctctcattatcctataccagttaaattgctatatatttaattgttaattgctatatatttaattgttgggatcttttgccacccaaacagcagtgtttttgaaaccgtgcgtggagacccattggtagctcataaaatcaattcagtatgtgtgggcagcattttggaaaaaaaactataaatttggactgcgagaattaggaaatataggacgcttaaattagaattttcaaataaggaataatttgttagtgtaagtgtgtcccataaaactgtgggatatacttgtactaaaaaattatttgttgtttgtctgaaattcaaatttaatggacatcttatacctactcctgcaaccttaattataaaaaatagaaaatagagtgtgttgtatatagcc

SEQ ID NO: 115640 - DNA, 1040 bp, Homo sapiens
atttttcattactccattatgaacagaactatgaatagactgacccagctggaaagactggatttgggaagtaacgaattcacggaagtggtaagttctcatcagtctcactttccctaagttcttatatttaatgaagaacaaaatatgaaaattaatgtatttctcttacaaattggataaaggtttacttttttttcttagttacaagatatgaaatttcttagccagaactttccagacagatagaaaaattaaccagacagatgaacttctgaccacaagtgagcataaaatgtaaaatcaatgagaggtccatggaagagatactaaacaatttttagcataggaagcagaaaatttgagtgattataagtgggaaacatcagtctggaatgcagcaggtaaaagtagttctgaatcagagagagctccatggggtattgcttgttaacttattcagtaataagatacttctctataatgttacttaatagctaaggggaaaatcattgagtgaaacaactgttatttttgaagtggtaatgagaacctttttgtttgtgctttgtatgccaagtgcgctatgaagctgactctaaaaggaaaggagtagtgtttaagtagcttttgtctttagtgagttttccaaaagaactcagaaaataagctagatttttttttttttgaagaggaactcatccagctgagtatcattattaaacttttaaattagtttacaagtttgttgtttaaaagtgtggtagctctcaaatgatggttttaagcctaggaatttctcaaaactgcttgctatagtattgccctgtgggtattatattaatattataaatttcagctgaggtttgaggaggaacatggtactttggagtacctcattctctaaaatacatgctgtgcttcccaaattatttatctgttacgtcctttctcaatatttgttctgtatgaatccgtttccgtattaactatttcaaaaatctcgttcattttaagaatccaacaagctttcaaaatcg

SEQ ID NO: 115641 - DNA, 1021 bp, Homo sapiens
tcagcctcttgagtagttgggactaaaggcacttatcaccacacccagctttttgtatttttagtagagacggagtttcaccatgttggccaggctgttattgaactcctgacttcatgtgatccacccacctcggcctcccaaagtgctgggattacaggcgtgagccaccaagcacaacctcatagctgttcttgaatccttttttttttttttaaggaagatattttcagaacacagtttaggaaacatagaaggattttcaggtaacatgtagagcctagttgaagtattattagtatcagtacacaaatatgagtacaaattaatcactccacaagtttgtggtgatactaatttgctcagcaatgtaatatagagaaagcacacaactggaaggattttgggctgtagttttgccaagacaggtgcaagaaaagaataatgcagcaaagaggtcttggtttgtggcaagaaagtggtttaaataagatacagtgtggtacaaaaggggagtcaaagacaggagtaaatggtgggaagaatgtcaaaaggtcaaaggaatagtagtcttgctgagggtgatcagcaagtactgtgagtgcagtggagtgggagggctgcatgatgtctgtgttaccatactctgctggttgtccttttacctgactgctcctcagtctccttttcagacatatttgttctgcctgtgccttacatgtttgtgcttctcatggttaccctaggctctgctttaatttctccctactttctcctgaaattgctatctgtatcctcattattcttaacaatatcttcagcccagttcttgtgccagagcttcacattcatatagctcaattcctacttaacattgccacctacatgtctcaaattcagcaagcccaaaattgagtataccacgttctgccccaaatatatttcccccacacccctcagcttctttagcttggtaaataatacttgatggaggcagaggcctggaaatgcaacccttaac

SEQ ID NO: 115642 - DNA, 1042 bp, Homo sapiens
tttgtagctaagaaagcaggatattagtggaaatatgagtctgagggtttttattgcatttctttttacattgaagtgaaagttgcctctggaagttggggtaagggcatttcaggaagtggtagtgattaatgtatcataaaatctaagcttaatagagaaggaagtaaaacctagagtgattttacaaggagcaaaagaaaggtagttaaggaaccaaaagtttaccagcaataataaggaattgagtgatttggaagaacaggtgtagtggtcaaagaggtggaaaagtcctgggtatgactatggttgtgaatcatttagctgatgtgcatagggacattgggattgaggacatcaaggaattataaagttgtagtgttggggtggtgggcttatcatcccacattgacatcattcaggatattagcaggtcttaggtggagagaaaatctgtagctaaaatattagagtcctcagtaagtctatacctgggtgatcagtttgagtagcctctagaatggatagaaagggatattacctgatatcctgaatcttcaaagatgtgagatttatactaaagagtagaaagtgtaagtgacgagaatttgacaagaatgagaagcatggtataagttaacttaccttgggcttctgaataaattctggtgtaaagttgctttagaaataatctaacactaattggaatctctgggccaagctggtgattgaaattactgccctggaacaagggagagggaattatatgaattaaaaaatagactttgttggaaactgctgggctgtccttgcctttccaatcataccacaaaagtatgtcagtaggaatttgaatcacattccacatttgttttgaacaaaaacaaatacactacttcattgagtacgtgttaagcaatttaaaaaagcaattataagggaaaaaaaatcttgaatggagtaatgaaaacaaagaaaaggctaaatcaaagaatttcattcccattggtaagatttggtttcatgacatccttaatttggg

SEQ ID NO: 115643 - DNA, 1100 bp, Homo sapiens
gaatgtaattatttgccccttatacaaacttagctgaatctcagaaaatgacaggctgaccttggaaaaatatggctcttggtatgtgagacataaatatacgaatatctgaattttatatatacgtagatgaatagctgaaaaatgtgtatctgtttcaaagctaagtgacacaatttttggcaatattcatactatatatctctaaatggaaatatttgagtctgataaaacttttaaaacattgaaatttactgcaaagtcttattttgtcataaaaccatatttttatcaagcctaaaatgccttcaaagcctatcatctgtcttcacagttatccctatgagcttgatatctaatgtaattcagatgggttacagattaaattttgtttgagattgacattagaaatatttgtacttcatattttacttattttatttctctaggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaaggttagaaaattcaaaaggattaaccaaagcctatttcaagttcttatttttaaatgacagttgatatagtgccccttttcatgtactctgaatgtgcagtcatgcaccacagaatgatatttcggtcgacatgctcacatacatatgatggtggtcctataagagtataaggggctgggcgtggtggctcacacctctaatcccagcactttgggaggccaaggcaagcagatcacttgaggtcaggagtttgagaccagcctggctaacatggtgaaaccccatctcaactaaaagtacaaaaattagctgggcgtggtggtgggcaccagtaatcccagctacttgggaggctgaggcaggagaatcgcttgaacccaggaggcgggggttgcagtgagccgagatcgtaccactgtgctccagcctgggtgacagagtgacactctgtctcaaaaacaaaaaataagagtataa

SEQ ID NO: 115644 - DNA, 1056 bp, Homo sapiens
ttcagaaactttcacaaatccctaaatcgtctgtatattcctttaggactttgccacacacacattattgtatcacagaaacaaaagttttaccatgtcattagagttactgtacagtccacaatgagcagaaaacaattttaaccatccggagttgagtttgctgagctaagtgactcagttgtccacacttacaagccttggcagcttctaagaggaaagtaaccttggctaacttttaaattttaatgtggctcatggatctttgggggccacgtgctcctaaaatgagcattttatctgtgagtgtcacaggtttctatgtttaaagttttcatgtttgagattagtccagaattggaagttggcaaattgcttacaaatttttatctgaacttttaaaatagatataaaacttaaagaatatgagctctttatcttttcttttacttagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggtatgattttatgattattctggagcaactataagaactttcaatttaatattttattgttgctaaataaagacctgatactgattgtagaaaatatgttaatgcattcatcattgagaaatttcatatctgcaaaaatatcactcacttgtcactttaaacttacaaattattatgccctttgtattcagatgtttatgcgaattagattatagatagtctaggctactgtaaaatacataattgcttttatttctgtaacttaaaaatgaaaagactactataggcatacccaattatttaacttatttatgcatttatccttgaaagtgaaagattttttggttgaatgtctgagacagtttttagatgtggagtttcttctagtggataaataaaagctggaacttttttta

SEQ ID NO: 115645 - DNA, 1066 bp, Homo sapiens
atgttattaacattttatgttactgaataagtcagagacaatattatgaaataagatcagtagagtagacagggccctgattacgaggctctgaaaagccaagctaagaagtttgaacttaatgttctgtagtgttgaggagccactaaaggcttttaatagagtgttactctaattcatagagctatatatggttgaaagttactatagttgtaagaatattataggagatgcagcacgtgaacatctcagtataaaaaagggaatagaggagcagtatcctaatgtttgattaggataatggtgccatgaaaaggatagaggtacaaattgtacaaacagtcttggaaggactggttgttattttattgccgtatcttgaaaaggtttaatatgtgtttataatatttgttttccctttaaagtcttatgacttaatatttatttatttaaagaaacaaaaatttaatttttatccccctcacccccttttcactaggaatctgaagaactttcttctgatgaagagatgaaaatggcggagatgcgaccaccattaattgaaacctctattaaccagccaaaagtcgtagcacttagtaataacaaaaaaggttagatgttaaaggaaagtgctaagaatagaaattgcctcaataaatttataaatttttttgaaataaatttcattgaatattatgttatttgatacattttagaaacaaatttttagacatggctttctgaaaggttctctttccttctctctcatttttagggaaagtccttgatagtcttttctttctcctcatgcaaatttacttataaaggcatggactttaccgacagataaacttggattgttcatttctgccacttatctgctgtgtaatccttgagttaattttatccatgtgtacatatctgatttgacatacaatgaggctaatgaaggatttttgcatcaaataggctagataatgtatcttttagcacagtaccttatgtatagtaggtgctcgttattttattgattgtatcacaaaacatttttttacactccgtc

SEQ ID NO: 115646 - DNA, 1011 bp, Homo sapiens
tgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggcctcgatctcctgacctcgtgatccgcccgcctcggcctcccaaagtgctgggattacaggcgtgagccaccgcgcccggcctaaatcgaattcttaataaccccagcattggttactttttgaaaaattatatcaccatctaaaaattatttaatctttgtattaggactgaattttcaggggtgcttccaattatcaatataatttattacctcatatatagaaccaggatggtataattgccatttgtcatcactgaaaagaatttcacacaattcttggggaatttatcattaatcttaaatttgttttgtttcagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggtgtgtgaacctcttttacagttttttatttatacaataaatagaagtagtaaggcagataacaaatacataaatatatagggtttaataaatattatagaagtggttccagtaatatgttttatttccccatttttattgctgattttccatttagtttttatacatttccatcttaaattagatttttaaatggggaagaatagactagattctcaatctctggttaaaaagttgaatatttatatatttttagatatggcaacataaacagcatatttgaggtaatttaagttgaaaggagtatttttatagttagaaatgcagaatcattttgaggg

SEQ ID NO: 115647 - DNA, 1246 bp, Homo sapiens
aattaatcttggtattatctatgaattttaattgtattacttgtctccaactgaatataaagctcttttaactattaagataatattttaaaattacatgcttgataataaatgccttttgtctttgacttttattaacttttttaacttgtctacctacacaatttatttattaatgttccctgttactaagaaaactcggctttattatgtttttcataaaattatctttattttaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctcta

SEQ ID NO: 115648 - DNA, 1478 bp, Homo sapiens
cagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaaggtaattgaacatgagtttttcattattttctttatgaacttaattattttccttaaaaatgatgaaacaagattctctgaattactgattatctctttatattctaggtgtttttctctggtactgggaatagagttccaaatttaaactcagccaggacaattgggatgataatgtgtgtttctatcctctccttcactccccactgtttctaacaaaaatgtattaattttatatgtttatgtgtctgtctctttgagattgtgcacacatactaaaaatacacgtacctctgttcagcattttctgaactttgctattaataattgttgattatctaaatttaaaaaatagtttactatatagttaagacaataacaaaaaatgtattgcaaatgtaaatatttcatctaatattttttccccagtccacagtatatgaactaacattgtcactgacacagatggcttctggcatggcatttattcttaacttttctgaatttctacatttctgacctacttaaactcagttaagtgtttctgtggctctagtgttgcttagcaatagttgattaaataactaatgctcgtgttcaatttataattttatgtgtagatgttcatcttttgaaaggagttaaaaatgtagatacagatatatatccttgtaaaaccaatatgaatgccatagtcatatggcccaagtgtacaagacatgatttttctttaagatttaactttatacttactcactagattttacccaagcattatctttctttctttattaaatataaaatgtgttcttaaaaacaggtgaacatacaacttcaattagccatttttaaaaattccttaaataaaattttcagaaatgcctaaaatatattagtacctcatatcagtttacatgaaatctcagcctataattgttctttttagtgcagtcctcaactttaaatgaactttaaataggtaaatatccacaagcattaggctacttcattctcatctatgcattttatttcatctagtaactctgtacacactgttgaggctatttgaacttttgtgctttttctaaggcacttggaaatttcttaagcagaagagtaacataggtgtgttttata

SEQ ID NO: 115649 - DNA, 1001 bp, Homo sapiens
gagtctacctcttaaaaaaaaaaaaaatttttgaagtggtattttttgcaaatatattttgtgttatgtatatttaaacactcagtttgtttaatatgttagaatttgcataaaatgaagtagattctctaaaaattcatttgacttagaattactgggtgttggtaaaatttatctttatatagagaaattaatttctgttctgtatatgactttagatacacatacatcagcatatggcgtcaactcctattttctgacatatatatctaagatgtgttaggagtaaaggaaatagcattctaaaagcagttatatgtctgtactttcttcctttgcttaaacatgtgaatggttgtatttacgtgtaatttgtgtatatgtatatgttgtcatataaatacatggtaaatggttccaatttctttcactaatgaaaattagtgttgcatgatacttctctggttttggggttacttgtaaataagtctacgtatataacatgtctcgtggattttgcatgctacactaatctctgttaaatctatcccctctttattcagagcatgctgtcaaggtcctttaattccaattttactactgtaagcagttttcactgtggcagctctagggatctgcatggcagccagggcagtcttgccttgagtgttgcagacagaagaggttctggtgggcacatttttcgagtgagtacctacactagaccaatacttttagcttgtagaagagaaaaccccaaattttaagtgttttaatgtttccaggaaaaaaaatgtttactctgggttagaaaccttgatttcctctgagttcttccatggcttagttctaaatctttcttcagagctgataaattcattatctcctgagtttctttggtcataaactaatgatgtagtcagcccttgtttatgcaaaaaagtgaacaataggaataactgagagatcttcaaaaactattctttgtagtatgttttctc

SEQ ID NO: 115650 - DNA, 2044 bp, Homo sapiens
ttgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaaga

SEQ ID NO: 115651 - DNA, 1003 bp, Homo sapiens
tgtaaccactaaagccactttatagaaaatagagaaaaggaaacagcacttgtgatcccaccactctatcaaagcttctctccatttccctgtagtccttttcacatgcgttaataaatattggacatattacctcattggttttaaaaataattgtatagtgctatcattatgtaatatatgtaatatagcgtaatcaaaggaatcacactgttattttacttttttcactttgtcataagcattttccatattgctgtcttatttatagtaatatttagagattagtaatttctgagtgtattgtgtgtttttgaaattctattgttggatattttgattgctttttttggtattacaaattagtggattttagctagaaattgggaggtgtgtctttttgattgtcaacaatgattagagggcctgttggcatttagtgggtaaatgttagcaacttataagtagtcttaaacaggatgaattgtgctaatccatagggccactgaagcccagtgaagaaaccctgttataaataatgcaccaactaatatttttgtacatgatactgtatgcttcgctcatgttttggcatatcttttttggtaggtcctctgtcctctaaaggatgtgtattaatgtactgataaaatactggacatattattacctcattggttttaaaaatattgtatagtgctatcattatgtttaataaaagacaaaataaccagttagggccaagaaatttaattgatgcccaaaaagttggttctttggtttctgcgtgtactacccactgaaaagttttaattttttttgaaaaattgataagattttgtattttaaaaaaccaaaactttaagtcaacgaatgaggtcaaactaaaatctgctaaatttgggtactgctattttcttcttaaaatttatttctaaaattttatttatttatttagttaagtagagacaggatttcaccatgttgcgcaggctggactcaa

SEQ ID NO: 115652 - DNA, 5114 bp, Homo sapiens
ttcaagtgatctctctttttttagtgtgaaaaatcttaaatgtttcaaatagattttaatataaaatctatgttacagattacgtatgtacttagttcggtcttttttttcctgctaaagacaattacagattttaatgaaaagtaattatggataggctgacaaaatgattatccatgaggatagtatattttcgaatctaacaggatgtattcattttaggaaaagttcctttcatttgtgctttgtctggttcatttttagtatcggcctgcctggattaaactgaatcaagtaggaccagttagagtctttgttgcctataaaatatgtaagattttgtttgtaaaatcttttgtctggaaaatcatcactgtccagctctggtgtatgcaaaatacctcaatttaaattccatactacctgactctttctaagactgttgtgaagttttttagtgatgtaaatgcttgggaaacacatttaggaagagttggaatgatgataaaatttgaaatcttgaggtttggagcttttataaagggatttttgcttacatatgatacactttttgagttaatttttgggttaaattagctttttttacattcactcggattaaggattgattaatttgagttccaagttttacaagtaaggcagtaggcctgcctggattgccttctgttgtggtagacaaatcaccattaaatgactaagtttcactgttttatgtgttaatgatccttaataacaaaaagttttaaagtcttaatttcgtaagattatgtaaaggttaagaaagaaattttaagtgaaaatgataaaaccaagcaaatgtttattagttcaattgtttttctttttatcttgcagcaacgcacctcttgctttttcctccaaagtatgttatgttaagtttcgtgatccatcaagtgttggcgtggcccagcatctaactaacacggtttttattgacagagctctgatagttgttccttgtgcagaaggttggtatctcgctttttttcctcttatttgaatttctgtcctgtctgttattgcctttagctttcctagagattggcaagtagacagtactcttggtgtgtgtgtgaaagtaagaatgaaatttggaggaggtaaacctttttacctaatagtaatattaaaatggttaatttatgacatgtacatttgaggttttacaatttaacattcattggcttctggtttgctttggctttctgtagtcaatttgcagattgcaaagaaagctttctgaaattaaaaaataattgatatgggaaattattttaaatgcataaacaagcatttaccttgtgtgttcaatattaatactattacaaatgaaaatagtgtacacattttggcaaattggggttaagtgatatttataagaaaatatttgtaatttatactttcaagtacactcttaaggtaatttaccttaattgttactatgagatcattattttatattcaatgtaattgtttgctttgcaactggaatttaatgttttcttttactggccccaaaaaggggcaggaggagtgttggaaaaaaaggaaagcaattttccaaagcctccatgaaggaagtagttgttgaagataggaacaaaggccttaaagtatccattaaattttatgacctaaactgctttaagaactaattattactaatattttttagtaacttctgtttacagagccactcacgtataatagactgtgctgaattttgacacttctggtgtataattaacttttattcagagcactgactagcatgtgtacaggattttagaattgggttattataaattaaaatgtcttaaagtagattttctctggtggatgattgaaactgttttaaacataaaggtttatggaaaacagtttgatgggctttcatatgtaatttttaaaacctcttttagtggccaggctgacattaaaataatatataataagcagtttgctgcactttaaaggttttatgcttatttcagaatgcctgttctgggatgtcaaaaacattacagtctaatacagtgagtaccaggctcgtattttttaagtcccagaataggacattctcagtatttttcagataaatttggaagtgtctttcccatgcttgggggttagagtgggtagggaagataaaaatggattaaagttaattattggccaaatgtatctttatctgctgatctgtaaggctacagtaagccccaaattggtgaggtgggaaaggagctggtgaatggtttcgttctacaaactttgtagtgaaatttcatactgagaaactgcatgggaaaaaagaaatcaggtaaaaggtttattaaactggaatattaattatatcagaaaattaataccaccaataacactgggtcttttattgtgttagcttattactgaattggaaggaagaattttatcagtgttgcttggttgaaacctgctttattcccatagaatctttcatatatctgagaagccctactgtattttgttataaatgttcaagatgatgggcgtgtagatgtcccttttattgtttattttacttgatagagatgaataaatgcacagtcagatgtacctttttagtgtttttaatattacaacttggacagttttactgtttttgaacagaaaaatttaagcatacttttattgcaatttagttataagtaagtaaatattttgaaacactaacctacagttggtattggtgaaacattcagatatacgtttttcattagttgtattaaatacggcagagatgaatttatggaacctcgagaatttcacagtgagctgttaaaatactgattatgcactacaagcaaagaaatagtgcattattgtactaaaaaagatagcagagtgagtgtgaaataaccaaagaaaagtattccagtggagtaagttctgtaagaggagatgtgctgtggtgctgtaagcaagcagtgttctgttgacctcactgaatgcatcctttccttgatgttgaacaaacagcatcatgacataagtgagaaaaaccatagaaaaaaatttaagaagttttttcagtttctttgaattgctgttttttagtgtagacagtaatgtgagaagatcctaagttgtaaaagtaacatttgatgtgtaacagtttcatgcatattaagccttagcctttgttaataaaacatgccatttcaaaataaaatatgctttcattatacttgtccaaatatgacctctttttgttgttgcgtgcatttcagatttctttttataaatgttaacacgtagaaaaagatacggtcaaacataacaagggtgtcagcctaatcatcagtcataactttatgtccacattttctggtagatggattttgactattaatttggttttgtatgttttctctatgtgatatttgtgcattattagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagtatctcaggaacactttctgatctcagcgcaacatttttctagtttttttcccccctagtctacatctctcataaaaactgatagcttctaatttttgtccttccccctggaattttaggcatacaaaatcatcaaggaaaataagtaaatataacaatctgggagtaaagaagagcctttcatttttatgatggttatttatcatataacttatttccttgacttatgaagactttttgttgcctatgtggggaatggatatttgagaaacttaagtatttgcatgtaggtttttgttagcttgaattttttgttgaatatttttcagaggttactagcttctaaatggattctgagattaggactataatactgtgagagatgttttcctcagttgactttgaggagtatagtttgggaaaaatgctaaatgcttatttgttttatacttttataagctctgttatttggagggtaaatttggtagaattctatcttggaaattaagcaatggagctttttcttaaagtacttttgccattacctttaggtaattagaataagtatatagagtaattagaatggtaattgaaagttaatttattaaaaaatgtgcttatagtggatttatacatttatagtagtatactatatttatagtagtatactcttttgaaaggcagtgggagagtttgacaacctactgatacttaagctgaaagtgaaagacttcataatactaagtagtcaacttttggccagtgttgaataccctttttgtttgtatagtctttctacaatgtcttcaataggtagttttacttattaaaggacaagtaatattaaatttgggacattactagattagaactctgagtttccttaggtgcatacattaaggtagtgacgatggagtttctgcctcaaaacctcaatttatcaagaatgttcaggttttacaaaccttttgagataataccaatttataacagataaaacaggtgaaatcaatataaatagtatagtgtatatgtgggtatatataaatacatgtgttaataccaataactaatacatataaagcagattattgttatttgatgttttcagtaaggcctacctgccttttgttgatgcatgttaagaaatctgttctccagaatt

SEQ ID NO: 115653 - DNA, 1228 bp, Homo sapiens
acatgtagtcaactatttaagaattttttttttttttttttgcctaaggggataaggaaaaataatgtgaaagttgcagtccttatcagaagtaattgattagaattcagcaatgaatatgccaaatcgtacttatttcagagtaagtttttcatttttttaggttgtagggagtttttttcctactgagtgttattagattattttaatgttactattgttattaggcaattaaaatgtttttaagcaagctttaaggcattaacctcccccttcagataagtatacataaattggttctaaaagttaataagaagttttctgaaaccagggaactttttttttcctgaaacatttttagtagtttcccaaggcatattttttggaactgagttcttttaggcatctctgatgttggtgagatgctttattaactgaatggatgtaggcttccttttacgttgaagttgattacatggagtaagtttttgttttctatttgaaattaaatggaatctgttggagggttatcaaaattgtttgcatcacaaataggtagtttcagtaacaggataggggcactcattaagaaatttcaattcgcacatatttgttttttctttttcttttttttgactaatttggttatttgccatttctggggattaaactttaaaaaatgttcttcttttctgtatctgatgttctgtgtgctattagtgatgcagccaacacgaacggttgtcatgtgtaacacaactttcgatcaccgcgaaaacaccgtcctgggaaagcgtccatgcttgatatcgtttggttcatgaacattaagtttccagtacaggtgacccatagctcaaagtgttaaataattgtctacattattcaatttttaaaataatattccattaatgagattgttaatatttgaagttttgctcacttttatttttcctagtagagcaggataaaaggaaagacttaagttcttatttatttctttatacagatctgatagatagattcatttattattattattttttaactgcaagggtaattgtaaaatcatagtgtaaagtttgtgtggtgtttctgctttttgtaatgtttggaacttgcctctgcaggtaaaatcccagaggaatccaaagccctctctttattggctcctgctccaaccatgacaagtctgatgcctggtgcaggattgcttccaataccgacc

SEQ ID NO: 115654 - DNA, 1263 bp, Homo sapiens
gtgaaaacatggcaaaatatttttccattaactatgcagaattaaatcataatttagtaatgcttcctttgtgatttccaagtgggattaaaaaaggatattacggccaggcgcggtggctcatgcctgtaatcccagcactttgggaggccgaggcaggtggatcatgaggtcgggagatcgagaccatcctggctaacacagtgaaaccccgtctccactaaaaatacaaaaacttctctgggcgtggtggcgggtgcccgtagtcccagctgctcgggaggccgaggctggagaatggcgtgagcctgggaggcggagcttgcagtgagcgaagattgcgccactgcactccagcctgggcgacagagggagagtctcaaaaaaaaaaaaagggtatattactattactggttcttggtttttgcttaaaaaactctggccatatttattttaaaagaagtgccatttttcttcaaaagacaacatagaacaaaatacaaagcttgccttaattggaagttgaatctagctttgtggtgttggataggaattgaactaagaaatgaactatgtgattgtagttaatttatctagattgtaagagtggtttctgaaattttgaagtgcaaaattttagatttgtagtttttacataacattgctatgctgaagacctgcattctgattcttggggggaaatgttttttaattgaacttatgtgttcaaggaacagaatggtggtcagtatggttgaagcatagtgagtgagggtcatgagtgtttgagattggaggggatagataggacacagattatggtagggctttttagaccatggaaagaggggtttgagttttattcttaaggtaattagaaaccattgatgggttttaagcagggatatgacatgatttgacatgttttaaaaagatcagactggctgctgtgataagtgacattgatttcataaacttccgttttcaccattagcaagtgccattacttaacagttgttaaaatcttagttctgtatcatatttgtatatatagtcattaatggtcaaaatgttctctaatagtataagtggaaatgaaaagagttgtgcttttttccttgaaagctcttttcgttctgaaaaattttttctgttttcaaattctgagatcttacatttcttctagtttacattcatattaaaaataatacgttccttaatgctgaaagtaaaaactgaatttagtgatgctatagaaagatc

SEQ ID NO: 115655 - DNA, 1991 bp, Homo sapiens
atattttagatatattttcttaggtaaactttcagcatgataataataacccatttcttagggttgatatgaggattaagttactacctcagttaaattcgatgctatgataattgttgactgttaggaactcatactcatactcatctgtgtttttcaatgaccaaggtacagttgattctcattctttgtgaattctgtatttttgaattcacttagtaagtaaaatttttttgaaatccccacatcaacagttggagcacttttgtggtcgttcgtggacatacacagagtggtgaaaaattggggtttgtctatttgcacggaggtcgaaatcttcttgttttggcactcaggcagtaaacaagcacgcagtctgtttagtgctatgttctttgaattgttgtgctttttgttggtgatttcactgttaagatgggcccacaagtgtagtgccaaactgctgtgtagtgttcctaagtacagggagattgtgaagtgcctcatggagaaaatattaaatacatgtattagataagcttcattcaggcctgaattgtagcgctgctggctgtaagttcagtgttaatgaatcgacaatatataacagctaaggtgtctttaaacagaagaacatataaaataaggttaaatattttactagttaatgtaaatgtgaccagaggcttgtaggaacttcaccctgtattttccctaggaataatggttcaatattcaataattcattgttcacggaaactatagaacatagctatgtcaggtaatgagaaacagcctgtcttttagggtcaagtttaaaagtggctaaaatatccagacagtaaaatatatttcaaattacatttaaaactaatgtgaccttactttaataactcagacatatatatgactgaaagttcggagtccctagtctcctttcattcttgttgagttagttcattcttttcaagattagagaatggtatctttggatactaatagaaaatatgtgttctgtgtgttttttttcttctttcgatagcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccaggtaactaattaaagaagaaacaaagcagcagtagcccttattctttttctcttcttaaaaatcatatcagtggatacagtaatatttatctgattttttaaatggatatattttatcaaagtgtcactttgttcccttagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaagtaagaaatcctaaacaaagaaattttaatgattttgaaacatttaaagtatttttgatgtaatgaaggctttttttttctttttaatagtaattggcaatttgtggaaaggaagactttgtgttaagtataaatgaaatacatgagatacttaccattttagtctttaaattcctttatttagagacatttattttctcattttctgttttctagggtctaattcagtgttaacattatttatataccctgcataacggttgtaggtctttttccataaactttaatagtcaggttggttttacattatgacactagactaattgagcaacttaacaggtgggttgaactacagtacttccagtaacaactgtggtaaattcaaaatctacagaaggaaattataagtgcccagaaatgttttaaaccagaaattttgacttttgaggtttgcttacatccttg

SEQ ID NO: 115656 - DNA, 2581 bp, Homo sapiens
caggtagcttacccttcttctagagtgtacaggatatcagtaagatcttttgatttgaaaatagaaatgattcattttcatattggtatcaacattttaatttattttaattctaagctatggaaaagcacttcatctagtctgtttgaattaagttagctagggttcaatttttcttttctccctgcttttggttgtattcgcaaggaatgataggaagtggggatgagagattaatcatggttttgaggttgcttttggttattctgtatatcattcttacgtgcttctgagatgtcctcacgtttataaatatgtgtatcatataaatgtttgtttcatgttttataaaatgtggtgtgtatttgtgatatgctaatatttttaatttagaataaatcactccaacaatgcaatagtaaaaccccctgagatgacacctcaggctgcagctaaggagttagaagaagtaatgaagcgagtacgagaagctcagtcatttatctcagcagctattgaaccaggtaagtacataacgttgttacataggtcatagtttaaagatcatagactcttagaactggaaggaattttagaaatcatcttgttcagtcacttcattttacaaacaagaagactgaaactcaagaaatagtaagtagcatactcatgtcaaagaacaacttagcccatattttatctctttctgtgatactgaattgaggcactttagtctgagctaatcagctctgtattttcatagcaaaatcagtgctcacaagtgatttgctgaaagcaaaaatgttattgcaaggctaaaaagagtacatatatttaaaacgttacgactcagcaggtttacttttcctcaacattttaattttagaagtagagaagagagcccgtgatttagaaaaaaatacagatactgtattttagtaaggtaaaagaacatctatttaaacttttgtgttgctaatgaaaataattaaaaaacccattctaaaaacatctaggtggtttacatttgagcagattttctaaatcaacacttagaatttaagcttcaaattctagcagaataagtggagaaaggacttaaaatcactgtcacaggaattacagacatgttgtaatcgtacgttacggcagcaacaaaatattacgaacagctgtttataatcatctggtttatatgtactgctgcagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggtgagaatttctgctgtcatatttaaattttattttagttttgtatttaaaatattaagattttatgagttttcgtcaaaatatcagaagttagaaattttagtagtgtacacctgaagtgtggttacctttaaatattgttctaattgtaatactgtagttgagaatgaaattttgtctaatgatacttaatttttaaatatttgaacttatctttatttttagaagttagttttgtgtctaaagatactctattccagatttttctaagagtaaactagtctttatatagaagtgacaaaagctgttttcattcttcatattgagaaaagggaacatccttagtgaccatgctgaaaataattgctcaagttgcagcttttttgttttgttttcccagtctattccaagtttggggagcaccaccccagatctttcacgcaattccctattttcagtaccacgtatccaaaggaacactttgagtccttggtattgctggtgataagagcctcctctgcccacttttggacctgaaacacaggagtaacttgcagtttcagcttcagttttagtactttgcttaagctctgtttatcttatttttgatcatagctttgtccttttgattttctttatctgtcatttctttgtctttggtataaaggggaccttaaaatgcaaatttggcaataccatcctaattggaagtaccctaaagatcattactaaagttacaaattttgttgtctattttaaggtacggagggggctgtttttgaaatgtgaaagtatgtatagtggatcctaattgcatgttatgtgtacatacgtactcctatgtatgtcttgagagagcagggagggaagagtgtatctgtgtatgttgggattttaaagaaggagaaaggatttgggggagggaaaaggaaccagtttgttgtacattgttttaccagcaggctcagtttactttgtttttgtgtgtgtgtgtgttgatcaaggagattcaaagaatgaggaaaaataggatgttctttcttagattctagtaaacaagtatacaccagatatactagtgt

SEQ ID NO: 115657 - DNA, 3485 bp, Homo sapiens
tcagctcattgcaacctctgccccccgggttcagttgattctcccacctcagcttcctcagtaactgggaatacaggtgcatgccaccatacccagctaatttttgtatttttagtagagacgggtttcactatgtttggcaaggctgatcttgaaatcctgacctcaaggcaggtggacctcaagtaccacctgcctcggcctcccagagtgctgggattacaggtgtgagccactgtgcccagcccaactatatttcttttactgataattgttctaaatttattaaaacatgactatcaagatgagttttagctgtataaaggatacttatagaagttcattcagcttccttggaatacgtacataaggatataaagtttacatttatgttaacttttaatgatgatgacattgagagttaagatttttaaacatttattttgtgctagagaatactacgcagttttacatacatcatcagttgtaatcctcatgacagccctaagagatgcaggtatgattgctactccactttatagaggaagaaactcaggcttggagaggttaagtgactagccagagttctcacaggtagcgtgtggcagagctgactttcagagccagattgtcagactccaaagctgttgagtctaatcactttgctatttaagttgtgtacatctgttttgttacaatttaataagcagttaggatacctcgttatgaaaaaaatcacattctcaaaaaactttttcagtgagaaagggggcctagtccaaattggaataacagttacttttcctgcaattaaacgtttcctgcagttaacagtttcttttcatacaggttgagactcacaaatttgaaaatctgaaattcaaaaggcttcaaaactttttgagcgctttcgtgatgctcaaaggaaatgctcactggagcattttggatttttcagttgtgtgtttgggatgctcaaccagttttatgcgtgtgtatatatagaatgcaaatattcgaaaatctccaaaaatgtgaaattcaaaacacttttggttccaagcatttcacataagggatactcaactggtagctatgattatagttacagctataaaatcaaggcattgcaaatccaatatttgattatatctagttttaacttatgagtaatgatttttattttcctgtcacagtggcgctgtcattaggactgtgcttccttttatatattctttttgtttgttatgacagacagcacacattcacaggaactactcaaccacgtaaccactactccctgtcatgatgtgttatgaccagattacatgcaagtcaacagggaaaaatcttctatactgatttgaggcataaaatgactagcaaaagccacatctgaaaatatacgaaataactgttaaattctttgtttctgtctctgttctagacaatgaaatatccggtaaagtttccagtaaatgtatttcagattatgtaactaaagtattatttaagagaaatttttaaaatattgttaaatactgttaggatagattttaaattttcttgtttgaaagatcgtaaattaagttttgatattctaacaattttttttctttaggagtagatcccataatagatcacgttcaagacagaaagacagacgtagatctaagagcccacataaaaaacgctctaaatcaagggagagacggaagtcaaggagtcgttcgcattcacggtgagttttagagaaattaacaataatttttttttcctcagagttctgttagtgctaagggataatattttaattggcttcatttgttaaaaatctgttgtggtttaggtttttaatgagagaaattaaaccttttttattgttttagtaatctaggattaatattgattgccagtgatctgaatctgatgtcagtgtgactcatgaggtttccaaactactcagttcagcttgcgtagtatgaatagctttgtttagcagcttcttgtacacctgagctatataaaaatgtatatgtaaatgtctgtaggtactataaattgtcttgtgttggtaattgttgaagagagagaggtctttttggaggaggtagaactattttagttatgaatttatttatttttgtttttaaagggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcaggtttgataatgcttaaaatttttacaaagggatttgctgatgacaattggaaacaaaattttttacggagggagaaaaggttactgtacgcaagtggaacctgtaaagtaatataagaacattttctcctaatttcagagtaaacatttctctagcagagtggggaaagagatgatactgggcaacattatttgaagagttttagctattctttgtaaccactattttaatagaataataataattgttattttcttagagggtgggatggcagggaaaggtactttttttaaaaagcacattaagaatttgcgtcttaggctttttcctgaactttttttgaatggtgtgattaattttaatatgtaaaatgattgctgaagttgcagtgttagccctctttgtcacctaagttaatttttatccttattttgttaagtgcataacatttaaattttggtcgtgttttattttgtcagttttaagggttagagtttttccttaggaccgtgatttcagtttattaatagctttactaccaccaggtggcagcaagttgccatagtaacagctgtacaatgagaacaacttttgagatttaagattatctaaacccacatcctttacttcagatgataccatgactgtaaatggaagttcctaacttatactacactatcttaaaaatactaaatatatatattagcaaatttttgaagatttttaaagatggttttttaatagaaaataatttgagataaaggaatatatgtttcccatttttaaaacttgtgctttagtagtttatttttaataccagcctttgactagataataaaagataatcgtagacatttattgtgcactttactgtatgccagacatgatgtcagtagactttttcatgtctcaccttatttaatcctcacaacaggcctgggagaagattattatcatcactgtttta

SEQ ID NO: 115658 - DNA, 1041 bp, Homo sapiens
cattcaccctgtgtaattgaccaatcatttgattgtctttcctttgtttctctttgcgaaatgaggcggatacatattcatttggttttattttctccttattgcagtacataaacaaatattgaatattcgaaaactattaaataggctatgccaaatagtgttttatgagaacatatggtggcctctgccaaaatgacttgtgtatccttaagaaactaactggggtaagggtggggtaggtcaggttgtagggctcatttatgttactttgcaaaccagcttactgttgatgcttattaacaatgcattattttagatatccagtgttagaaaaggatattttgtcaagaatataatagatcttacaatttcttagaatttaactgacatatcaatattcttatagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagtaagcagcagtcattcggtgtctggcacttgaaatggttctttattgcatacaaatggttttagactgaaagctctttggggaacagtgtcttgtacattgttggcattttatggcattttaaaatatttaaaatatttaattggtaatttaaaaaaactaaatgttgaagagataagagccaattaaaactaaaaaaactaagttaaatcctaacatggcatgcaataagaaaaatttaagaaatcaacagtaacaaatgtatttgattttatgtagataggatttctgcctgatgccattttcctcaatttatgtttcagcaagtttgaaaagactttgtgtagttaacattaggtttgttgggttagaatacctaatggaaaaccacattccaccaagtgagcttttttgtcacttggataaatacttcaagtagttgtgaattaagttacttacactggtaaagtatatttgtatttggaaa

SEQ ID NO: 115659 - DNA, 3515 bp, Homo sapiens
atatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcatgtttgtgtggtgtctataaaacaagtcatttaaagtatgagtgttttcttgtactctggacctattacatgtttctttatgttggtaattaacatttaatttggttcttgctgctaattattttctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattttgtttttttctttaagacttctttttttaaatcccaggtagatgttgtcagataaacttgaggtaaggccaagaagacagacattttatgcttcatactttctgtaattatcttttgtagcttgattacatagagtaccctctcttccttaagttgtagttgctatttatcattgtagacaaattctgttgcctttcagcaacgtatgctgaactagtatcataagatggtgcatcagttcataagctagtgcataagttttgtgtcaaaacttttaaatcctgaagttctgcagttatcatcttagttattttctatctaattagcttataattgcaaacactagtcagcttgtgatctctgtgtttcaagttcttttcttcacgaggttcagtacctgctatgttgatctttggcagtgccagaggcttaaattttgacctgctcaattaaaaataaacactggcgtttataatgaaaaggtttttttgtcgggggggggggggtcaagagaatttattttgtgatagtaataattttcaagaccttcagtcattcctatgtctatgttgctatctttattttaaaacttagaaccctgatctaactcccttctcaagtgaagatactgtgtagattcaagaattataatgtagagtaataggcctttaagtttttttttaatctgttagaaataaagagcatgatttaattattgttgaattaacaattaaaatgaatccctttggagggatggcattgaataacttataatttcagtgaatcatttacgttttcattggaagacagtatctgatttcaactggtgcgttacgaagtagagccattcccacaaagtaaatgtgcagtgcccatgtttcttgtgtttaaatattttttattttcactacatatatattattttctcatgtttatttactaatgtaattttcacttaaaattagatgtttattttcaaattttaaaagctagtgctcttaaaagagctaaattatatttctggaagcaggagtttagtataaatgtaataaaattttaaaataaaattgacttccctacttaatcttgggtttgtgggtgagtttgtttttagtacactcttattggtggttttgcctgaagagtaatacattattattattacttttctttttgagacagggtctcactctgtcactcaggctggagtgcagtgacacgatcatggctcactgcaatcttgacctttctcggcatggatgatcctctcacctcagcctcttgaatagctgggaccacagacatgtgccaccaagcccagttaattttagaattttttttgtagagacaggatcttgccatgttgcctagactggtctcaaactcctgggctcaaacaatctgtctgcctcagccttctaaagtgctgagattacaggtgtgaggtactgcacctggcaatacgttattttaaaagtaaacgctaagccatttatgactttggttatattcagtcagttggatttagtaactaataactagctttcttccattctaaggtacttttatagtttctagcaattagtttgttacaattagcttatatcagatataacagttcttaatataatgtttataaaaggttttaagtctgttgcctgatttttaaatttatatctagttaacattttaattttaaaattgccaacttttgggagatttcacatattttacctctatattttatttttccaggattggtatggaggagtagtaccttctattcttggtttatttttatttgctagacataatttcttaactacatatgtaagtataaattcataaaaatcacactgaaagaataggttgatttcaaccattttgagggtactggtaggtaacacactgttggggaataaactaaagaatttctgatttctacaatagatttaagtatgaaatttgagtatactgtgtagctgtgtagatcaacttaatgcttaaaaaattacctccttaatgattagattaatagaacagtgttagattatcaagggaagagtttggaatgtaaacataaacatgctgcataggtggtggttatttgtgagtaggactacttttaaatggtactagtaaagatttatcaaacaatgctgctattatgttgctatatttttaataaaatgaaaatcttaaaatcttgccactgttgagtagtaatt

SEQ ID NO: 115660 - DNA, 1059 bp, Homo sapiens
ctgaggtaaagcgaagttcatgagccgagactgagctgagctgtccaaattggtttcagctgatggcctttgttagtggagtttgaattcctgctatctgtcttgttatttttttcattttctttccaaattcatttctggagcttggggcctcaaaaataacaagttgttaaaatgactgagtatgctgtctggctccaccgagcccaacctcccccactatgtgtcctaagcaggactgtgagtcctcattttccagatcaagctcaatggagcagtggcggggaaccaggtctgttgatcctcgctcagctgggggaggagggtgaggcaggtggggaggagggacatcaaggttgggagggcaagaatgtggaggtaaaatggtgagtcagaggcaggtggagatgctggcaaatcctggcttatgttccagagcgttctttagcaatcttaagatggaactgaaatctggaattaaagagtgaaagtctttcgtaacagaggcctctttgttctggctcagatcctcctggaccacagtcactcgaggaagcctaccccacacttacaaagacaagacctcgccacacagcatctgtcctcttcaagatctgcccccaccaagatgtgtctccagaccaaaaccacagtcagattgaagcacaggccagtgcagaggaaatactgaacacagaggaaaaaatggcaaggccctaaatagtaggttcagcaggccccagggggccgagtgtggaagtggatcttgagggcttggaactggtgttggggagaatagaagggtgggaaggtgagaatttactcacatggaagccctcccagcaaagacacctgggcccatcctcactggcgcccggttgctttcatagccgcggacacaacttgggcccacagttaacgaggaggaaggcagagcgtgctgagcagagcaccaaggaagagagctcggctagccgggaaggtccgaatggatttatttggtgaggccaaggaacccactgcctccacggtgttcctccaggaggctcctcccttcac

SEQ ID NO: 115661 - DNA, 1394 bp, Homo sapiens
ttcctaaagaggaaagggtcactaccaaagaacgaaggcttttaccctttccactctggtctgaagtactccagggaatgtcaaatacttaacattttgccagtgttttagagcctgtgacaaaggctatccactcagacctagtggatacagtgcaggagtccaggcggatttttttttttttctagtttggctttgtaaggaaggtcatggaagtggggtataaagatgataaactggaaaaagaatcctcataggacgtgtcccacagtgagaagggtccatgacctggtggcttggccttagaaaaagctgagtgggggctagggggtgtgcatcttagaagagatgattgtgtgttttagatgaaaaccaccctgcgtgttttctggttatgttcttacattctatagtgttgccagaaagggcttgcattcttctccttcattcctttagagctagcagccagtgtttccctgctttgaggtcagagtctgtagtgactaaggggacagactttggctaggttcttattgctgaggctgtttcctcatctgtaaaatgggcctgtagtttttattcctgagggtcattataaggattaatgagatgttttatggagagtacccagcatggtgtgtggtgcttagtaagcactccataatggtatttgctactattaccgagtgtggaaaagctggtttatgcagggtattggtaccatcagcaccataggcaggtacataataagcaagaaacctacaagtcccttgcctgatggattatgcttctagcatattttgttggtagtcctggcaggctttcattcatgagtaggtagatatgtaacagttatcccttttaatttcatgggcagagcattcattatgaggtactaacagcaaagctttattgtatatgattcattaacccttctgttaagacaccgtttctcttttgctcatggaacctgttcttagtgatcagttattaaataatatcctgcaagattttatgaacatgtaaattactagctgcacccagagatttagtcagaaggcagtgtgtcagccatgtcctggggctagtgacatgaccatgtacttcatttcagcttcctagaataatgatttgggggatgagaaaggagtaggaaggaaatcaggtgattatctggaagtcaaccttggttcatataagcatgaaagatggtgcaaggcagatggtatgcagccatcccaacttctcagaggggaaatctgttaggaatgcaatagaactttcaaaaatacaagaactcctgtatgcagattacctaacacaaattctgttttgtctccttggaacagtataaacattttggtttttaagacaaaaatgcaaataacctagta

SEQ ID NO: 115662 - DNA, 1039 bp, Homo sapiens
ggcctctgccttagaacttggctagctcctttttttgataagctgagaatttaggtgtgttcctttctggctggtgattttgtgcctctttgtgtttgtctaacaaaaataatctcagacttccttcttaacatttttcttttcaggcatttctccatacagagatagatgtacttgctgcaatgcaggaagggcctcagggcctcatcagtggtagggaaactaagtcaaattgggttaaaattggaggttaaactattaggtcggtgtacacagtcactgagactgacattcacaaaatcctcacatttgaaattacttcttagggcagtcatagccagcgaaattgcattatggtattgaaatggaatgaagttgtgatgaaatctattttgtgtataaaagttcaacaactaatttcacaaattagtttatgaaataaattagttccctataagcatatctacctcctacataagacaaactcacaaaatttgctttttactcacatacttttagctggagtggcttgattgaaataacctgagccctcacctaggcttcatttgaagagtggctctgaggatacttagatgcagccaagaagaggaggggaggattgctctggaggaaaactcaggcccagagaaagaaatacagaaaggttttacttcaagaggagagtttcagacatcctaaatgagcagaatatatacctgcaaaacccaagaaaatgttgactttcccgtcctcatggctcttagcagactggtaagtagaagcgccctgttaagtctatgcaacctgagtttgaaaattgagggtgcctgagcaggagagcgaatgagaggaaaattacttgtcaagtaagactgtccctttgccttatattttggtactttactgttcaaaatactacattggtaaattttaattcacatacttttttctttccttggaattacttggttatttgttctacagtcagtgaccaagtctccctaattggctaccctggtttattgttgcttggggagtg

SEQ ID NO: 115663 - DNA, 1058 bp, Homo sapiens
tcccagccacgttgtggctctggggagcctcttgaagacatggccatgacctttctttgtctttaggacatcttcattggatgcccaagactccttcacaaatgggggcaaataattttaacacaaagctaaatgtctcctactgcttttcagctcatttctaacaggagatgccagtgaaggctcagaatttaagagacaaagtggtcacttcagaaaatccatcagaatgcctttaaaaataaaccaagtgctattactagaaatagttacagccaagggccctttgtccataacattttttttctttgtgtaacagaatttctttctgcaacatgttctcatttgcatgttctgtctcctgcttaccagcagactttaagactttaaattctctcatggtttttctttgagtttaaactcagatagtgggatagctcctgtagatgaggctttaaataattgccacatgtccttgttccagcggcgaccttacactcaagtgtgtgtttttaggggcctctttgtttttggaactcagacccacagagtttgtggacggatgtctgcatcatttcaatgtttttatttattatgctgcaagctgctggttttctctcctcttctctgcttcctctttctgtcctcctctcatgagagggttaatgctgcattgtggagttagtgcaatttgttcttctaagagatggcaaaggccccatcaaagtagtctatagtcaagttctagcaatgacagtgattccttcagagcctctcttgatatctctttagggatcttctgtggtgtttaaaaggaaggtgaaatatgggttttaaaaaatgataaagacagtcttaccagttgatttcataatgagaggtgtaagccattgctgggatacatcggaaggtgctcgctttgtactcctgaaaaacctgtaatcagatgggcactgtcttgaattgttaaaatactgttacctgcagtttttagaaatttattttgacatttaaggacatctgaaggtgtatatttaattactactgctgctttcttt

SEQ ID NO: 115664 - DNA, 1068 bp, Homo sapiens
ttagaatggtagggagctcaaaagtggaggattgtgacttcagttgtggcttaatcagcccaagcaggtgcattctaagtaaaagagatacggttttaatgcaactgtcccccctaattcagagaaagggagacaagtataggaaatgacacagcagttaagtcagaattgtttctaaatagattgttttttttttccctgaattctctgagcaccagcagcagtgtcttgttaaagtgaagagagatataaatgaagaggagttgaggatgactgtgttaattttttgttctgagggatcagaaatacttaagaaaaatgaagtcggagatttacataaataggtgggagcctcagtagtgtcatgttcatttgagagtagaatttgattctggggacctcaaataacagaagatgattatattcaaaatgtccaaggcactactgtaaggcaacttaaatggcatgtgccttaacagggtggctttgtagtgaggttctggaatttttctcattcttttgtctcgcagtgtgctattgtatgagtagcagtgagaaaatgtttggatagcatgtctaagaaccagagcatgcagagaaaacagggcttttattctactttgcatcttagttaatttggtttttagagaagcacactattttgacttgaaaggcattagccatatcttcttatttacttgagtggtggttacaagagtattctatatttatttattacactttgctcttatgttttaggtattttttgcatatttcacaataaaaatggttaaaaaaagtcactagtgtattctagacctttcaagtcaaccataccaatttattcattcctccgtctacccaacaaatactaattgagcacctactgtgcatcgggtactgttactggcactgggaatacagtaatgaacaaagcaagcaaaagtccctggtctcatggggtttatattgcatggaggggaggcagataatatgtcaggcaatgggttagagcaggagttgacagtcgtcttctatagagggccaaatagtaaatacttcaggctt

SEQ ID NO: 115665 - DNA, 1111 bp, Homo sapiens
caatggaatattattctgcctttaaaaagaaggaaatcctatttgcaacaacatgggtggagccagaggacattatgctaagcaaaatgagacacagaaagaaatattgcatgatataacttaacatagaatctaaaatataaataatctaaaatctaaaatgtatagaagcagagaggagagtggttatgggatgatattagtcaaagggtacaaagtttcagttaacggtagatgaagttctgaagatctaatgtacagcatgtcgaagataatattttattatatacttagaatttgctaaaagggtagatcttaaatcttctcatatacacacgtgcacaaatgataactgtaggggtaatagagatgcatttcacaatgtatatgttttccaaagcatcaagttgtaccccttaaatacacagttttcatgttcacaatatctaaatagagctgttaagaaaaatcatgggttccatgcactactgatggttctcactgtatatcttggagaaggtgcaatactcttccgctgcactgttagtacatttaagtaacatgtaaaatacagcaccaataagcaatttaggacagtaatatctgcttaaaatgttctgtaaattctcagctagaacatttgcaaattgtttcccaaatgcattgcaaatttatgacagttaaagtgcagtaatgatttaaagactgtaagcagtgtttcctgtatcttataagacaaatgctttagttttacctttatctcattagagagttatatgtcagtgctgaaaatgccatgctgtaaggtataaaaggtataaaatcctttcaaggggtgagggttgagatttctgttaaacacctaagtggagatgtgaggaaaaaagttggataaaagcctggaagtcaggaagggacacctaagcgagggatgtttggggagtctgctggtagggaaagctgtgggaccaatgggatcattgggatagttagcagtgcccaaggcacttcatgacttacaggtcaggaagatacgaagcaactagcaaaggatactaagtcaaatggccaaagataggaggtttgtattagtttgttctaatgctgctaa

SEQ ID NO: 115666 - DNA, 1052 bp, Homo sapiens
tttttgagacagggtctctgtcacccaggctgaagtgcggtggtatgatctcggctcattgcaactttgcctcatgggtacaagcaattcttgtgcctcagcctcctgagtagctgggactatgggaatgtgctaccatgcctggctaattttttgtattttatttttagtagagacagaatttcgctatgttggctagctggtcttgaactcctggcctcaaatgatctgcctgcctcagcctcccaaagtgctgggattacaggcgtgagccaccgtacctggtctcatgatgtattttaaaaatgtattttcttgttcctccactaaaaaggcttagaaataatgttcagtccagtggcagtgagcatccctagtgctcagattgtggtctctaaatattacttcccagcaagaggaactaggctttctgggagaaatggctgattccagctctggagtggaaaatataaatgatgaatcagaaacagcttgtcaaaccagaaaacaaggaagctgtcaaagactagtgaggttgtattcaaaaggattcaggagtctctcattagctataaatgtgacagtttggagatcaataaaaataacaactatagagggttgaaacacattcagtatattaaaatctataacttcaaaattataccaaaaaaacctagttagtcacctttgaaggattggcttgttactttgaaaatgataaataggaaaaaataaccaatctgcctttccagtcggaattgcacctccggatgatgaatagttaataattttctctttatagaagtattttagctaataaatgaagaattgatacatttagaatattaccgttttgcacaccctaataaaataatggattcaggcaatgatcattaataactcctaatatcacacggagacaactagacattatgtatttcctgatggaagtagacagcaccacctaggatatattcttgaaaaaaaattgaatctaattctgttcaagtctctagatctaactgccaatttataagaaatatagtggaaag

SEQ ID NO: 115667 - DNA, 1049 bp, Homo sapiens
acttgatatgatgtctggggaagtgggcaaggacagaggaaacaagaatgactgccgatttgtaatggaagctggatttctctacttgaagttgtttcttttaaaagtgactcttattctcacccccatcaagaatagctaggtataattatgatgtcattactcatgattatacacactgagaatactcagctctgagactattcaaacaaaattggtggctgagcattttgtcaaatattggttctgaattgtgtattgcactctcttacaacacctggtgtttttcctctgggagtttaggatgggcgtgatgttaataataccctggactgttatttgctgtggtttctatgttgttatttcttatatagctggaaagctgggaagaaggggtgccatgccatgagtgtaaattgaaccataccttttgaacataaaccatcatgtaaatacgaatttcagaacatggaccgtttaatttctctttgaatggactgaatgtttaaaaaatatatatggctgacacgctcagatctgtattctagggtagaaatgttttttgcttgtcagttatctgacattatagaattaaacataaaagctacttgcaggataaacttagaaaaaatccgcttgatatgtttgtgtttgcctcccataaaatgtcgggaaccatattttctcagaagaagggactatttggacttccaggagtgctgacttcaggaaatctgtgcggagcttcccttattattgagttgaagctcagtaatatctgttgaagctattgctgtgtccctgtgatatgaaagagactattataatgcccacatttgtcttctatttaaacatttttggttttcagcattactgtcacatgtaagttcaaggtagcaaaaagaattaaaagagccacagtttaaaactgaaagtaaacaaaatcaatatttgagaggattttagtgagagtgtttttcagtaatttattgttgtgcagaggacagataccccatattgcatcaccttcagaccaggcctcaggctgt

SEQ ID NO: 115668 - DNA, 1068 bp, Homo sapiens
ccttgagtacgacatcaaaacattttttttcgttttcattgcaaaatatctaagaagttgtttttaccaagtgacagtgggtattgaataaaaaatcaataatgtataaaggaggttcaaagttattacccaaggttttatataaataaaccaaatctaaaaaattttatccagaattatctgcattatttcaaataaggaaaaaaaatagaagttaaaatgtcctaaataatctaactgtggtgtaagtggtttgtagtttgattgaagacttagtattggtataatcaaacaaaattcctgtggtatgggagtgatgtggggttcccagctccagaacatagcacaggaagtaaatgctcaattatatactcacacctggccagctcctgcctcttttgccactggcaggccataaatgcttcttgagaatttactataccattcacttttcatgcctctactcttattgccttaaacatagaggaaaatatctggattttttagttgaactttagaaatatagagggaaaggtgggaattaaacctaattctaactatctgtaccttaattacttctgataagtcatttacattattgatgctctacaacttgagggaaattcctgacttcatctgagtggttaatgtaggcctgtgtgtgttaggtaatgtgtgtgtgtgtgtgtgtgtgtgtgtgtgtgtgtgtgtgtgtgtgtgtgagagagagagagagagagagatttagtatttcctctttattttcaggctttgtggcaatgtggtaatttaggccataatatataaaaaaaaatcacaattctgaagctgctttttgctatagataccagtcattttagggaagctttactcagttatttttactggagttttctgtgctatgattagaacaagaagatttgggaaagtttaacttggcatggcaaagaaggagctgagcagaaaaatatttggtgaaaaaagaatcaagtgaacaggatgctcaagagtgaagttcgacagaagcaggaaaataaaacagggcgcctgtgttacgtctcttccata

SEQ ID NO: 115669 - DNA, 1051 bp, Homo sapiens
tctaggctcagcttggctggtggctctgcttcaagctgtggtctggccaaacttgtctccttgctctggcttgggctcatatctgcttcatatatgatccttctcgggtgccccaggatgaaagagcagagactactaggaagcatttctcatggtgatataagcctacctggctctatggaagaaaagatacagcctgatttgtagcatttgcccatttctgtggagtaaatactcccaccacagccaatttcaagccaccgatatgacatcactggaaagaacagcacagtagcatatcattgtataatatttttcatcatacagctaaaatagacaacctcaaaagcataagtaatagtataatgtaacataagttatgaattttgagtatcattgttttgctataatttaattataagctactgtaatttttattagtatgtttagccaactgccatgtaagttcctgaaaatttaatgagcatcatgagctggtgcaaactggctccagtatatcagtgggttagcccaaatacacacatggaatactctaatacagcagtactccagaacatcactgggttaacacaaatacataacatggaatactccactttaatacatcagtattctaatacatcactgggttaacccaaatacatgtggtaaaacctaggctccaaactggcacattgtcacttctgttcatatcccgttgatcaaaacaagtctcatggcagagctcaaagtaactggatgggcaagcacgctctgactctaggaggaggaactgcagtcacatggcaaagggtgtggctacatggagggtgaagaattggggccagtgattcagtgaattactgctgttacatacttgccgtgtcacatagtagagcaaaatctatattatgttaactgcacttaatcccatctttgaagtgtttacatcatactgctgtgggagtacccatggctataagttctgttagcagatttgattgagaatctttttttttttgaaaaaagtacgtctcatacagtgtaatag

SEQ ID NO: 115670 - DNA, 1055 bp, Homo sapiens
catctaatagaaataagcatgaaaccactttggtgtctcttcttttcaaggactgctgtttttccataaaatgtgtaagcccacagtttgatactgaagcccctataattcatgcagctgtgactttatcgttttaaatattactttcctataaattaatagtcctgagaaatgtgaggccatttaaaaatcacagcatgcaaatgaaattttggaataaacttttggcatagctagtaaaggggccaggtgagtaaacaggttgcctataatgaagtgttgccaatgctagggtaagaataagggttggtttgtgtgcaaccaggtagcagggcagtgactggggcttgactggcagcctgccagaaagaggcggcctctacagtgagagctgcaggatgaggaggcgtagccagatgcaaagggaaggaaagaggcgaacatcatgctttgggctaaggggaagagcatatgggggtcagaaaacagtgtggtcaaagggaagtttgaccatacctgtgtatgcctgtcttgcataattatgaatagcccctttttactcagaaaaatgaactgctttagaccatgagttatatatctagtctctctacccatgggtgaaatggaaacttgtacaaaggaatgatacaagaaaatgtatgggcgtttgattcattagttgctcttctttcagatggcccctcattcacacctagctaattactccatttagaaatagtaggttatacttaatacactactgtactgtaactgttggtatcttgttcctctgggagaaaccttctttgtcttgtttttctttttcatgagattcagtcgcattttaggatatgtgatgatgtttgctgcttattacatttctctcatctttttatgtggccagaactaggtccccaaatgctgctggcagaattattgagtgcagtgatatccacttagcaaccccagagtcatagttggtcgccaattctcacctagttaattctttgtccttgttgatgccgagttcctactccaccacttatggtcagtga

SEQ ID NO: 115671 - DNA, 1032 bp, Homo sapiens
tcattcctttggcatttctcctccctgttctctaacctctcttttagtttattgttctggagtaatgaaaaactgtctgagggtaaacactgccagatatccattttgcatttgctcaaagtttatgcctttgttcgtttattcaaaatgtggtcagcaacatttattgggcgcctactgagtgtcagggtactagtggtgatttaaaaaaatccctctctcctgcatctctgagactagtaagagagatagaaaaggaaatctaatgtgttgtctctgctatgcaaagggagcttgggatgcccagagcagagatgtgtgtttgaggaatgttcccgaagaagtgatgtttaaaccatgtctggaaaagtgagtagaaatgagccaggcacacttaaatggcagggtgactccagtagagagattagaatagcatctgcagaggtttggaggaggaggtggtgggcctggagatggatttggaaagcgtgaactttagggcagggttcttgtgatgtagctctctatcagaattgcccgatgaacttgttgaaaatgcagattcccgcatccaatccctccccctccccttaagatcagtttttctggcagtgggaccgggcatatctgattgtgaagtcaggaagagtttgagaatcttcttctataggaattggaagcattgaagaatctaaagctgcaagtgctgtgaccaggtgagatttttaggaagatttttctaatctaatttgctgcaacatggatgaacctggaggacattatgttaactgaaataagccaggcacagaaagacacatactgcatgatttcccttactcgtggaatctaaaaaagttgaactcacagaagcagagagtagaatgggagttgtctggggctggtgggggtgtgtatggggggaatggggagaagttggtcaaagggtacaaagttaggaaggataagttctgaagatctattgtaccacagtgactatagttaataattatgcttaaaaattgctaagtagat

SEQ ID NO: 115672 - DNA, 1015 bp, Homo sapiens
agattcataaactcaagttgggcttatttggggggtgggtgaccatgcctggagcatcagttaaggtgactggttactccagagaaggcaggaggacaggacagccagacagtctatcgtgtgtgtgtgctaactgcttacatgtgtacaaaggtgtccaggctttatttcacatcataaacacatgtgctccctgacctacatgagggcatctagcttagacaggcctgccgccactctctgggatgaagtttcacatagaagttataaggctgccccataggtcaagaccaagagtagtcgtgagtggccccacaccccagaaatggattagagtccacacctggctttgagtggttggtgcctgaactgcagaggcactgaggttaatatcatcagcattttcatgaatacaaattgtagtttacgtgccttcttgttcttatgaattctcaaagaacagtgtgaggaatcgcctagacgttaaatgttttcacacatgaaaggtgctgtgtcagtgctgctaacagtgaattgcgtcaacagctgagctgaagataaagatgggttcagttgaattagggctctggagtcagatctgctttgaatactgggcctactgtgtgcctagcgttataactgggaaaagaggacagtagtaaggactatccttagaactgttatgttagataatgcataaaagcatctactgtagtgcctggcaaagagtaaggagagaagtgagcattaggtattgttgccttagagagtgccgttggtagcaatctacttatctgaagaggtgaaggggtagggaacaaataactgcataagtaagtgaagcagaccattttttttccccttaagaaaaagaggtcttgctgtgttgcccagactgacctcaaactcctgggcttatatgatcctcagcctcctgagtagctgggactacaggcctatgccactgcaccccgcttcatctggattttaattcctcaaaggcccatctttgaga

SEQ ID NO: 115673 - DNA, 1082 bp, Homo sapiens
tcttttttatgttctattctcaaagagtactagttaataattcacatgcagttaccaattaagtagaaatttcatttgaagcgacagtaggttcaattaaatgcgtttggaaatcgggtgcctaaattgctctggaaggagtctgaatatttatgtatatatgcattgtgaatgtgggtagtaggtgcatatatgttttatacatacacatttgaataaaagtcagggttgaaaacctgcctaaagggctaattgccagtcacatgtctaattaatcacacatgtaaaatgtaacccttgctttgtgggctataagcagagagattttaattttcatcccagagttcctggaaagaataatgctagtaattttggggggcttacaatataaaagctggggaaagaggaagaggggtcactgtctcagtttagaagtgctgcagagagccagcagttgatggttattgagtcagcacctgctgctcagcgcttgtgggaggtaaaagggtgtgatgctgactgctacaattccagtaagttcttctggcataagagcaagaacaaatggctatggggttgggcatgagtatttataaaaagaatagctggccaggtggggtggctcatgcctataaccccagcactttgggaggccgaggcaggcagattgcttgagctcaggagttcaagaccagcctgggcaacatggcgaaactctgtctctacataaaatacaaaaattagctaggcgcggtggtgcacacttgtagtcccaactacttggggaggctgaggtgggaggattgcttgagactgggaggcagtggttgcagtgagctgagatcacaccactgcactccagcctgggtgacagagtgagaccttgtctcaaacaaaacaaaacaaaacaaaacaaaacaaaacaaaacaaaaccacacaccccaaaaacccccaaaaacccccaaaaagaatagcaaaacacacagtcaaatgagttcttcacagataatttggtgtattttaaaggatcagaatataaaagagctggaagaaattcatagggattaacaaaacgtttgca

SEQ ID NO: 115674 - DNA, 1034 bp, Homo sapiens
gcccttgtaggagttcagaagggggatgtcagtggctttacaaggaagtggccagatgggaccagaacctggacctatttgaagggtggacctgttaggattcattatggattaaatgcacatccttgtggctcccctcccctgacgaggtggctggcgtagcactgctagtgcattctccatccttcatgagtgtgttcctcatgtggggaggggagtagggggtaggaggctctcagcttctcaagaattcctttggcattttgagaaaggcttgattcccagcaaacagattcgggaagaagatgacgctgacatgataagagttcttaagttttaagcttactttgtgcagcatttatggcatgagcagcctgaaaaatgatgcctttaccaagtcatgtaaaagcagtaatattgaccatcttatatgtatgcatggatgatcattgtcataaaatcactttacattttgagtaatatctaggtttattagttgaatcggtgggagcatgggggtgtagggatagggaatgggagtagcaagatcagcactttctctccagagccagtgacccaacttctgcagggtgaactctatagggatgcagcaatggatgcagcagtggagtgttgttttttaacagctttattgggatatactttatacacataaaatgtgctcatcttgtgtgtaccattcaatgattttttagtaaacatacagagttgttgccctcatgctcatttacagtcactccctgttctctccagaagaatggttttgttattcttaggcatgtccaaggttcggaaatagtcattaagctagtatacaggagatcaaatcaggaggaaagaagtatgtttatctctgctccagtttgatctctttaggcaatcagaaaatgtgagctgccttggaaacacaaagatcataacattttgagtcacaaacttttataggaacctgaagcattaacacaacaaacaacattaccttgtccatgttttacataaagtataagagtgtt

SEQ ID NO: 115675 - DNA, 1142 bp, Homo sapiens
gggagatgcctatttctatggtttttaaaacatttcttctctaattttcttatgtaggcaaaggtcaaagtggatatttttactattataaattagtagctatgcctatattcataaagaaaggcctcctttggcacttttagttttgactgttttctagcaaattgtgggtgagtaccatatccaatgtattaattttgacatatggttacacctagtgcagtctcagccaggcagtcccttggggttacaaaggcatagagttaaatttcccaagttggaaaaaggctttcagaaatgagtttctcactccacttgaagtggctttgctactgtttccctggggaggttgctaggcatttaatagatctccatgttaggaaaataaattctttctagcattgaagtctaaggtgttgttcccccaccccttggcctcagatttgtgtggtggaggctgcagctaatctcccttatgtttatatttataaaacgtttccagatgattatctcttcctggtatcatttggctagtcccaggtattcattgtctcagtcattcccagttaggcatagccctgctcactgcctgagggaaggaaggaggccgtgggaccgctgggtctaagcctggttcctaccacctccccacagctgttagccttcctccatccctgagttctcactgggacatgagggactgcgtttcagctgtgacagtattttgttgctcttggccattgcacagtggcttacatcctgtgtgctttaaaaaaaaaatgtctctttcaaaggctcttttcagagtctatgggatgagatgcacagagacagactatatatatttaaaaccagtgggtttttttttcttttttttttcttttttttttgctttgctgagaaaaagcataagcaaatgagagggactctatttgaaggttttttttgtttgtttttttgtttttttgttttcaaagcaccttttacagcttgtctttcggtataaatgattaagttatgatgtcatcttgctccttagacacacggcttcttctacatgctggcatttttgtatggtgaagtctcttttggtgcctcctgaacctgaggaccccatgagtgcctgggccagttcaggtgcc

SEQ ID NO: 115676 - DNA, 1060 bp, Homo sapiens
aagcttgggcacagaagccagaatgtgattagtcatttactactagatagtgaaggtttaaaatttaacccttatctttccctttcccttcagagagttcattagttcctaattatagtctacagaaaactatttgcccctcaccttctgttgtattaagagcagcagccagaggagagctgccagacagacgaccatcttgatttctttattaatctgctgccatgtgcccagatttggatgccatatcacttattttgacgtgtcactcaagtacatgttagtgacctttcctgcttttggtaccacttgtcgaaccacacagctaaaggggcattaaagttgatctgtttcgtgtttctgcctcatttagattggattatatcaaaattatctctgccgattacaactaatagacctgagagagaattgtgctgaagaagtgggaatgtacaccttgtataattttttctttttccttcttctcttcagctttctcttttccttgtcttcaaacaaattgacatttgcggaggtgcgttgtgcagtagaacattcctcatgctgatgatcctctcctcctggcctctctgtctaccccttgcccctgtcgtagagctgtaagccatccttcccccgactccgcctgacatgtatcatggcacaccttcgtttttgttctttgtgtttatgtcgaatacctccctgctagactgcaagccccttgagggcagaattcttgtctgatttttactttctacttttcactgctctcaggacaatgccttgcacatagaaagcattcagtaaataatgttgaaggaataaataattatttatggaaaagtgacttttttttttagttgcaggttgagcacgatggtgtgattcttcatgctgtaatgggtgacctaataagaccatccatctaaaatctctatggctttgctgtccagtgtgcatcttacagttgtgattggccttaaagtctatgatacaggctaaatcccattgagtttcacatcagccactcaaaaaatatggtgacaaaatttgtgaa

SEQ ID NO: 115677 - DNA, 1056 bp, Homo sapiens
tgagaggtattaatatgttagtaagatataaatgaaggccctgaggtttggtaggtatgaattttagtaaatgcatgacctttagtgatttaaatgccataggcaagcttgaaggtattgctaactaccttctcaaggaggagattaattcctagcctgaagtatctagttttccttggctatgctaaatatagttgtgttccctttcccagacacattgggcatttcagataaatggcatgttgccagttcatcctaagtagcctggtagctggcagaatacatgctcagccagtgtccgcctgctgggacaccagccgggagtgctgatgaagtgtcagatgtatacttcatatacattaatctgaagaggggaaaactcattttcccatttgcttcttccatctttctgtccctccccacacacatgggtagtttatcacagaagtcatagtcgtcaaaagccaggggatttatacagatgctgctttctggcaagaaagatggaaatttcaggaggcaaaagcaggaccagtggcaacttatttctttgtaggaaaataagggtgtaagccttgatgatggaagtttaaaatggctacgtggccatcatcagaaatattcactccatttgtacttgggagtaatagatagatggcagaagcaccatgaacattagtttctggtatttttctccaattttctggttggttggaatcctgtgcctcatcttttttgtgtgaaggtttcattcacattcttcccattgaggttttccttgaccatcctgtttcaaactgttccctatattgcttgccacatatttcatttccttcattcatttttcgccatagcttatcactgtccagtataccatatcgtttgcttattttattatatatctcttactactctaatgtaaatttcatgaaggcagagataattctgttttccaagctgtctcctcagtgcctagaatagtgcctggcacatagtagggtgctcagtgaacttgttgaatgcataaacatatgtctcctttctgtacattttcag

SEQ ID NO: 115678 - DNA, 1052 bp, Homo sapiens
gtatataagtgatatttttctttgtgaaagaatctaatcattagccattgttaaactcttatatattattttgatattaaaaaaaatgcttggaatacagaatatacagcacatttagaaatgtttccttaatattaagtctttgaatttcagctggtctagctgtctgctttttgttctaagtatcaattattaatactaatattcatattactataatattaatataggcaacgaaaggattatttgcagctaaacaaaagagggattagagaagttggggttacataccatctattgttcaaacctaagtaaacagactacctccttaatgaatttcagtgtggtcattgtttttgaatgcacagtgtggttagtcactgctgtggatttccttttctttgttttcatcacctctataaagttctggtaatgcacagctgtttgtgtccacgtcctctttggggtcagttgttaaatatggaaaggctctttgttaaaaagatgattaactctgttaaactctgaatagttcagattattagtgactggatagtaattcttctgtgagttttctctttcctttaattcattttaaatgatctgaaaatgtttttcagaagaaattccttttttaagtttttgttatttctgtaatatgtctgttatcacaacttcagaggagatagttgaagcatatagtgcttgtgaggggcatggttttcatgggcctttaattttagaaataaaggaatcattatttttcattaattaaaataatggagctattttctatttaaaatatttgctacaaaacaaaggaatacttgctaatatattattagagtgctaggtttttattgtacttaatatactttttctacacctgccgtcctctgtataatggataaggaatattttctcttctggatgagataagtcttcatgctgtgaaaaataacaacataaaagtgcttgaaagttctgccacttcatggttacaactttactgtggcttaatacaaaacctattttgcttttactcccattgc

SEQ ID NO: 115679 - DNA, 1008 bp, Homo sapiens
cacatacccttggaggaggtgctgctgtcctcagtttttagagaagaaaactggagagttacctgacctttagtgaattcatagaattaataagtgacagagtctagcttcaaacttagatacctggattgaaatccagagagtttggccgcattcttaatggtcttacccttttttgcctctctgaagcaggccagactgatggcccaacttacagttatcatccactgtgacaagttcagtagaagttgtatctgggataacacggaagctcagagatgggtgtggttagggtatctatgcgaaggtggttagtttggtagaaaaattgtgatgagttccacatatccatacttctccaatagccttgaggagctaaagctatgatgtatttttttcaattgtaggcttagagagggatattagttcttgatattttatccatgagaggcaggatgagataatgtccattatactaagaggcaggctttcctggtctatggaggtacagctagtttgttgctatagattaatgacttgagtcctggagaaaatagagttaatccatgactgtaaattataaagtatgtaattctatcagaagaggtatgttatggtataaaatttctggaacattctcttgaaggctgaattccataaattagttggtatatggagagtcaggctggtaaacagaaaaatgaataaggccagaaaaaggagatttaaaattttagttgctgtttaagttaattttagttcttgtaagataggatgaaagacatctaaggggctcatggaggtaaaatggtgtctggaacatttattaattttattatggaaaataattttgagttgtatataatttgcctataactttgtatgacttaactaaattcagatcttcctgcattagaacgtgtggtttcctggtggtgtctacctccctggcactcatttctccagtgccttctttatcagcccccttttttccatttgggaaagatt

SEQ ID NO: 115680 - DNA, 1044 bp, Homo sapiens
ctcaaactcctgggctcaagcggatctgctttcctcgacctccaaaaaggctgatattacaggtatgagccaccgtgcctggcctattaactccattttatagaagaggaaaccgaggctcagagatgtttgacaaattccctggacaccgtaacgcttgtctgtgtggatacaaatctgtatctccttggcttcacaatttgtaccatggtctggccctttcttaccgcaaaatgattttgagggagaagttgggctggatttttgcacaactgaaattcatttagactgtacttttggctacatttttcccccaaattagaaacacagataaatcttttgtatagaaaataccattgcaatgcaagttctcggagctccattgtgtcagtgggtttaagtaagttacagagatagttgtcagtaatcttcaaaggatatcctaatgaaatgtaaactatcttccctccctaaatagaattctcattatattccctttggtgcgtgaagaaagagggatgcagaaaatatgatgagctgaggaggaagactgtaggatcctgtttgaaagtggaaaacagaaatgacatactcttctcaacagtgtcatagtggatggtacaccctggtcaaagcccagagtgagtcttaagaggagggtggttaataaatcaagtccctttgtgattttcctcccatatattctggtttctattccttagttcatggccttgtgccatgactggtagagtcaagttattgcttctaatgaaagtgaacttttgttcaagtcatgttagttaaagtggattctattaatgggaagaaaatagaggcatgttcgaaaagcctgcataaccagtgtgataatttaatctacccggagtaagtgtaactggtctagtcataggtttaataggtcccgtgtgtgtgtctgtgtgtaggtcactgaaaaatcatttccccatatctttgttttctatttattctaaatgatcatatttctttatgtaggatgcttaggattctgtggaaaagctgatg

SEQ ID NO: 115681 - DNA, 1013 bp, Homo sapiens
tgcgatgcaggcctccctgactcccgattgtgtggtgtaggtgtcagctgcacttgcagacagagcactaaggcctgatcccaggtaggaccttgatggtttggatgggaaaatgtgggagatcagagacatggttagctttcacctggaacttaaatggagaaatccttttgtatagtagttactggaagttttaagttgatttatttactgtttccacttgaacagaaagaaaagtgagatattggtctcagttttgaagagttattaattgccctcacatgtgccagtcaatgtcagtgctgtctggaggaaaagattagaagttcctgtgtgttgcctttatcaggaagacacatactgactgattgccttcctgattttaaatctgattttgcttatatctgattttgagtcaaatactgtgcatttgcacaaagacagcccttatgcccatattactgtaggaagatctttggattgtgctttttattaaattagactgtcctcttgttttaaatattgacctggacaagaattatggtgatatggctatatgtccagctgttaaatgcagtctttaaaataatttgaaaaggttgtgaaatgctgaataacatagagaatgatataacaaacacctctctatctgacatctaaaattaaagtttacattttgtcatttttcttcagagagtactctttataaaagcaattggatattataaaaagaagaaaacttaaaacataaaggaaatgtaacaggaccgaaaacccctcctcagtcttttgttcccttctctgccctccctcccagaagcaaacactgtcatagatttgatatgcacatttctagtttgtgtttttattctgtcatgtacgttttggaactttttttccccactcagaatagatttttagatatctacattgattcatacaggtttagttcattcattttaagtgctggttactatttcatctcatgaatataccacagtttatcctttccc

SEQ ID NO: 115682 - DNA, 1079 bp, Homo sapiens
aatgtgttttgagatttttaaattttattttatagatactccctttccattacctcacatacctttatctatttcctgcctgaaaaagagatttgcctctgatgcgcccaagtgtggttttccttgaatttatcctgcctaggatttgctgagcctctagggtatgtggattaatgattttcatcaaatttggggatgtccttggacattatctacttaaatacatctttaaaccactttcttttctctcctgggaccccatttatatctatattaggaagtttaatattgtcccacagatcttaggcgttctttatatttttgttttgtttttgcttttttttcttggcaattcatttgggataatttctattattttgacttaactgtactgatcatttattttgctttactctgccagttagtaagcccatttcattgttagtaagcccatttcattctaatatattcttcaggctagatttttcttttttgtttttataatacaatctctctgctaaaaattcccacatcttctttatgttgccatacatttgccactgtatcctttagcatactttttagtctgtctgataacaccagcatcttgactacctctgtatctgtgtgtcttctcttggccatgggtcataacaatatccaaacctagctcaagcagggagcagaatgactcagcaccctactacagtgtatgacgcagaagaggcatacctttttctgaagctaagtagtatttatctcagcatcagtttctaccgagatttaaaatgtttagcacctacttgaaaaattaccgatacaagaagaagcaaaaactcctatttctgagatttcctttaccacttaggaggtagactatgaccagggaccattgctctcactcctacagtcaaaataacctgggtaagtaataaaaatcatagtttaaaaaatcataaaatatgctaaggacataaataaaccttgaaaatgtaaattccagaaatgggcaaactcttcaaaggaaagaagaggcccatggtttctctcacccctggtggattggcaggaggaggagg

SEQ ID NO: 115683 - DNA, 1090 bp, Homo sapiens
aagtttctttatttgagaaaatgggatctttagtgaaaaaagaataatgacataagtttgtttggagcctatcctttggaaacatagtaagagaaagtctgaattacatcagagccatttaaactcccctccctattaaaagtcaattgagcattcagaagatgagcatgaagcacactgtatatgtatatgtgaacacacatctgcttttttagtgaattctgggaaaattaatactttcaagtgaggtaaaccaaaaataaacatgctattttgtattttctattaagcacaaatattccccagagaattaatgatgcctcatatagctgtgctagaacccagtgtcactcagcatttttagtgaatactgtacagaatgccagtaattactctcctcatgcaaggttcttttatgactttgagaaagggaaaatactttttaaaataaatgctagagtgattttatacaaatctaatgaagaaaggcacaaatatatctttattagtatcagttagccaacataatagtacctgagaattaaacctgttaacactctcttagtttatttactgcatacatgcctcctccataaatgctttgaaatctttttatatcttctctcagaaagattggggtttgcttctgctgttcttttcagtctttttgttgttgttccatattaacagtaagcaactgcacatagcgtgatgtatttcttattgtctttggttatacagcaatgtgatccaacttgttagagagtgtgtaccttgataaaggctgaaaagccctctattttgatatatctgctgcttcagattgtatgtcttgaaagatagtagctttaaaattgcattttcagcattctgaaacttacggggttttccaaatttttttgaaaaatttgaatattgctttaactaagcttaaaggtaacttttatatccagaatcatggtaaaaacatacattaaattgaaagctttcagaagtgaaagaccacaggaaatttttttgttattagttgaaagtataaaaaagcaaactattctgtctagaaaaagaaattcacatccccactaattta

SEQ ID NO: 115684 - DNA, 1154 bp, Homo sapiens
attcgttcagtcagatgggggacttagaattttatatttggttgacatgtttttatgatttttctccattcaccctttcattattcctctgagagtggttggagtctattagggctggccttggaataagtgggctagttatctactggcatttgatagtttcaggtctgctaggaggtcaatcccctctgaccgcaaaggggatttccatcttaaacacatctaccacatgtcaaacattccagtattagaaattcattctgctggatcttggagatgtctttggtacctcactgaaatgtatgtacctttggtcagggcaggttgtcgcccaaactaaatttagcacagcagaagacaattcattaatgggatgcttctggtgaagtggcaagaaacaaggctagcagaaagttgagcaggtattgagaaccattttaccatatgactacattaataaatgtatgaaaagaataatgaacttattttaccactttctaattttgcctttcttggttaggcacagtaaagggtgtccagagatgagatggaagatgagagtgaccaacagagggagaaaatattgtcaaaaagtagttaggactacaaagcaggggaacttgatggtagcttctgggaggagctgggcctgctagacttctgaggtagagtttgtcttatagtagatgtatttgttggagaactttttccttagttcaactaaaactcggcttttatcacacgaccaggaaagattaagcttgtggacatatagaagggtggggaaaatggaatttacttggtgaaaaggaaaaataactctcagcaaagcgagagagagagagagagagagagagagagagagagagagagagagagagtcctgctaggaggtttcccacttcacagatagaatcccaggtcaccacacaggaacagaagaggccaggcttctccccattgcaaagggtgcaaacttcccgaggctttacctcatcctcccagggtgcaggtgggcattactcagaaagaatcagtggggaaagggtgggcttcatccaggatcagcagttcggtatttcagcctccaggctgttttatgcttgaaagtaggatttcgccagggacccttggctgtctcctgtctcaatcat

SEQ ID NO: 115685 - DNA, 1065 bp, Homo sapiens
tgttaacgacacggcaacaaaatttttaaaaatgtattaagtattcatatatccctgaatttttttttttcagattgcagtttgaggaagactggcatagcatatactaagagtaagaattggtgcagattacttttagtggattaactgcataaacctaagctttgcattttttggtatttggctttggctgtctctttttctaaacccagccttgctcttagctgtgtcatctgctacaggtaaactaacctggcagcaaagggggaattcaaagggtggggtggcagagaatgttgtcaaaccatgagctctgatgagtaaaaaggtctctgccgtcagtggtaacatggtactctttactgggtgattctataatttctgtaaatatgtttcccaaagacatatgcatttgaaagtgataattactatagttaggatcacgtccacagtgttttttcagtaggtaaggatgtcttccaatctagttctgccacttagtagctgtatgactttgcctctgctaaaatgggaattgtggaaataggaccaatctgaggctttcgtgagagagtgtatcaaaaatgcttttcacagttcttggcttacacttggcaccagtggatgtttgctcactcctaatgccactaccagtactacaagaaaaatattcccagtaacgattctttgaattcatttaacatgcagagaatacaagtaaaggtctgagacaggcatccccatttctcaacttgcggttagtcgttagattttgatactatgtggtatgatgtttttagcgtagaaggtggtgtattatcattagcttttttatgagagtaattaccatcttctagggtacctatggaggccaattatattggaaccttgcaacctcattactaccctctgaatctgaccttttgcccttttccaacctggttatccctcctttaaattccctcagctgtcgttctagtgtgtcctttcttccctttctgtcccggagaagcctgagggaagcctgtcagctcagtactcagtgtcccacttattgccaaagca

SEQ ID NO: 115686 - DNA, 1049 bp, Homo sapiens
attttttttaagcaagcattgagtacagggaagtttcaggagcctaaatagatcttttcgttatcccatgtactctatagcatacagttgaaatctatttatataaaattaagatagtagcaaatttcaacaggctcatttgtttaatggaacagcttggtgaatgcctttctccaacttttgtgtttaagcaagaattattactaatagtacttaaaactttttagtatttatttgaataattttattatctcttcaggaacactaggatatcaattacagtgctgggaaatgtgtgttcagcgaaaaaaagtgctgccttttccctgtggtagcgttctgaaaggttttgaggctacacttgatgagcatgccttttttcccccaaagaatcaaagttagagcatgataaatgaaagaaatttcaaaatcattatgcaaggtgtgttttgtattcactggtcttctctgatgagtcaatttccatttttaaggaatctcaagcattcttataacaatcttgggtttgacatagaggttgagacttcttaaagtacaggtaaccatctccccgttctttgctctattgatttgttagagttgacgtgtaaaattcctagttttaaaacatttcgagggtattttctgattttgctatttttaaaaaatagtttacaattcctatttccttctgaatatctttggtgcagctatttgctttctgcatggccacatgagttgcattgcatctgtttctaaaataatgtgtttaattttccaccagtactgcaagttggtcctgaattgccttatatgataaacaaacgggtttgtaaagttgcttcaaaggtcaccatcttctaccctttggtggtggttctgagtacttttaaaataaaaatcttcaaagccatctttagatgatacccttgctttcaatcatgataatgaaattaaaaatgttattaaattggtagtaacttggctttaaattgaaagtatattagcataatagaaggctctagaacttctttctaaataagactttc

SEQ ID NO: 115687 - DNA, 1059 bp, Homo sapiens
cagatgtttgtctggagttcgttgcaattttgcttctagtagttttcctgcctttgggttctggtagtattcagaagtattactaacaacgcgttacaaatgacactcactgcaaggcacttgtcacggacagtggaaacattttatgatgcatttccttcgtctccagcttctctgaacagaaggtttggccattttagaaataaaaaatgaaacacttgactatgttagaactttttaccatggaatctaatgctggccactaaaaattgagtagagtaagggttttattttctaaatggaaaaaaataactatttgttctgtacataataccttgaaagctttcatgggatttgcaaagtataagagttgtttcttattttcagagaatttctattctagctgagatgataagaattaagagtatgggttgggaattgtgcattaacacttaatatagctgatgtatgtcatgggctgaatggtggccccaaagatatcaggttctaacctctgaaacctgtaaacattaccttacttaggaaaaaaggagtctttgcagatgtgattaatttaaggattttgagatggggggattatcctggattatctcaatagttcctaaattcaatcataagtgcccttgtgagagaggccaagggggatttggcccacagagaagccagaagatgcaaggagcagattctccctgagagcctcacagggagcctggcctattgacatcttgatttcagccctttgacactgatttcagatttctggcctccagactgggagaatatatctctattgttttaagccaacaagtttgctgtcatttgttacagctgctgcaggaagcaaatgcagtggtaaactgcattctcttgtttttcctgggaccctgaaatgacaaagtgaggacagtgtggtgagcactttcacgttcatgttacagaagaaggagcccaggagtaagggagcccagtgacttaaaccagcttttccaactctgagcccagtgcgcctttcactgtggccccctgcctcctcctagt

SEQ ID NO: 115688 - DNA, 1034 bp, Homo sapiens
aacgcggggatctctgcctggagagggaatgctttcacttcccaggggcccacaggcggagctgcctgagcccctcaggagctggggttttgtgtattgggtgacactttgaaaagtttatgccccgctaggggagggggtactgtttcaggtatttcttcgtccttgtggtttcctgggtaaccctgataaatgtgcttctcataggttttctccttttgaaatgtggataataagacatttccttgtgagaggtgggggagaaaaagggaaagaggaggagatactttgtctaagtctgtccctttgacctgatcatgtttatccatttcattcacccagtcattgaggcttctggtacttttcgttgagcccttcagatgttcctctctattaaatatttgacctttataagatgcagatgtacgatgcaaggatagcccaggttagctatttcatactatctgtggagaggcagatctacataactttgtcattttgatttttcaatggtttgctggcatttattactaatacaggagtgtccttttcattttgtaacgtatatttgatagaaaagatggggaaagaaaaagaattttaatgtcaagatgaagctcatgccacaagtgacaggcagttccaagagtttgctgacacttgtgttgagagactatgactttgaaggaggcatttctcaccacatttgtgtccagcacagaaaagtaagattgttgtacttttagaggggcacaccttttgagttgtgttaatactgattctttgttttccttcaaaacttgccttgcatgtacatgtgaacatgcatgagagcaactttgcagtcagataaacaggatgcaggctctcagatttggagcttcacaatctctatgcttcagtgttcaaagaacccaagaaaatggttcgttctttttggttatacctgtaactttttgtagtataaatgtggatatgtgatactttagaaaacttagtttttccttttgaagtttttcatggtttcttacatt

SEQ ID NO: 115689 - DNA, 1033 bp, Homo sapiens
aggtttgatttcaaagctttttaatagagaaactaacatgtttggaggggattcatggcccaacatttatggattttgttgggaagtctcaggtgtgtatttatcttaagtatatgttaaggctattagacaaaagtaattgtttgtgctttgctctgttttgtttttgccgtctagtcctagactgaatttcttaagattatcttagggattggactgggagggagtagttccgagtcccgaaggctatatatctccactttcagttccttttctttggctgcctaaagaggagcactaaagaggagtcaagtgattataaattcggccaaaagacagagaaaccaagagctggacgattaacctctgaaacatgggaagttaattacatttacaaatacttggaggggctatttatgagtcatgcatctctctgtgacccttttactgctttgggagcttgtggatgaggctgaatcactctctgaaacctgataacctgataacctagtttggctaagtttggcttctgtgaacagggtctgaggatttatcacatcacgtcattttttcatttgtatgccaaatatttattgagtaccttttatgtgaccagggctatgattatcacctgggaaacaaagatatgtatagcatgatccttttcttcaagtagctcaatctagtgggctttagacagtaatacaaagaattagagtaacatgcggtaactggtagatctgccaacatcagccgaggaggagggagggggaggatatctgtggagacagtttgatatagtctcatttaatcctcacaacaattctgtgaagaatatgttattatatttattatacagatgaaaaaattgaggattagagaaattacttaactgtccctaaatctcaccactagtgagtagtgaatttggataaaaactttactatcttatggccaaaagaaatacagctccaacaacattctaattactgaaaataatatttgtaaagcaagattttagtacctttttaat

SEQ ID NO: 115690 - DNA, 1047 bp, Homo sapiens
gtattctgctgtaatttcctcatcttaaagtatcacagtttatgatggtatttaaatgggtttgtgcttttaaattgaagctttacttatggtgtcgctctgcacagctgctgtcttccaggcctttgaatgattaacaccccatgcactcaggcttattttcctgagctttccctgtatgtattataaaatcctgcacattcacataagtgtatatgttatctacacatttcaaaatccatgccgatcttgtaataatgcatatagttcatcccttagaaaggacaaaaattctttctgattatggatggcaatacaatgggtatgccagaaaatatctgttgggagattttagagatgatttacttataggcttctttccttttaaaaaatgtaataattcgtcttgaaggtgctattgctaactgtttttaaggaggagatgactcgatggcactcaaatacaccttttcctttgagaaaattgctgtgtttagagaacgaaaaagtaactgctttgtaatacataaaacaattgcataagaatagactataaataatctacaacacacaaaggacacaaatattgtgtccagaattctctaaaccacacacacacagaaaaactttactggccatctcttagcttttggtgatacaatatgtgagctgtttttgaggaatagctgcccctacctaaggacggaatgaaagaagtcttccctttaggaactttgttaagggttaaagaaagtgtgtcttattactattaacctaggcctaagagttactcagatgtgtactgacacagggtttaccacttgtatcaggcaactaggtgttagttttgttttgttgagacaagtttattgagatacaatttacacatggtaaaatcatcctttttcaggtatgtagttcaataagttttaacaaagttatgtagctaacatacaaggaaagatatagagtatttctttctttcttttttcttttcttttttttttttttttgagacagactctcaccctgtcacccaggctggag

SEQ ID NO: 115691 - DNA, 1122 bp, Homo sapiens
agccaagttagtggacccagtgagttctattcatagacatcttggaagtccacagactccaggtcagaagttctctggtgtctccagtgggttaaacactagtagtggagtgaaaggctgacccaggtggcctctggagtttgttatgaaacttgattatcaggggcctggcataattgaggggatgttatacaaaaaaagtaacctttgatttacctggtcagcactccagtcagaaaagtgctggctttcatcagttatgtttagctagcatgtagctaggaaagcccggagtatattaaaacaaagaagaactataggaaaggagtagagtaattatcacccacatcatgtgcctctggagggccccaaggcccggacatgtggaaatgtgactgtgtcccctgtacttcgtgtagtactttaaaggagtctgtatctgtcagcatctcaccattcctttgtcataactgcatgcttttccctaattaaatgtggccatgaatgtataaagattgtgtactgcacctacctacttgtcaggcttgaattggtgctgctcagctggaaagtaaaatctttgaaatacaaaaaagctaaagaataatattgataaaacacttctcatctgttagtcttaaagcagttttctttcctagagtttgtaagtgttttaatgatcaaggtctaaatatacaatgaataagagaagtggcgagcaaaatttatcctaaccttttcagaggagtgaagacatttcttcccattacctatatacctaccaccttcgatgctacattttagaggggaaaaaatattttaagaggcaaagcctcaaatgcttttacatgccgtgccacttgcctaccacaacagcatctcacaacagtttctaatggagaggagcattctttttggctttacagctgctgcataaatgcccctgtgttaatttgggtacagactcacagcctgatagactggggagtagagcaaagtgcagagattgatttgtctatctgctggtgaaatgtaattcatgcaaccatcagcagaatgctttgtaaacatggaattattttcaggttataagatcctctactaaattagataggaagcttg

SEQ ID NO: 115692 - DNA, 1093 bp, Homo sapiens
gtgagagatcattgaaatgtggaagactgtaatctaggcaaaacaacaacaacaacaatacaaaacaaatagctatcgtacagagactcgagtgagagttgaggagcaattccattagagtggcaaacaggaaatgtactctgagggtaggaggtgccactgaagggttttgtacaggacaataagatcacatttgcctgtaggaaagattcctagcaatgagggattgaactggagttgtgcaaaaaggattccaggatctgagttagagcaagcatcacgggcttctggggcagatggtgatgatgccacaagcaggctggtgaccgtgagaatgaagggagacgctcaggaagtggattctgaaagactggatgactaactgagtgattagagtgaagaagaactaaagtggaggttgtgctcatagttctgctttagcctgttagacaatggtaccaattactgaaattgggaacacagaagcaagacacgttggatgaagatgatatcttcagtttgggattcattggactggagcttctatagacacacccaagtggagatgctggatatgtggatctggatggaaggcaagagagttccagattggggattaagagtcatccaccgccgggcatggtgacttatgcctgtaatcccagcacattaggaggcccaagtgggtgaatcgcttaagccaaggagttcaagaccagcctgggcaacatggcaaaaccccatctctacaaaaataaaagataaataaattcgctaggcatggtgtcatgtgcctgtagtgccagctacctgagatgctgaagtgagaagatcacttgagcctgggaggttgagactacaggcagccatgatcacgtaactacacccagcctgggcgacagcacgagacactctctcaaaaaaaaaaaagtcatatacataaagattaatgaagagtgccaaaggtaattagtgttgaatatttattttccagcagcttcaagtatttatggtctgcttagacccaggtcagagtctaaggtttctggccctctgcattcccaagagaaatggaggtggggatggggagaca

SEQ ID NO: 115693 - DNA, 1121 bp, Homo sapiens
acagatacttctcctttttgaagaaactatacaggcaaaaaaaaaagcagtcaagctgagctagtttggcatagtatattgcaacataggcataggcaggatttatattctaaaaaatattctgtgttttttggccaaggaacagaaactcctggtcaaagtcataaatgaagcagcagattcagaagtagctgagtgttagtttacattagtgaaacagttacaatgctaaagcagtgatgtgtggtgccctatgaattttgttacattacagtgatctagatttcgttatatgataagctgattaactttgactctcccgtgggaagacagtctgcctgtgggttttgtttgtttgtttgtttgtttctctttaccattgccacctttaccctggcttttgtaaccacattcagtgataagcaaaataagtttaggtttcaaagaaaagtatcagtttattgtcaaataatatggcattgtgaatccgcatctacgtatgccatccatctgcagatggatgtaaacaatgaagtatgagaatagattttttaactcttatttcattttagatttgtaaccctgtttatctatttggtcttgaatgaaagaagcccttcacagcagcttactctttacagcagaccacatttcaaataagagattagagcataaaccagtcggccggtgacttaagtacaaaatgtcttatctagctttgtacagtctatccatttaaacaacttgcctaaaaggcctatatcttttgttgtgttgtcatcacaagccacacctagagagttcgtaattgttccttagagcttcttcagatgttttctgctaagttggctttatgtaaggtgctgaaagccacctgaaccctgaactcctgacataattgaaatgctctttgtcaccacaaaagcctgccttttctgcaacctatatggaaaaggctcaagaaggaaatggacgggatccatgtcaggtgatacttgtgggcctctttaggctgggtagagataggggtaggggttacgtaacaatgatttcaaacccacaacatcccttcattctctctggtgctagattcctaacttatgtgtttgctccatcagttc

SEQ ID NO: 115694 - DNA, 1153 bp, Homo sapiens
aaagcagacccctctaggcttgagaagcttacccattgcactccctgtgggagtgtctcaggaaagagcctgggttgggacttgcttttagcatgcttcccaacatccattccctttcctgggaccaaaacgcattaaatacccttcaaggcccaggaggccagactctgaatacaaagacttggtatagaggaaggaaaaaatacttttcattctcttcctgcagaaagaataccacaaattagtatctcaataaagtatcctgttacaggacccattgcccaccctctctagcttctgcctttctgcttagaaattgtggctagcaatatttaaaaggacatcagcttttctttgtaaaactcacattttccaggttaagaggttaaaatattcatgattaaaaatttttgaaagctagagtacaagcatacctacattcatactcccatattcctgccactgagaagtaatcactattatgatttatgtacattttcttcctattcatcttctttgcattctctatgcagtagtccctcagtgtcccgaggagttggttccaggacctcccttggaaaccaaaatctgaggatgttcaaaatctgatataagatgacatagtatttgtatataacctacccatatcctcctatatactttaaatcatctgtagggttcctataacacctaatgtgatgtaaatactgtgtaaatagatcttataccgtattgtatagggaataatgacaagaaaaaaattgtatgtgttcagtacagatgcaatttttttcaccaagtattttctgtctgaatttgtttgaatccatgaatgcataactcacggatacagagactgatgtttaatatcagtctttggatgctatatattttctcttatgtctttgtaagcatttttggagtaatcccatcttgtggtgatagtatagcttgactacattttattcagggtttttaggagaaagagactaatcatttgtccctcactgtcttttgttcattgtcatcccagaaaaaggccaaaaagaaatgtatgtataggggagatttgttgttaattggcttgattagaaacaaaaacctgccacataaaagaggtcgttaattccagggtggttgttgagtggtctcc

SEQ ID NO: 115695 - DNA, 1743 bp, Homo sapiens
tcttccagacctaaaattctgttaccccacaaataacaacagcaaggaacactcattacccagactgaatactgagcatcttaaagaccagcgtcttctggtaattccccagtcctcctgtctttagcaacagaattggttccttgtggccaatttcatctttgcaaaatgagagaatgactaagaaaacattagtggatgtaaatgaggaaaagaaaagacatctgtcaagttaattaagggaaaacattcctttgacctctttttttttttttccgcgcttttcaccaaggtgggctattcttcgctccttagagactacttcccttttcgtgttagaaacaaatagtagggaccaagcactaaagtataggataaacacgcaactaattttaatatccgtttggcagttttcctgttgcttctccattcaggaaacattttcttctacttctgcccattatcacagctttgacattcatgtcattaacagaatgtcattttgcaagatactgaattaggagcagctagcaacaaaacatgctgaacagaaagacactggctttttgccacatgacttctcacaaaaaagaacaaagtggagctctggtgtcggtttcttatatttgtatgtttgtgttccgattgtggaggcacatgaaatcagggacagttcacttgtgggcagaacgttatgccaaactgctatataaaagccaaatgctgtagagctgggaggtgttaaatagtcatgctgttcattctgggcttgaaataaatttctgttgaatgtcataaaaggagatttggtggtcacggaagtaaacccccttcccttttgtgggtcaaaaagaagtggtccttgggtcctcggaagcagaaggaaggaagagacccttttatttttttggttagtgattagctatgtagctaaattatagactaaaatatattcaccaaattaaatagttctagtggtagcaagttaaactgagatttaatttctgtatagagaaggctgaaatgggtaaaactatattataataatttagttgctatgtgtatattcaaataagttttggatataaggacatctcccaatcaagctttctaaagccaatgaccatttcataaaagcaatgcaattgggacatgaggtacaggagaaaaaagttaatagtaaaattttactgtgttatttccaaaaaggaagattggaacattagatttaagttattgcattaactctggcttgggactgccaccactgtctaaggtcttttcaagagttacttccttatccctggccatttgaaaataatctaatgccattaaattaaattgattaaagtaattttaacagtaggactttgaacttggtttttctgctacttggaaaaagatatatcaaattgtgaatttaatatacttacattgagtacaaaaaacggaagttaaaaacaaaaaacaacttgtttatgtcacacacatcttccctacccccagcacacacttgtaaagtagaggtttagaaaaccattaatttgtgttttgtgtatcttttcttaattccccagtatgtctgttgacttctctttggtccctaataataactgacctatggacagccaaccacttggatgtctgtctcataggtatttgatctgacctttccccatgttataaaactggctccaccacctccacctttcccccaactttgctactttgataacccagctc

SEQ ID NO: 115696 - DNA, 1049 bp, Homo sapiens
tcaaatgttcatcttctctaaaggtgtgaggaaatagttagcagatgttcatggacagtaaagctttggtctatgatgggtctcctgtgcaaatttatcaaattttcattaggacgatgtaataattctagctttccagaattaccggggcccctcttactcaattcactatattattactgcccctcaatggtggttagtcttattttttactgaatgttgacctttcaagtcagctgtcaatgtaaaaatcactgcctgtcggggtttcctctcttcatttttcttgccatggtcagaaatgatcagaatttatgtctcaaagtgaatgtaatttaaaattaagttggatttcagctactcagagtaattggaaaaggccacagcctggtgggcttcacagctttcagagacctggtaggggatggctaacaggttcttctgccaggagacaagtggcagacccaggtgtgaaacttttacaggtcccaccaagcctttcttatggagcacagagcataaggacaacttctgcagaaatggaatggggtacttggaaccaaaaatacatacacctcctttcccacctgcctccagcttagtagcccatagtcctctttgtccctcacactgagccaggcctgacttagatgatgaaatgcatggcctgtctcttcaccttcttagcaaatgggaggtgctgttggcagtaattaagaaattgagaagctccttgtgaaactgttttcgcgatggtaatagtgaactcagggagcaggtgtggtgcctctttcagtcctcatttcacctgcctgagcaaaaaccatgcagacaaaacacttcctggtggtgacctcatgtcactccaaagcatctccacccaagcacctgttcagctgtgacattcttacacgcagtgttctgtccatgcctgctcacctcctgcccctcaggggcagccagtcctccctcaaggtcctatcatcagaacatcttttccccttcccattcttctcggattctgtagtcagcaaggtgcatttcttgtg

SEQ ID NO: 115697 - DNA, 1041 bp, Homo sapiens
atcagtgaccacctagaaagtaaaaggtacatttaaaattcttcctagtcacctctcactcttgtggttttgagaacatggtagtctgtgacaggacagtttcggtgaccgtcacagtgatttctgtggctttggcttttctgctcctagctcactcgtcagcagtttactctcaggtttatctctgaatttgagttagaaatcctcagctgtatgtaaatagagactgtcttcctccagtcattagctggtgagagagtgtggatttgtgtcacaggcaaactaactgttccacagagacaaaaggacttgaggcaggggctccgttagtgtgaggatcagccagctgtcttcattaagtgcccagtgccatagacagaaggctgaatgctcaacacagccacagtggcctgtacccatcaggcaaccagtaagggaagtttaaaagtctgtatcttaaaatcaagtatatatgctaaaaagcattttctttttttggcacatttaaatatcatgtacaggaatgatatctgtatctttgaacttattcattctggcataattgtagtttcagctttatgatgctttaatgcagattttaaaaactgactacagcaatgtatgagtacttctctacaaaagccgtgtaaactgcaggctttgaagttctaagctttcatgtttggagtaacagtgagtaattgcagagcttgtcatgaagtgttcaggtgtgcacacactgtggcaacccagaagtttagagggttcaagcctggggaggaggagcccatcaacactctgcactggagttggtagcatattttggtttccctagtcaagggaggagagaggtagataaaatttagaagtgtataaatacaaaaacagtcatatagttttaggggggagagatgaattttgcttgaaaaaaatctgaactattttagatgtttttaaaaatatgtttaaaaacttctatttacaaaagctgtatatattcagtgtagaaaacttggaaaatataagaacaaagaagaattg

SEQ ID NO: 115698 - DNA, 1377 bp, Homo sapiens
caagccatattatctgtcaaagaacttgggtcccccacttaaatagatagtggtggtggggtgggaagaaacctcacttttccaaaaagaaatacaggcattttttttgtttacagtcattttgttgtgatatttatcatttatgggatgttttaagtatagaaaaaattctagtattattttaggaatgaactatattgctgtggtacattaaaatagtagtcaagagataagcaaggtaatagtaagctaacaggtctcatgcaactaaatcatgtcaagaatagtcagcaggagacggcacccacctgagaaacacgtgggctgagagaggaaaacttcctaacctttgtaataaaaaccatgcatttcctaagtattccgctgaccctcctgctgacacccttctcgttggtggagagtcgctgatacacgtatacctaaggacgtccccaaagcatgagcattctaaagtggtccatgtattaaggtatcagatgttgatgaacagagagactggcatttaattacatggactctgctcatcttttatccttagatataaagaagttatatttcaggttaattttcttaaagttttatcatggtctgctaacaatcaaatatgactttgaacaattctcttaacttggctttaatttccttttctgttaaaggaggagattggatatatatatatatatatatatataaaattttaaaatattccttctaaggctgtaccttcatatttctagttctttggctttaaagaagattttctttcaccctgtgttctcaggattaatatatacctgccttgtgttctccattggaggcatgcttttagtattccaggtctgatgacaaatgacactctcagcatctaaaatattaaagataaaagaatgggttagctggttgggcccaacagacataagatgtgagggcatgcccgagtgacccccagcatgttctggatatgcactccgcatttcatcagcatctgaggatggatgtgccctttggaaggaattttgagaggaaaacaggttgtcctgtggaccgtgcctcccaggaactttgaaggccaggtatccccttgtttatctggagaagcaacacatcccagtttgtggtagttatatctatccgctggaacaattaggcctaaagcctatttttgcacatgtgggaatgtactggaagtcctgcaatagttaccagagtgaccggccagtgtctgaaggaatgaacgtagtttcgaaggctttgagagaaagtgtgtgtgtgtgtgtgtgtgtgtgtgtgtgtgtgtgttcctcagcaaaagaacatgccctacttcagtgtttagagatgcaaatcatcttaaat

SEQ ID NO: 115699 - DNA, 1827 bp, Homo sapiens
gagtgcaatggcatgatcgtggctccctgcagctttgaactcctcaggctcaggtgatcctcccacctcagcctccttagtaactgagaactacaggcgtgtaccaccatgcctggctaactttttgtatttttttgtagagacagggtttctccatgttacccaggctggtcttgaacctcctgggctcaagtgatccactgacctcagcctcccaaagtgctgagattacaggcatgagccaccacacctggctttggagtgttttttttatgacatgcattgctgaataaaaatgtgattggtgaggagttgagttaattaatgtaaaatattacaaaactatttagcagaagtttgtcatctttatcttttagaaaaaaaaagtaaattaaaaatggcctaagaaacattgttctccattaggattccaaaatgataaatctgctagcctataggggaaaggtcaaaattttgttttgctgtaactatatgtcataaaatataaaagctaagcactcccttaggcattatctcacacattgttccacttgctagcacatttttaagtttttaaaatcatactatgaaatgattagctattataacatttgaagtttttttatttttgaaattataatttaattaataaccaaatgtagatcttgttatttattatctttattacatgtcttggtaaaacagagccaggaattcctattgtagtagtcctgggaaactagtccaggtgtaacattgcccatgattaattggtgatgtactcaggcctgacaccatcccactctactgctccactgtgggagatgcaccttgattgcccagtggcctaatctaatccaatgacctctttctgggaaagaaaaaaaaaattgagcatgagcaccctgcaggatttgataccaggaaccatttccaatttcttgagtagttgtcttctcttgcttcctgtggtgcttgcttctgtatttctgttcttgttggctccttttgcttcttgtgccattttaactattggaatcccttggatcacattctctgtcacacttaattgtggcataaactcttttaccaaggtcctctctttcatgcgtgtgccagtttttcccacagctttctcttgggtctgaacctttctcctgaacacagatgcatgtgtctgtttactaatagtctctccatctgattgtgtcctaccagcacctcaaatccagctgttacccaataacaaatttattttctccaatttctgtttattctctctgttattagcaacatcatccaccttgtcactcaaactagaaatctcagtatcattttttgttacaccctctctcccactttccctctgaaaagtgttttatacctgacccccctccccagtgccacagccactggttccaggatgtttcagtgacagagaactgggagcctgctttggcacttcctgggctccacctccatcaaatctctctcagacatcgaagctcatttttttgaaagacatgaacttaattatgtcttttacctaatgtaaaacatttcatggttcatcatgacatacgggagtatagtggttattaaagtgattcccagatgagcagcagcatccatcgccaccgccacagactagttagcaatacaaactctgaggctccaacccagatctactaagtaagtaactgtgaggggtggtgcccagcactctgtggtctaacacattttcaaggtgattctgatacactctacagttggagaattaactgccctgtaggttctaaagcctggctgtgcatttgagtcacatgt

SEQ ID NO: 115700 - DNA, 1073 bp, Homo sapiens
ctaccaggggtctgcaaaaggggagggaaaagtggcagtactttactgtccagcttcttagcgctagtctgccttagagtcgtcacacctgacctgacgtacaaaataattcaccatttctaaccccttgagtattctcagaatacgaagctttggcttcattaaacacagccttcagaaaggttagcattccattgcatccattgtcactgccaagatcacttgaaggaagccccgggtatcatttgtctttgactttctggccctagcaaagtgtccagcatatattaactctgcataagtgctttccaaatgatttaaaaattttaaatatgtgccttttatgtacctactttttcattcaaagagggatttaaagaccctgtcatgttctttaagagaataatcacaactttttttctcccatctcagttcgtcccagaatacctgaaggattcaacaccttgcaatagtaactgtggctgtgtaaggtagtgattctctgaaggttgacatttgtgcatacagaatctcaagagttgtgtgtggcttaaaacaagctccactaatcacacttatcaattattttcagattgtctactaaagatatcatggatgcatgtacagaacataaatgaaaggaccggaaaggccatgttcctattatgtataaaggcaaattatgttttatgcaagaaggaatgataagaattagagtgaatactcttagttttgcttctgataatcagttgttgaatctagatcccgtgccttgattttaactgtcctaataattttaaatattataatattacatggaccgtataataggcattctgcctcaaaaaaaatgaaagcaagcatgagatgcacagattttaagtcaaatattcatgtttgttagatatgattaaaatgaaaactggtttgaacaaacatgagtaaagttgatagtgaaaatgtaaacattatggttaattaatgttttctttaattatatatattatataatataatatataattgtatatattatataatatatataattgtatatattatataatataata

SEQ ID NO: 115701 - DNA, 1038 bp, Homo sapiens
ttgcagcttgcttctatgtggcaaagacacaggacttctccaatctaattacaaagcaatcaaacaatttaattaatctggaaatcactttcttaacaatagctgctgctaaaatgaggcaccctgtgtagtgccgttaggtaaagtatgtttttcctacactgtttatgtattagccatgctagttccccagggggatcatggagttaattacctacctaatgcctgaccactactaaggtttactttaccaggtcagaaacatcagcagcgataccagcagtctataaagtgtcctagcactcaaacatccaagagccagcaaatccctgggagcagcaggattttagttataagcaagtgctgcacatatgggcagagaattaactggcaccagttttcatttgggagtctctcaggtattgctttgcagatgggtggatgaattcagagagcagtgctatgaggagtgaaggtcatgtataagactcgggtttcactccttcttactctcatcctggggaagcactgtgcatgtgcacagcagtcaagtcctcatcgctgagtttagaacatataacatgtgctttataatttggcctgttctaaattagcagtattttgatcactgtataacaaaatagtattgctaagtcttcagagactgagtaggagtcaatttttatttcaaataagaacaaagacttcagagattgacttctacctgcctaatctgctagtcttataattcctccctaaggaaaatggaggaatttctgtaataagtaacacagaagtctatagaatgctcattgacccttttcttctgttaccaccacgactccatttctctcccaaaatttcctattagagggtcagtcattttcccaatctacccacattggaaacatcagtcacttttttagcctgtatcctttttcactcgtttctaatctgctaacgactatgcttggtttgcccaccagaatatcctttctcttgaccttccatgtcctggtctaggtccctcctcctctg

SEQ ID NO: 115702 - DNA, 1050 bp, Homo sapiens
caatgtaaaattgctgtaagagttgccacgtgcttacgcttaaaattgtatttatctcatcacgcacagatgacatcgtggactgttcccagtccacaggctgccctttgacttctctacactagagtataaagtctctgtggacagggatattatctgctttgttcacctaggatggtgtgtgacacatagaaggactttaatattttttgagtgaatggcttctgatacccctcaactcactgacatcctccttattgtcatatccactggacattttactggaatattactgtattcagcagtgttaaaaccctccttttctctgccttccttttaatttattgttcttgggacatctctgaccatttcttctctgcctcttccagggatttctcttccaactcccgttttctacaagttttctcacgatctcatctttagtctactcctcctccctctctcctagggatcttgtcagctgtcttggattagagacctatagactctaatggcttcaaatccttacctcagaccagtagtcatctctcacatttcagaatcatggatccacctgcctactgaatatctttctacctgggcagcccactgaagcagcagtcccaacctatataaaactagacagcatttcctcaaccacacatgcttctcccacattcttttcatccatcattggcactgccatctatccagtcacctgctagaactctgagaatactagactccctctctcccttcatcaagcaacccattagaccttcatagtttacttcctaaatatttctacaacccttctttcctgttctataatcactacctggctcagaccctcatccagctcagaccctcatcctcacctatctgcctccctccagtcttaactcttcaaattcatacttttatgcagctgcaagaatatctatctaaaactctttattggctctatcttgcccataagtaaaactataacatggcctgttgctgtgcccttcctctcaatgcatttagccataatgaattgtactgact

SEQ ID NO: 115703 - DNA, 1050 bp, Homo sapiens
ttctcagtagatatgaaggaatggaacacgagatatgcaccacaacttaagaatcattccctagttgttgtcggtgctgctttgatgcccgccagagcctggaaagatgtgcctctctcagatacctgattctaagcagagttgttgacccaccgaagcctttccaagctgtggtgattgcatcagccaatgagttcctatgcccagcctctaaagttcctatgtctaggtgtttgcaagaaatggagttctggggaggagtgtgtagtgaacaatttcaaaataccaattgctgcctttttttagatttaagattttcccatgggcacattggagtatagagcaatttttttaatatgggagaaactatttttcttttgtttcagcttagtattcttatccaattgcaatatttttattaagcttaactttttttttttccaacttagaaatggctcatttgggaaactacgatagtgggacagcagaaacaccagaaacagatgaatcagtgagtgtaagtatatttcttgatgaaatatgatgttggtttttctgtttagcatctggagactttggctatgttagtttatttgttcaacaaatgtttattgtgcttctatgtgaatatatgaataagaatatggataagatctatgaagaaaaaagaccatgtgctaccattacgtaaagatatttgccatagtctgtccagtcccagaagatttcccaaggaaatggcacttgagctaaatgtaacagattactagggtaagaaggggcaaaaggaacattccagacacaggctacatcagaggactaagcaagggagacagcagaaactagagcacttgagtaaaagctggatgcttaggtccctgttgttcatgtttatcaggttttttgtttttgttttttaagagcaatgggaaatgactgaactttggaggaggtgtatgggtatatgagggtgggaggagtggacagggagataacccagtcagagttatggcttgaaaaaaaatcacactgactgcagtgcagaaagca

SEQ ID NO: 115704 - DNA, 1551 bp, Homo sapiens
gatttttttctgcttatttttattacatatcataaaagtactcatcacaattagtcttcttacagaaagaaatatatattcttttcagtctatagtatgaaataaaatggaaaaggagatacattcaagaaaatgcagccagtcttcccgatttttagcttttttttctttctttaagaggtttatggactaccttttcaatgctccaagtaatcttatttccatcaattttatattaagtttctgagttcgagtgaccatgacttgttgacataaagttaataagatgaatagatcagtaacaatttcaaagcatctaatttaagctgttgtcattgaacagaatcccaaaactataaaactcaaagaaacattagatatccttttagtttaacctttgcatttcatagatgagcgaaataaagtccaagaaaggaagacttactagatagagtggtagataaaagacaaaaacgtagcttgccttattttcacccagtgtcctttctaccacaccaatattttgcttttttaacctttgttgtggttatcttaacaaaaacaattactaacatttatcacacatttaatatgtgatatgtgttgggcagtatcctaagttctttatatagattatctcatttaattctcgtaagaattctaacaaagatggtattattaccatcctcgtattacaggtgaaggaaccaagagtcgtttgcctaggatgtctcagctggtaagaggcagagctaggatttggactcaggtagcctgattctagaatccatgttttatgctggtgtattttaaattgttaccatgatcctaaaattatgctagccgttctttaaagtacagtttcacttcagagccaaacctcctctcttatgaatactacttcttaaataaaaatctgtattttctccatactgtttcttagttagaaacatgataggttaacacatagactccagttgtgactatgatatgctgtgtctatgggtagagatgatttcaccttgaaattctgcagtctaaactgattttctacattaagccttcatcctatagctactaactctttttcctgtgttacagggggagactgtgctactttaatgaaaaacatgggtcctctccctgttgatatggccagaatgtactttgctgagacggtcttggccttggaatatttacataattatggaattgtacacagggatttgaaaccagacaagtatgtacacaaatgaaatatatgtcttcttttgcccaatacaaagttctcgtatgtttataaagatgttttcttttagtcaatgtacatttttaaattattccataatgtccaaaatgagttgttttaacagtatatatggtaatttgtatgtaaaactttaaaagatatgcttattggaagttcaggaaactcatggaaaaaaggatacaatgcatatgtatatatatattttattatactttaagttctgggatacatgtgcagaacgtgcaggtttgttacataggtatacacatgccatggtggtg

SEQ ID NO: 115705 - DNA, 1021 bp, Homo sapiens
ataggtaaaactaccaaacagggtcagattctcaatttgaaagtaaacattacatataatttaacattagagcagaactgtaaacttcccgtctttggtaataattcttttcgttggtattttaaatatctttttataattggtgctcttaagttctttgtccatgtggttccatgtggttgagcaggtgcattctgggcaaaataattggtgactagccatcttgctcattttaattcatgtctaatattccaattattctaatattgcaattatcttttaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtggtaaatatcatcaggagttatctttaggtcactgttgggaagcagctatttaatgtaaatctgttgagtgtcacagtttttactactaaaatgttaacctttatcaaacagttgagccaacaaaagaactcactcatcaaagcatataactgacattcttaatctcaagagagcaatttttgttgaaaattgatctgaagaaatgttgttaacatagaatttggaaatgtactagcaacaaaaccattttttatagtgtgctttttctgcaaaggaaattggtgtgggatttacaggcaatttaattgccgtccagtcttcctttccatgataggaaagttacaccagggaagaaaaggttaatgtgggtaacatttacataaatagggaaaatggctaatggcataatgaagaagttaacaaaaatgtaataaaccctaaaacaaatgtctaccaaataataaataatgagaatgggaaagaagcaagttgaatccacagattgttaatgatttcattggtagttgttatggcgtaatgttatttctgtaacagctgttcatctttcattt

SEQ ID NO: 115706 - DNA, 1180 bp, Homo sapiens
aactttttggaagccaattctttgaaagaaaaatacatttaaaaagcaaattaaagatctgcttattgaaatattctcttcctaccttgtaaaaaatctatgctacttatgtcttgtaaaataatgcttctcaaacatgactgtgtttaggaatcgactgaagatcttgttgaaaggcagactctgatttagtaggtccggagtgggcctgaaattctgcctttctgacaaattcccaggtgatgtccatgttgctgggacctggaccctcttgtgaacaatatggttataaacaacttttcttccttctagatgagatcaactggcctgagaaggatgaggcacccccacctgatgcccaggatctgattaccttactcctcaggcagaatcccctggagaggctgggaacaggttagagcccatgtgttttaattttgctaatatgcaagaaataatgtctacatggagcactctgaagcttttgttgttgttttgctttttgcataggcaacatctgttagttgatgtagaacatgactgcaacacattatagcaataatattttggattttgttttctgattcaaaacagtgtgtacgctaagagggttggttgtttgtctttgttttttgttgtttttgtgtttggcaaagcagaaattatgcttaatttgtttcaataaataaagcttctctggaagaaaacctcaaaggcacatgtaactcttctatcccgaaaagcatgcatcttaaataacttgaaacagaggattcgatatttggaactctttttgtttttgtctttaaatatacatccccatacggatttgacccagcacgttactatacacaagctttgaaatgggttatcagtacttggactaattactagaaatgagtgtctggggttgaaccatgctgtcctgtcacagtgatcagcaccgtgacccaagaaagagaattaaaaaccactgtctttcaggattaacgagatagtagatttgtttcttgctgattattttttctgactgttctgccagtattttattcccttttcttctctgtattctgaatagacagacttagcaatcccagtatagagtcccagtctgcccaagtatgtgaatttatgtagatgagactaaatattaaatataaatgcatatagtctagccagc

SEQ ID NO: 115707 - DNA, 1019 bp, Homo sapiens
aggtaatcacagtatgaagtgggcggccatggtgtttgggaggtaatatttgattcatggcacagcctttcatggtatggggggggtaggggcaccagaattatctctgcaaggtttcaaaaatatagattgttgaaagaaactaattcctctggttacatggagtcatggattgagaattagcagacttgtgtacaggtagaatgaagcctgaatagatgcctcttccatctcttcctcctccacgtcacctttctcaaagcaatcacatgttgttaatgttcgcctgacaccgtctggacttactggccacataggagtatgttctctggcgtttactcttcctgctgtctctctcttcccgtcttcccacctctcctatcctggattttcctgaatgtgtttatcccttcttctttgtacagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggaggtagagagatactacttgcatgaaattgtgtgatttgtgcatgtggtcccatccctcctctcccaatttggaatgctgaatgagatgcaagattgcttgaagtaataacgggtcatgtcccaggacagctcttgagagcttctgcctgcagactctgaattcttcctgcaggatttgtagggccgccaaggagcattttggcctatttcatctcactttctgcatcaggggtacaagagaggcttccttcccatgaaagcttgtttctgttttgtttcctttcgttttcttttctccctccaagttaaatgataaattttccttccttgaataattttttttctctagagtatgtataatttatacactttatagagctgtttacaacatttg

SEQ ID NO: 115708 - DNA, 1083 bp, Homo sapiens
tgtctcccctgtaatatgtagacactaatgattctgcttaatacttggggggtggtgtgtgggggcatttgagttcaataaagatcttcccagcaactgtattgctcggcagtcagccaattatttgggcagaggctatgttcagacacatcaagcctgtgaggccctaccttctgctgcctgaactgtgtgtgggttgtgaattacaactatctaaattgtgtgtgggttgaggaatgccgcaaatagaaaagttttctgcaaatgtaccccattcccctgtgcgagaattgcttgaaatggaaccagaaactaccaaatttagcccggctgtgagaacttacaaagggaaggtcagagtcaccatagaagtagcaggacaggagaaatttaaaggtgttggtcgaagtaacaggattgccaaatctgcagcagcaagaagagccctccgaagcctcaaagctaatcaacctcaggttcccaacagctgaaacccctttttaaaattcaaaaaaaaaaaaaaaaaggcgggggggaaattacttaaattggaaggatgacttaaagttgatattgagctaaatgcattgaaggcagaatttaaagtttgtttgataacaagatagctaacagaataaaacatttagcatatgtatgcaattttggaactaattgtagtttcagtttttgcacaaacacaatcttgtcttctttcctcacttctgctttgtttaaatcacaagagtgctttaatgatgacatttagcaggtgttcaaaataattgacagagtttttttgttgttgttttttgttgttgttgtttttgagtttaatttatgtcagctttgcttagtgttagaaggccatggagcttaaacctccagcagtccctaggatgacgtagattattctccatctctccatgtgtgaagtagtgccaggcctgcattagttgataagaatagaatgattgaatagaatgataaggttttcgagaagagaagtgcaccaatgttgtcttttctttccacgttatactgtgtaaggtgatgttcatggtcgctgttgcacccgacagtaag

SEQ ID NO: 115709 - DNA, 1113 bp, Homo sapiens
ctgggacaccatgatttggaaggtaaaccatttttaaataatgatttttttaaagactgtatgaatttaggtgaggagcttgacctagactctgaactagcacactgaagttaaaaagatggactgtagagagatatgggctgtgggcccaggaacccttccataccctcctgccttggttgaagacccatttcgtgctgccatccaatgcctaactgctaatttcattgggagatagaatcacatgacttggatatattcttgattaatttaatgtgatttaaaaatatcctgtattcctgcctgtccatcaagttctccaaattcttgtcatttctaaatggagaatggagtaactcaacaaagtcagagagggcttttttgtttggctctttgccaaaatgcctataggttagagggttacacagaaaatctactttacagcagttgtacgttaagtagctgtggattgctatttgtcaaacatcagaaacaattttattttggggaatagaaagagaatttctctgtatgttagcagggacagaaaatatgcttctgattaatgggattgcaggcagtcattagaaggattgaaagactggagaaaaattccttaaaattttgaactgttgcatatgatattatataagagtaagttagtttacttgttcgtaggattcctttataccctttgttacaataacttatgcatgcactagcttggagcctatatcacaaaactgccttggttatttgaaaatattacattgtagataatgttatctacatataaaaagcctttgctatgtgaataatcatgtcagaactgggtaaaaatagtttagtgggcaggtatatgtagcaaaagagaatagaggcatgatagagtgaatctgaggaaaaatcctgttgatttggatagtttaggctccaggtcgatctcggtaggggtggtggttacacaggtattaccaaatacctcaggctgctgggtcttctgcagtactgtgaagaatttgaggatgagagaaaagagaacttcccagtcctctagatgtgacagtccttgtggcagtgccatatccccctaaggaggagctgggttattgg

SEQ ID NO: 115710 - DNA, 1059 bp, Homo sapiens
gctgccaccctggtttgtgtcctcactacctcttggccagacctctgcaacacacctttctcgcacactgtggttagattgatattcctggagtgcagctctgatcccgttgctcacttttcaccaagccctttccgtgttccacactgtgggctgaattactcacaaactcagcatgggcatgcgtgatgtcctacagcccctacctaaatctctaaccccaatcccactgctccctctttggctccagacggattggactgcctgttctagctcttctcagaatatgacattttcttggtcacttctgtaactagcgtccgaccacacatgccattctgtcttcagattcctgcagttagtgtgctttctccctcgtttgaaccctgcagtgtttagtttctgcctctcttatgacatgtactagtgttgtggctctgtgtactctgagccacattatcagcgataatgtcacattatcgctaagacattgcctcatgccgacactcctcccctctgcccccgcccggtgttcttagaaggcagggactgccttactaatctctgttgtgtcaagcaatagcacactggcctgtgtctgtctgccaaatcgattaagtacttgttgaatggaagtagaaattccaattaacacagatggcaaagtgtgctgttcattcttaagtctcgtttttttcattcctaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccag

SEQ ID NO: 115711 - DNA, 1036 bp, Homo sapiens
tctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgc

SEQ ID NO: 115712 - DNA, 1022 bp, Homo sapiens
taaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctct

SEQ ID NO: 115713 - DNA, 1109 bp, Homo sapiens
taaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagt

SEQ ID NO: 115714 - DNA, 1049 bp, Homo sapiens
ccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatata

SEQ ID NO: 115715 - DNA, 1043 bp, Homo sapiens
actgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggttttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgatttt

SEQ ID NO: 115716 - DNA, 1187 bp, Homo sapiens
ctggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcacc

SEQ ID NO: 115717 - DNA, 1585 bp, Homo sapiens
ggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggat

SEQ ID NO: 115718 - DNA, 1986 bp, Homo sapiens
tatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcatta

SEQ ID NO: 115719 - DNA, 1022 bp, Homo sapiens
taaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatata

SEQ ID NO: 115720 - DNA, 1057 bp, Homo sapiens
cgaacacagctcactgcaacctcaacctcccaccttagcctcccgagtggctgagactgctaccacgcaccataatgcctggctaattctttgtattttttgtagagataggcttttgccacgttgcggaggctggtctcaagctactgcacctggcctcaaaatgttaacagtagggcgcggtggctcacacctgtaatcctagcactttgggagaccaaggctggaggatcgcttgaccaaaggagttcgagaccagcctgggcaacacattgagaccccgtctctatgagttaaaaaaaaaaaaaaaaaaaagtcaacagtagttatcacgtggatggtgagttgtttggggactctgttttgtttcattttgtgtttatgtatatttctgtggtttctgtaatgacctcttgtttaaaaaaccagattgatgagctgcttgtaatttcagtgatactaaaaattgtttctgcttttatttttcagattaacaaaatatattgtgttactatgtttcactaaatttttgaaggctgtgggacttttcgaatcatatgatctcctaaaagctgttcacattgttcagttcatttttatattaaaacttgggtgagtgtgggggggggttttttcttgatattttttatttctttgaaaatcctgttttaacagagtatctttaagaaactttacatacaatattttgtttgttcctcctgacaagtatttgataaacttttttaactgggagtatacttaagattagaggtacaaagagactgaaaagaaaacggattgttgtgctctaatcacttgcctaaacacaaactttgatgagatttttgcaaatttagtttttgggctatttattattattattattcactgcataatcctttcttagtacagagtcctcatgtagtgtgaacattaatttattctacttatacgaaatgctttttttttttcttttttgagacacagtctcactctgtcaccaggctggagtgcagtggcgtgatcttggctcactgcaagatcactgcctcctatg

SEQ ID NO: 115721 - DNA, 1791 bp, Homo sapiens
aaagcatgcccaagagcctagtacaaatgtcactggaaagctgacaaagcataggggttaagagtgtgatttctggagtcagacaaagtcatgttctgtctgtcctccttactgacccttactttgggcaagttacttgatttctctctaccttaatttgctcactgtaaaatggagataacagtaacttcctaacagaactgtgaggaaaaatgaattaatacttatgaagttcttagaatgatgcctcatcatcattgtgacaatgtgacaccctcatgatcattgtcactgttctctttaggcagctgtgattcaaactagaaatgtcctacattttgcataatcatctcacatcgtcacttctttgggcagcagttataccatagtacatgtttgctttatgccatgacttacaaacctgcgtcataatttttttattagaaagacgaatttaagtacttctgtttcagagaccaagaacattttttaaaatatgattaatagtctaaaccccattttaacttttttctctcctttcagataattggatcactaaaaattcctggtagaaaagaatttaaagacaaaaagttaaatgatcctaggaaactagtgggaaactgagaaatcataaaattgtactctgaagaaaaagatttcaaaatctaccagcagacaagaatatagataatggaaaacagaatactgtcctttttttttttctttctttttttgagaaagagtcttgctccatcgcccaggctgcagtgcagtgacacgatcttgtctcactgcaacctctgcctcccgggttcaagcgattctcctgcctcagcctcctgagtagctggaattacaggcacccaccaccacacccagctcatttttgtatttttagtagagacggggcttcattcaccacattggccagcctggtcttgaactcctgacctcaggtgatctgcctgcctcggcctcacaaagtgctaggattacaggcatgagccacagcacccggcccagaataagaatactgtcttggaaatctagacttagtcaagggatcttatgttttctatttacaaaatatgtaatgatttcacctttaaaatatttgttattattatctttctgtattttatttaaaatttggatatatagcaaaatatatgtgactgaaatttttaatttttttgtttccatttatagtggatcaaaatatttaaacatgcagttgctgggtgtattatttcactcttgtggttttttggcctcactctttgtggaccactaaggtaaataaaaatgcatattttgaatgtgtgtttgtatttcttcattttgaatattatttttgttccactgtgttttacgtcaaatatttatctgtacaaatgtgtctagcacttttatagcatcagagagaattcaacagatagaacaaacctgtttagtttctggactagttctttagtgaataccattaatatatttattcatgatttgtcatagatattttactagttagaattccaagtttcagaaaatttttagcataaacggctttttaatcatttattcatgatccctgttaacagcttagaagctataataaaaggtctgaagtggtaaataaaattagccaataagaaggagaacaaaaatctctaaaagcactcattttttgcacaattttgcaaatactctcataaataaatgtctcagaagtagtatatcaattatcagattaaatgcgtggtggataaagtaaactactcccatttcata

SEQ ID NO: 115722 - DNA, 1058 bp, Homo sapiens
cctcagcctcccgagtagctgggattacaggcatgtgccaccacgcccagccaatttttgtatttttagtagagatggggtttcaccatgttggccagagtggtctcgatcttttgacctcgtgatccccctgccttgggctcccaaagtgctggattataggtgtgagccaccatacccagccacattgcctgtatttttttggattactgcaaacagtgctggtatgagcaacctggtaagtgttacctgatacatacctatacaagaataagaaatctgtatgacataattctatgagtggtatgattaggtatttgtagcttcaatctttctaaggtagataatgccaaaccattttctaaagcagttgtacctatttatttttcttatgttttgtgaaatcaaggggaaatgtttttctttctctaactctagttgaattcatgcgtcttgataaagataaattacatttcataaatgataatgttttatttttgtaggactttgctgctatttgagcacagtgatattgttgtcatttcactactcagtgttttgttcaccagttctggaggaggaccagcaaaggtagaattttccattatcagttacttggaaatggaaagtatgtatgtcacatattatccaaaggaataaaatcttatctttcaccatttaaaagaatgcaggaggctgagcgcgatggctcacgcctgtaatcccaacactgtgggaggctgaggtgggcggattacatgaggtcaggagcttgagaccagcctagccaacgtggtgaaattccatctccactaaaaatacaaaaattagctgggcatggtggtgggcacctgtaatcccggctactctggaggctgaggcatgagaattgcttgaacctgggaggcggaggttacagtgagctgagatcatgccactgcactccaacctgggcaatagagtgagactcagcctcaaaaaaaaaaaaaaaaaaaaattccaggggctttttccgctagttttacatttttcttacaatttttttgtttttgaagaat

SEQ ID NO: 115723 - DNA, 1866 bp, Homo sapiens
ccagctcctctggaggctgaggcaggagaatcacttgaacccgggaggccgaggttgcagtgagccaaggtcgcgctattgcactccagcctgggcaacaaaagcgaaactctgtctcaaaaaaaataaaataaaataattatcagtaagttataacattgccggccatttaagtagttacgtaattgagtatatgggaaaaatatactagttccatttccttaaatattatgttagcatggtgtggtggtgtgtgccagtagtcccggctacttgggaggctgagacaggaggatctctttgatcacaggagtttgaggctgcagtgagctgtgatcatgccactatacttcagcctgggtggcagagcaagaccctgtctctggggaaaaaaaaaaaaaaaaaaaaaaaaaaaaaagatcatgtatttaacgactgactgttgaactgtgtgtgtttctaatgagacttatctaattttactcacagggtggagtattattgctagtactggctttgtgttgtaaagttggttttcatacagcttccagaaagctctctgtcgacgttggtggagctaaacgtcttcaagctttatctcatcttgtttctgtgcttctcttgtgcccatgggtcattgttctttctgtgacaactgaggtaagataagagcaagaatttattggtattaaattgctagtaaaatgaattgctattaaatttttagttcactgtattcaataaattatattttaatttgaggttgaaagtggcttaaattgtctttgctttttctttgtagttttttaaaaaaaatttggagttaattttattgtttatagaaaatacaaatcaaatgctattacatttacatatccctcacattgctatggcccaaaggaatcatttgaagaaggagcaattaaccatgtgttaggcttaaagattgtgtgtcgcctagtgttcatcgaatgattacacaatagtgcttttgttttttaaaactttggagaatactgagaaaatgtaccaatatcttatagcttttatatgttggcatattatgaatcatattgaatcatgcgatttttatttttttaaaagattaacagaaacatcttgtaagatgtgaactttatacatgtatagtcttgacaattcttttttttaatttctagagtaaagtggagtcttggttttctctcattatgccttttgcaacggttatcttttttgtcatgatcctggatttctacgtggattccatttgttcagtcaaaatggaagtttccaaatgtgctcgttatggatcctttcccatttttattagtgctctcctttttggaaatttttggacacatccaataacagaccagcttcgggctatgaacaaagcagcacaccaggagagcactgaacacgtcctgtctggaggagtggtagtgagtgctatattcttcattttgtgtaagcattccccccttttttttattttaacaaatttctatttatggattttgatggtcacatcatttacttattttgggaaattcttcagtgcttgcatttagtgccgacagttactgtgttggttttggtagcttaaacttcgaaaatttaaacaatattgttttttctctttgtagctgccaatatcttatcatctccctctaagagaggacaaaaaggtacccttattggatattctcctgaaggaacacctctttataacttcatgggtgatgcttttcagcatagctctcaatcgatccctaggtttattaaggaatcactaaaacaaattcttgaggagagtgactctaggcagatcttttacttcttgtgcttgaatctggtaagattttt

SEQ ID NO: 115724 - DNA, 1117 bp, Homo sapiens
attcttactccttttttagaaatttttattgcactataaaaaaaatggaggaagtactaatcatttattttgctgaattgtttattctgattgcttaatataagtaatgtgggtaatgtcaaaacttgcctcaagtatgatttttgggaagcctttccagacaaagtacaccataaaatttggcacgctgtgtcatgagtgcctatgtccttatatttttaccactgtattctgaattccttgagggcagtgaccatgttttaggcattttgaagtactagccagtagcagagtatgtggtgcacagtaggtatccagtaatattagtagaatgtattaaaaaactaaattagatgtgccttaatttttaatgtccttatatattttatttgtaggtgtatttctacatgttttggcagatacacttggcagcattggtgtgatcgtatccacagttcttatagagcagtttggatggttcatcgctgacccactctgttctctttttattgctatattaatatttctcagtgttgttccactgattaaagatgcctgccaggttctactcctgagattgccaccagaatatgaaaaagaactacatattgctttagaaaaggtactgtatgtaatttcttcactactttcttccttgaaaatcacatttttgaagtctttgctggaagtaaaacagacaaccaaataaataataaaacaaaacgaggccaaaaaagaaatataaagtagcatttaaaatttaataagttgacctaacaagaaatatgcaagatataaatgagaaaaatacagttttacttaaaggatataaaacagggaccgaatagatggatgagattttcttggatgagaagactctttattataatgatgttgattttattttatttagatttcaatttagttgccttcattggatatttttgtttatggtttgggatgttctaaaattatttggaacttacttggaagagttagcgcttgagaataagaaaacatacataaacttacagaattaattaataggatcctactttgcaattataaagtagcagaattaagtgacaaaactaacagtttagatcgagaccatcct

SEQ ID NO: 115725 - DNA, 1322 bp, Homo sapiens
tttcagattttagagcgtctcagatttcgtattttcagattaaagatactcaacccgtatcaactatgtacagcatattaagacgtgtgtactaaatgcattactctaaatgcttcaaaatatctggatttttataacaggttacaggaatacttaaagatgctggagtaaacaatttaacaattcaagtggaaaaggaggcatactttcaacatatgtctggcctaagtactggatttcatgatgttctggctatgacaaaacaaatggaatccatgaaatactgcaaagatggtacttacatcatgtgagataactcaagaattacccctggagaataaacaatgaagattaaatgactcagtatttgtaatattgccagaaggataaaaattacacattaactgtacagaaacagagttccctactactggatcaaggaatctttcttgaaggaaatttaaatacagaatgaaacattaatggtaaaagtggagtaattatttaaattatgtgtataaaaggaatcaaattttgagtaaacatgatgtattacatcatcttcaaaaatagatatgatggattctagtgaagaccaaaattacttctgtttactttctatcaggaagcatctccattgtaaatatgtatttacatgtttattacaaagacccaaatgaaaaatttttagtccattttttgcatagcctaaagataaaataggaataaaagttctatatttatggattttctgtatataaaactggtttctaattataacttaagtccattaagtaaaatctgtattgccactttaaatgtaaactaaattatttgggagaaacttcaaccactgatatgagataagcaatgagaatagggaagtgtataacatcacagtttttgatgtattacaaaaatcaaccactctataaaataaattttttttacttttggtaatatttgcaaatgaataattaatttattagggtaaagaacttatactaagttgtgtccatgttattcatttacttaccatgttcctttaaagtagaatatttcctttcttgttatatatttgacattccaagctgcttatcaagctggtatccaagcagtggtaagctttcatcctttcttagctccataacgttgtgaaacagccagttaagagaatcgtaaataattgtcaactcacagttgaattctctgcctatgtaggtaacttttttctaatttctggaacatatagatatataagaaatatcaaagaataggtagttatttcaaagtttaataagtaaaacttgttcataaacatt

SEQ ID NO: 115726 - DNA, 1040 bp, Homo sapiens
ttcgtggatcagctcttaaagtggtcttgcttctttcagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggtaactctcttcctgacctaacttctgtaagagcccgccttccaactgtggcctttgatgcagaaacatttcattctctctgtttcatctacaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggtaaacttattcttaccattgtagagtctgttgattatttcttgtcccttatttcactgatacatgcaagagcattcaaatgaatagtaatattaataccatttattgagtgcttagcatgaggcaagctctgcctaacattttacatgcattaactcacataatctttacacgtactctctgaggtattgtcacctctactatttaaatcatggctttagagaggttatgtcagggtcacacaggtaagtggcccatatgggattcaagctcaggctgtctggcttcagaatctatgcttttaattgtcaactgtcttatattccttcgttaatgatattaagtagtagctgtctgagccaaaggctttgttatccaactacaagccatctctgcagaatttattggcgtaaacatagaatgttctcttgaatttttttactgctgcatatggctactaaataataagcctgtaacattggaatatgcaaaggagtaaaacaggaagaaggcaacttttcagggagtggttaagaagatgaattaacacttagcctcaaaaata

SEQ ID NO: 115727 - DNA, 2417 bp, Homo sapiens
ctggagcacaatggcacgatcttggctcactgcaacctctacctcctgggttcaagcaattctcttgcctcagcctcctgagtagctgggattacaggtgccagccaccacacccagctaatttttttattatttttttatttttttatttttagtagagatggagtttcacgatgttggccaggctggtctcgaactcctgacctcgtgatctgcctgcctcggccttccaaagtgctgggattacaagcgtgagccaccatgcccgaccttatttctttactttgtctactaaattcagagtcctttgaggatgccatgaagtcaatgccttgtagagtttgacttcaagaaggtgctcaataaatgtttgaacaatgggataaagggagcttgaaggaaatggttaatggcgatgaagttagttaatccttagtagtcaggatagaatttgtgttgagtagtgagaagcagtttatattatgaaataaagactaaagactgaattgtcatttatttggactaacttcacatgttgctgataaaaattaattacttctcagtttcctttgcagcaaagtctagaatgtgaatttatttgcttccaactttaaactgactcactctaagttggcatttcactgtttttttttttgcccaggctggagtagaatggcgcaatcatagctcactgtatcctcaaactcctgggctcaagtgatcctcctgcctgggcctcctgagtagttaggactgtaggcagctgccttcatgcccagctaattttttgtagagatgagttattgctatattgcccaggctagtctggaactcatggtctcaaaggatcctcccacctcagccacccaaagtactgggattactggcttgagctgttatgcccaacctcattctttttaattgaggaattaaatgatcacttttttcttttttaacagagacagggttttgctatgttgcccaggctggtcttgaactcctagcctcaacctcagcctctcaaagtgctgagattaaaggtgtgagccaccgcgcccaacccaaatgatcacttttgatgttaatcacttcctaaaaagaaatggaataaatctgaaaagatacttttcctttaaggaaatgaattgtatgccgattcagcagaatactagcttgagttggtaccaataacctgaacttcatgcccaaactatagtgcttacttctatttgctatttcaagatatctctttgtttcaaggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggtaagtattatcattcgttttttttctaaactgcatctaactttatgaaagtattttccatcaatagtttataataatacaagcaggacgtgggcagcatttcttaagagatcgcactttcaaattctccttcatggaatacctataataaaaagtcactaaataaaccaatggagtctatttgtcactttgtgcaggaaagttcgaagttagggtggatactactatcgctttctaaaggaaaatccacagattgaatttgatatgtatatatgcgatctccaccacgtttggaatggttaagtcccaaactctgcattttaggtgataacgggtcaggaagtggatgaggatgtagaatatactcaaagactacagccacccctaacacaaggcattttgtgttagtgtggctgatgtgcatccagttgttggtgaaattatttgtgcccaaaaggagtacactcaaaagctacttttttggttcacttcaatttgatcccacttttgaaactttctattaatggcatttgccctttccctacaaatacaagcactctttatggcagcataaacatagtaacataaattatactgttaccacatttacgtagtttttttgttgttgttgttttgtttttttgagatggagtctcacactgtcgcccaggctagagggcagtggtgcggtctcagctcactgcagtctctgtctcctgggttcaagcaattctcctgcctcggcctcccaagtagttggggttgcaggcacacaccaccatgcctggctaattttttgtatttttatttggttttggtttttttgagacagggtcttgctctgttgcccaggctggagtgcagtggtgcaatctcggctcagtccagcctccgcctcgggtcaagtgattctcatgcctcagcatcccgagcagctgggattacaggtgcccaccacaacacccagctaattt

SEQ ID NO: 115728 - DNA, 1063 bp, Homo sapiens
ggccatttatgcaaagcaacccctcaagtggcagaggagctgagaaaccaaggaattaggcagataaatggagtttgctggtattgggtgactgatgagggggaatttacagacataagtatggtctttgatggctgtaagatgtagatctctgcactgtaacccctcgtacccacggcttgggtatgtatacattttcttgggcaaagtatacatgctctagaatcaatgtgtgggtggctgacagaatgctgcagacatcacagcctataatgtatacaataatatcaagggctgttttggaggaaaggccaaacttaaagtgaataggcagaagtcacattgaattagtatttaaaataaagtcactgttgtccccacagttcttagctatgttgctgttgggatttaacccaggagcaggcaggagtgttgtagtacatgggttccagctgccctgggagttactgatattttctctacataaagctcaggttctaagtttagaggcttaagtgaaaagatctgagatgataatgtagtatctttatttggaagggagtggaccagcagcagttgtggtgaagaatatcgtaagacctgacaatataaaaaagctgtcatactgtcctatctaatgtttgccttttttttcttttttttttggggtggggagacagtctcactctgtcacccaggctggagtgcagtggtgcaatctcggctccctgcaacctccacctgccaggttcaagcaattctcctgcctcagcctcccaagtagctggaactacaggtgtgcgcaaccatgcccagctaatttttgtatttttagtaaagacaggttttgccatgttggccaggctggtctcgaactcctggctgcaagcaatctgccaacttcagcctcccaaagtgctgggattacaggcgtgagccaccacgccagccttcatgtttgctttatttcttggtgatggtgttgtttgtggttgaccatatgaataattgaattaagaactgatatagattataaatgccccagtgctactgtaggaactaa

SEQ ID NO: 115729 - DNA, 1386 bp, Homo sapiens
ctctactaaaaatacaaaaaattagccgggcatggtggcgggcgcctgtagtcccagctactggaggcggaggttgcagtgagctgagatcacgccattgcactccagcctgggtgacagagcgagactcaaaaaaaaaagaaagaaataaactgactttttcaactaaaatctttcttgggggatatggtgtcattaagattttgctatgggagaatgtctttctacctctccttcatcatagctctgtgtctccttttcaaacattttattcaccctattgaaattcccattgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggtacaggtttcttgagaaacctctccgtatgggtacattagggggaacactgctgctgaccaagcacgttgaattcaactgacctgtattatacctaactacatggggaagggataaagttgttctttatttctagtcaggctgcatgttaatattaggactttccatgggcatttgagagtttgtagacaaacatttgtagttaaagatacatatgggcatgcaggttagtgccaaaggaaaattttctgaaagaaactcagtaacatgggttttgtttcaggttgatgtcgagcaacatactttggccaaatacctgatggaactaactatgttggactatgacatggtgcactttcctccttctcaaattgcagcaggagctttttgcttagcactgaaaattctggataatggtgaatgggtaagctgtgtcccacagaactcctaagcttttaaattttaaagagtgactaaatacagaacttttgttattaaaaggcaattcaagtggttcataaatatgggatctactgaaggaatagttaaaaaagatgtcttagaatgtttccacatctttttgtttttgagacaaggtctcgctctgtcactcaggctggagtgcagtggtgcagtcttggcccactgcaacatcagcctccagagtagctgggattacaggtgtctgtctagtttttaaatttttttcatgtcagatgggtaatatgcccacattgtaacaaggtttgagggtggcacgtttcacatgttcacatgaacaccaaatcatcacacttatgaactacaaaagagtcgcccaccagcctgggcaacatagcaaatcctcatct

SEQ ID NO: 115730 - DNA, 1608 bp, Homo sapiens
gggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaggtatcttttttaaaaagttagtttactgcttccttaggctctttctaaatcccacccacctgaaggacatcaattatggatttatccttcatgccttgtataaatacagatgtgcatatgaatttttatgggttttttaaaaatgtggttcattctatatacataacaattactttcaacatacataagcctacctgtatttgtgcattatattacatggtacagataaatagtcatgtgccccatgaacattttggtcaaagatagattacagatacaatggtggtcccataagattatgatgccatatttttactgtacctcttcttgtgcctagatacacaaatactgacttgtgttataattgcctgcagtattcaata

SEQ ID NO: 115731 - DNA, 1128 bp, Homo sapiens
acgctgaggcaggagaatcacttgaacccctgggaggcggaggctgcagtgagccgagattgtaccactgcactccagcctaggcaacagtgagactccatctcaaaaaataataataaaataaatgtttatatgtttcatttttgtaatttaagagggaaaaatatatgtatttcctacctattttggcaacccaaaataagccctcattacatgatgccacttgaaacatctgtagacagctgttattgtcatacagaaatacctggaacatttcactaagggcattgctaagtacgaaattaaaatattgttattttgcaccagggaagtcattttcagatcgtaataaagttgcaacctaaaatgctgcttattaaaatttttctcttgactaaaataaccaagaagtgatctgcttcataatttttcaagatccttgtttatagaggtattatatatggtatattattttatttttaacctaacagaattaaaacaagcttcagaaagtaagcttttagaaatacagactgaaaagaacaaacagaagattgatttggacagtatggaaaactcagagaggataaagatcatacgacaaaacctacagatggagataaaaattactactgttattcaacatgtgttccaggtaacatttatataaactagcaagagttttaatcttgttgcccaggctggagtgaagtggctcgatctcagctcattgcaaactccgcctcctggttcaagcaattctcctgtctcagcctcctgagtagctgggattacaggcgtccaccaccatgcccggctaattttttaatttttagtagagacggggtttcaccatgttggctaggctggtctcaaacccctcaccttaggtgatccgtctgcctcagcctcccaaagtgctgggattacaggcatgagccactgcgcctggccaactatttgatgatgctatcatacagtattgacttaactttcagctagtttttgatcttgatgaaataattcaatgtttaatattggtctgtttgtatatatctggaatgtgtgtatacttaatgtttaaggtcttgatttttcttttttcttttttcagacgcagtcttgctc

SEQ ID NO: 115732 - DNA, 1045 bp, Homo sapiens
gcgcccgccaccacgcccggctaatttttgtatttttagtagagacagggttttacaatgttggccagtctggtgtcgaactcctgacctcaagtgatccgcccgcctcagcctcccaaagtgctggcattacaggcgtgagccatagcgccccgcccgtaatgtaattttgggggaaagatatgagtggcttacatttcaaatatttctgaatttttgagttatctcaacttgaagcaaaggcccagcagttcgatatcaggagtaataaacggtaaagaaaacagaaacaaattacaatcaagcaatgccaatcagcaagagagtgtgacatggccctttttaagccagagtaaactcttgtgagcttgccactaactcccattttaacgaaattattcattttaggaaaccgcaaggttttttttttgtttttctttaatttttttaatctttgcaagagctgtcagataagaaggttgtattatttatttggttccagataaaattttgaactatatcgaaattatagactggctttctggaaaggaaatggtcctagacaatttataggctaatgagcagagacccaccttaacaaaattttgtccccaaaacgaaacaatagaacacacgtgggtggatcctagtagggagaaggggtgggcggggtcaggcacagggggcggagccagccccacggcggaggagagcccagtccggtctccgcctccgtgacgtcccgggaagcaccgcccacagctgcccgggactccagtgatcgccgcggctcgctcgcgccccggaaactgccccttctcgggggtcatgatgggcagcaagatggcgtctgctagtagggtcgttcaggtaaagcaatttgtcgcgtttccgcatcttgggcggtagggacggtgctgactatggcgacggcgtcggggagtaaaggcggtggcagaggcagagcggtgaccgcgcctctgcggagggccagtgacggcgcccgcgggtgtgtgtgaggatgggactttgagcctgttggacc

SEQ ID NO: 115733 - DNA, 1030 bp, Homo sapiens
cgggaatggtcgggcaactggccccgcgtactgcgtcctcgccggagcgggttctccccaacctctccaagcgtctggctacaggccagatgagggaaatagaaaagtaaacttaagtttaattagtatgtgtgtgtgtatattaatgtgtgtgtgtgtgtgtgtgtgtgtgtgtataagcgttggtttcacaagcctattttcccctggtttagatagacagctaaagtaactttgttaatccacctatcagctactaactcctgatagcctttttatttgtttcttcagctgtggttctaacttaggtaaaattattatataagtggaacacaacctccacttttgtggttggtttacatagtctttgaaccctgaaactatattattttataattgacttttatctttgatatgagaagtacattccgctttatataagtacatctcttaaaagacctttttctaaattcctgaaattgttgtctgaatgataatcctagatcccagtctttggtcccattgcaatgaatgatccttacttattcagtaggtagttactgagcatcaactagttaaagattctgtaaggactgagagactgacaaaggtctgttatccataatatataaccatatgtatcaataatatataacaatttaaaaatgggtaaaagacttggcgtgttgcacaaaagatacccaaatgagcaatgaacattttaaaaggtgctcaatatcattacttgccaggaaaataaaaattaaaaccatgaggtcctacacatccaccaaaatgactaaaatttagacgtcagtggtgatgagaatgtgaagcgtctgaaaccctcaatattgctggtgggaatataaaatgttatagccactttggaaagctgtcagtctctaatagttaagcatgtatctaccgtatgacccagcaattctactcataggtttattgcccaagagaagtgaatgcacatactgtctctgtacgtaaatgttcacagaaaaaaaagagttactag

SEQ ID NO: 115734 - DNA, 1483 bp, Homo sapiens
cttcataaagggactggactaagaatactcttgaccagcccgtaagaacttggcactcgtctcagtaatctgagatagcagggtttggcgtccatagcaaccacggcgacaggacgcgctcgagcaagaaccaaaaagcgagaacaggtacaaggccaaactttctacattcacagacacctaccaaaccccgaacatggaacaccaaattagaacgctgaccagttcctggtaatgtagaaaacacccaagttaaaacggcaacagagtgacacagcagccattgaagatgccccacttcaggcaccgacaggcgtcacgtgacgggtggggaacgccaaccgcctgggcctagcgcagcttcctccgcccaccacggaagtgaggcggggatactaaagcgacggagcccggtggacggaagtgggtgttggaggctttaaggtagctttaaattcgtgttgtcctgggagctcgcccttttcggctggagtcgggctttacggcgccggatggctctggacgtgaagtctcgggcaaagcgttatgagaagctggacttccttggggagggacaggtgaggctctctggaaggacggggagggccccaagcggacagccccgcgccgcctccacctttgcgggttttcccgtggaggccagaggtctggcttggctgctcgttctcgttgggggaaaccgtccagacgcacttgctgcccattctttacatcctgggggtgaatccctgaggggcctctccttgctgaagagtagcctggagctggacggagactgacccgccacgtttccagccgccgcgagtctgctcaggaactctgggctctttgcttcgcgaaatgtaaaaatgcaaaaaggcaaacacaaaaactcccataaacttatgttatttctatttttctttctagtttgccaccgtttacaaggccagagataagaacaccaaccaaattgtcgccattaagaaagtgagttacctttttatgttgtttttaagtctccttgaagatgtctgtattattaattgactgatagccattttattagtcttgaccatactctgataatgagttactcatgtcattttcagagacaaaataattaattagtgctttgtgttcccaaacggaactctagggttgaacccgttttaatttctattgaaatgaagaagaagctgtatgttatttttactgcataaattcatatgttgtgggcaagtactgcccatcttttcggtcctcagaactattggataccatgatctttctaggtcactgtttatacctcacctgcatccactcagtgtgtcgtatctgtattttctgtgtacggatttaccatgaaagactttcactagcatgaacaacattgatgtgaggtctaaaatgagttcagtagcttcttatattcattcaaaagacctgggtcggattcagtagcttcttatattcattcaaa

SEQ ID NO: 115735 - DNA, 1034 bp, Homo sapiens
tgatttggaatgtttctctgaatatccagtaagtaaaaatcaccaaatactccttctctatgctgagtctatctttactcttcggggaccctgcagtaactctatccagaaccattactaacttattaattcatactttgctcgtttcttcagtgagaatgaaaactttatgctgggcatggtggctcaagcctgtaatcccagcactttgggaggccgaggtgggaggatagcttgaggccaggagtttgagagaagcctgagcaacacagccagacctcatctctacaaaaaataaaacattaaccacaagtggtggcacatgtttacagccctagctactcaagaggctgaggtgggagaactgcttgagtacctaagtttgaggctgcagtgagctacgattgtgtctcagtactccagcctgggtgacagagcaagaccctgtctttttaaaaaaaaaaaaaaaaaaaaaaaaaaaaaaggagaaaacttttcctatctgtcagattacatgaaatacttaccatctttagcttctgatctatgtccaagtttgatctggtagaaacggaaaaaaacccaaatatattaaaaatgtgttaaattatttagaatcaatgaataatgtgtaaatacttcaaatacttcgccacagaaaaaaaaacaattagcaaccaatatgtacctactaggcaaaaagagagtaggaatcatgatcagaaagataaaattaacaatataagagagaatcaaatacctacccttgtcccttaagtttctgaactacacattcaaataataaaattaagaaaaatctattttaccttttcaaggttcaatgtggaccaaataactaagggtaccctgattaaaaataaatacgtaacttcaaattaggctacttgggaggaaagatacagaaaataacatgctgtagagttggtaataagcccaataatatgctcttagacaccacatttttcaaaaagcaaaattacaaattgtgatggttaaaatgttgttactctgaa

SEQ ID NO: 115736 - DNA, 1064 bp, Homo sapiens
tttttttttaaaaagacagggtcttgctctgtcacccaggctggagtactgagacacaatcgtagctcactgcagcctcaaacttaggtactcaagcagttctcccacctcagcctcttgagtagctagggctgtaaacatgtgccaccacttgtggttaatgttttattttttgtagagatgaggtctggctgtgttgctcaggcttctctcaaactcctggcctcaagctatcctcccacctcggcctcccaaagtgctgggattacaggcttgagccaccatgcccagcataaagttttcattctcactgaagaaacgagcaaagtatgaattaataagttagtaatggttctggatagagttactgcagggtccccgaagagtaaagatagactcagcatagagaaggagtatttggtgatttttacttactggatattcagagaaacattccaaatcacccacataaatggaaggcagcaagcttaattagtttgtctttctgtcttcattactgttttaggtgttacaagccattgttttttctgtttctgagtttctaattactttgaaaattcaggatacattttcatgaaagtacataaagcttactatggaatagatacatgaggaaattatttcattaaactttcttccaaagtcttatttattaggattcatcataaaatagctcttacaaaagagacccattgtctgtgtaagtgccaatactatatcttatttttattttgtttattttttttgagacagagtcatgctctgttgcccaggctggagtgcagtatcgcaatctcggctcactgcaacctctacctcccgggttcaagcgattctcctgcctcagcttcctgagtagctaggattacaggtgcacaccaccatgcccagccaattttttgtatttttagtagagatggggttttgccaccttggccaggctggtctcgatctcctggcctcaagtgatctgcccacctaggcctcccaaagtgctgggattacgagccaccgcgcccggcctgtatctaatttttaatttt

SEQ ID NO: 115737 - DNA, 1100 bp, Homo sapiens
gtgtgtgtgtgtgtgtgtgtgtgtgtgtgtatgtgtgtgtggtgttttgttttgagacggaatctggcactgtcgcccaggctggagtgcaatggcgcgatctctgctcactgcaacctctgcctcccgggttcaagcaattctcctgcctcagcctcccaagtagctgggattacaggcgcccaccaccatgcctggttaattttttgtatttttagtagagacgggtttcactatgttggccaggctggtctcaaactcctgacctcgtgatccgcccgcctcggcctcccaaagtgctgggattacaggcgtgagccaccacacccggcctgaaaaggttttaagagaggatggaagaaaaggaattggagacagtaagaatagacaattctttgaactgggcagagaatgaggaggcacctattaggggaggtagggtccagagaagtttaagactggaaaaatactggtatgtttgtacattgttgggaaaagtctagtagaaaacaaaagactgctgtaggagaaaaaggagagaactgcaagagtattatatttaaaacttcatgaaagagtatggtatctagtccttaaagtaagggattgcctttaaaaacagaaaacagacaaggatcgttcatccctagagatagaagtgctttgataatttcatgctaaaatgatactaattctttttgttctttaggtggtatcgggcccccgagttactatttggagctaggatgtatggtgtaggtgtggacatgtgggctgttggctgtatattagcagagttacttctaagggtaagtctaaattaatgtacgcactttaatattgttgttgcagttatttgttctgacagtttgtataagaattcttgtcctaggccaggcatggtggctcacgcctgtaatcccagcactttgggaggccgaggcaggtggatcacttgaggtcaggagttcgaagccagcctggccaacatggtgaaaccccatctctactaaaaatagaaaaattagctgggcatggtggcgggtgcctgtagtcccagctactcgggaggctgagacaggagaatcgcttgaacctgg

SEQ ID NO: 115738 - DNA, 2122 bp, Homo sapiens
taccttcagtttatatgtataagctgtatatgaaacataagtttcatttttaatcttggcttccatccccaaggtacgtcatgtatatgcaaatattccacagtccaaaatctgaagcacttctggtcccaagcattttagataagatatattcagcctgtataggctatttaattatggaaaaattagaagggagtctttttttcttttctttttttgatacggagccttgctctgtcgcccaggctggagtgcagtggtgcgatctcggctcactgcaacctctgcctctgggttcaagcgattctcctacctcagcctcccgagtagtggggactacagacatgcaccaccacgcccagcttatttttgtatttttagtagagatggagtttcgccacgttggccaagctgatctcgaacttctgacctcatgtgatccacccgcctcagcctcccaaggtgctgggattacaggcatgagctactgtgcccggccagtcttttaatggaattatcagccaatcttaggatcctaggtatttatttgtagtaatttccatttgcaaatacttgacattaattttgttttgttgggaatgagggcattcacatagtatttttaatgctccctataatcttgaaggtaagattttccttaacacatttcagatactcacctaccttacttttggtatcttttcttttaaaaggcactgaaaatgaagtatttcagtaatcggccagggccaacacctggatgtcagctgccaagaccaaactgtccagtggaaaccttaaaggagcaatcaaatccagctttggcaataaaaaggaaaagaacagaggccttagaacaaggtaagattcccacttttaaaagaaattaaatgaatttagaaaactccaaatagctcgtgtatggctagcgactgaacaacagcaaagaaatgtagcttgctagctatttaatttttataaatttaattgtataaagtagagagactgtgccgttttaggtatgtttactttcattgtgaatacttcggcagcttttgtgtatacctcagaattatgggaactatgtatgtgtaccttgttcccttcataaattccttctgtaaactacatgctaaatgtttaacaagtgctactggaaaaaatgtgtcagtgaaataatgtagttggaatgcagtgactggttaaaattgctatgagaatgtgaactttgttaaatgtgaacaacttttttttttcttgttctttttgcttcctaggaggattgcccaagaaactaattttttaaagagaacactggacaacattttactactgagggaaatagccaaaaaggcaaataatggaaaaatagtaaacattaagtaaatgctgtagaagtgagtttgtaaatattctacacatgtaaaatatgtaaaactatgggttatttttattaaatgtattttaaaataaaaatttaattctggtttttctgattagagtgcaaaagtgagaaaagttcaatactcttgaaatgtagaattgaaaatgcattagggaaaacttaataaaaattattaccagttatttggaagatctgacccatatagtatcacaaatctgtagtagcatgggtagtgtttaaaaataaaaatgttggccgggcgcggtggctcacgcctgtattcccagcactttgggaggccgaggcgggcggatcacaggtcaggagatcgagaccatcctggctaacacggtgaaaccccgtctctactaaaaatacaaaaaaaattagctgggcgtggtggtgggcgcctgtagtcccagctactcaggaggctgaggcaggagaatggcgagaacccgggaggcagagcttgcagtgagccaagatggcgccactgtactccagcctgggtgacagggcaagacacagtctcaaaaaaaaaaaaaatgtagtagtggtgtagtaaatactacccaaacttaacaaatattaatatacggaatgtactaaaaaaagaaaacattacagataaaattgagattccccccaaccttttttctgaggcgggggacaaagtctcactctgtcactcaggttggagtgcaggggcacaat

SEQ ID NO: 115739 - DNA, 1033 bp, Homo sapiens
tcaccatgttggccaggctggcctctaattcctgacctgaagtgatctgcccacctcggcttcccaaagtgctgggattacaggcatgagccactacacctggccagaggttccctcttaaaaattcactttattttatttttttttgagatggagtctcgctctgtcacccaggctggagtgcagtggtgcgatcttggctcactgcaacctccacctcctggattcaagcagttctcctgcctcagcctcccaagtagctggggttacaggtatgtgccaccacgcctggctaattttttttttttttgtatttttagtagagatggggtttcaccatattggccaggctggtctcgaactcctgaccttttcatccacctgccttgacctcccaaagtgctgggattacaggtgtgagccaccgcgcccagccaatacttcactttatttctattttttccttttcactttccccagagggaaatgactctatgaaattggtgtgtatctttccatgattttatgctagtattctgtaagagtgcatgtagtgagatgcataacaatgtacagcattgttttgggtctcaaaattgtatataaattgatagaatctctctctcctttttttttttttttttttgtgagatagtctctgttgcccaggttggagtgtagtagtgcaatcatggctcactgcagcttcgaactcctgggctcaagccatccttccacctctgtccccagtagctgggactacaggtgcataccaccatgcctggttaattttttttttttttttaatgagacagagtcttgctctgttgcccaggctggagtgcagtggtgcaatctcagctcactgtaacctctgcatcctggggttcaggtgatcctcctaccttagcctcccaagtagctgggattacaaatgtgtaccaccatgcccagctaattaaagtaacacaaatgtattagctcacagttctgtaggccatatatctggctcagctgtgttttctgcttaggg

SEQ ID NO: 115740 - DNA, 1018 bp, Homo sapiens
tagtttaccatttgaactgtttttaagtggtattaagtatattcacattgtaatgtaaccttcatcaccatccagctccagaacattttcatctttctttacagagaccctgtcccatgaaacagtaactcctcacttccccttctccagcccgtgtgatttattatttaatggcacagttccctgagaagaaggtaatgctattctcattttagagatgaggaaatcaagctgagaaaagtcacccgaggtcatacagttagtaagtggctgaatgaggattcaagtccaggtctttgctgttcggaagcagagtttgcatggctcagaggccccctgtggcctgcagacatgttttgttaggttggcttagtgtagtcaaacaataagactagtggctgacatttagaattggaagatgtcatgacagatctgcatttctggctgctcttgaagactgtgatgatccagtgacatggactgtgttcttgtgtggcctgtgtgtcagctggcacagaggggtggctgtgccgcatggcagggcggcactcttgctgcctctcacctgcattgctcctggctctgaaggctgtgctctgctcactacattccactgtgtgctcctggactcacttgtcctagagatcaagttacctcttttgctggaagtatatcagtgaggatattttaatgtctcagctggattctcatgttcaattttaggatttccatcaccaaggagtaagaagaccttcgggcagagactgttgggtatgctcccttcagaaaacagttctaagaggatggaagaccaggacagtcctcaagaggtccttaagatgctcatagatttggttagtgtctttgcttttttttgcaggttatggttaagccaagcttgtccaacccacggtccgtggggagcatgcagcccagaacagctttgaatgtggcccaacacaaattcgtaaactttcttaaaacattatgagatctttttgatatatatatatatttt

SEQ ID NO: 115741 - DNA, 1084 bp, Homo sapiens
tcacaaaggcttgccctccagggagatgatggcactgccccccagcttctctgccagggtgcagtggtccttgacctcctcatagtagtttgcttgtaattcttgcttgattcctgtcagcttcttgttgatggcgtccttggagctggcattgatcattttgctcttaaggggcacagactcagtggcccagaagataaacaccaggtcctccttcttgctctcttggtctcataggttgcgtcatagagggcgtagaggcaatccttatccggtagcatcttgacaaaggtggcataggggttgtcgatggtctggtccacattgcccaccagtatctccttgccctccccttcaggatgatgttcttcttgtcttcactcaggcggaagagcaccgccttcttgcgcttcttcaacttctctggtgttgaagacttacacaacttcatgtcgttgaacaccttgatgacaccatcagagacagccacaacagaggccatgtttccagaagcaaaaaggagagggcatggagagctgcagaagacgagagcactgcagccgctgctgggacccagctaaactgataatttttatattagccagagtacctacctctaaagtttcattaagacattgccttaattcttcatttgacaattctgaattcgaatctacttgggagggaggagaaaagaatctattaggggaaaaattttgaatattttaactaattaaacataggacatttgtttacaaattaccaaatacaggtatcccctaaattgcaaagagaagagaattataatagaacaccaggtgcggtggctcacatctgtaatcccagcactctgggaggccgaggcgggcagatcacttgaggtcaggagttcaaggccagcctggccaacatggtaaaaccctgtctctactaaaaatacaaaaattagctgggcgtggtggtgcctgcctgtagtcccagttacttgagaggctgaggcaggagaatcacttgaacccgggacatggaggttgcagtgagcggagatcgtgccactgtattccagcctgggtgatagagtaac

SEQ ID NO: 115742 - DNA, 1058 bp, Homo sapiens
acagacatgagccaccattcccagcctgaagttaagtttaagaaacagtaggcagggataaaaaacaaacaaaacaacaacaaaacctcattatattcaactctgaatagcaggaaggcgtacccatgatgcctgaatttatgtggtgcattgaaaaatattcttagctaactctacaattgcttactctttccttttacagcttttcccccttatattgaccaattccattttcttctctgctgcctgcctaatcctgaccacacccttcttaacacaggccagaggttgcccttaacaagcaggagtctactgcactagaggtaaaacacagcctctcaagggattattctttgattcaataaatatcttcttatctaccttgacaaaataggtaaatctcctttttaaggaaataatcttgtaaaagaaccaagatgattttataaaaatctgggaaaaagtggatccagaatctgttagatgttgctcaaactagatattttagacttttactttaagttctatttgaagtcataaataatagaaacttggtatactctgatgttaatttcattgaaattctccaaataatacaaaacagtggctaagagtgttggctctgacatcagatatctggattaaaaatctgtctctgggccaggggtggtagctcatgcctgtaatcccaggactttgggaggctgaggtggaaggatcccgtgaggtcaaaagttcaagactggctggcccgagaccctgtttctacaaaatgaattaaaaattagcctggcaaggtggtacacatctgtagtcccagctactttggagactgaggtgggagaatcacttgagcctaagaggtcgaggctgcagtgagctgtggatgccatcactgcacttcagcctaagcaatgagcaacagagtgagatgctgtctctcttttttttttttttttttttttttttgagacagagggttttgctttttcacccaggttggagtgcagtgacacgatcttggctcaccgcaacatccaccttctggtttcaagtga

SEQ ID NO: 115743 - DNA, 1120 bp, Homo sapiens
aattttgatttgcatttcctatacagctagagatgctgaacatcttttcatgtccttattagacagttgtgtatcttccttggagaaatatttactcagattctttgcttaagttttaattgggttacaaatctttttattactaagttatgagattttgctaatttactaattcattgggaatttattgagtagctgacaaattgtgggggggggaaattcaaacaaacctagatgctggtttggtgatctttagtttcaccctagtgtcaagaaactgtgtcatataaacaggtaccagtcactcctctctaggtgaagagaccatttctgtaatttttcacgtattgaaaagtgtccagtttctggtatgtttctgaaactccagttaatgccatttattttgcttcttgtttgcttaacctccctgccttctaggggttataatgagaagaaactaacagacaatattcagtgtgagatttttcaagttctttatgaagaagccacagcatcctacaaggaagaaatcgtgcatcagctgcccagtaataaaccagaagagctagaaaataatgtagatcagatcttgaaatggattgagcagtggatcaaagatcataactcttgacttataaggctagctacttaataatcactcttgttgatatctctgccgacatcatagaaattgttcaagtgtcagtaacactttattaaaatcatgttgcagaaccagcaggtggatagtatataggtttatgcctgtgtttctttttctccatgagaaagctaaacatgaaatataatgaatatagtattattaaggattgagacaaaaactgtgattttaatacttaaattgctaaagaataaataaatctgacaaaatgggtggatatcttttaagtttattacagaaaaaaatgcagatgatctcttaaaataaaactaaagataaagcaacagagtattccttttttctttctttaaattagaaaaaaagttaagtgttgtactcgatacaaagttcaaaaggtacaaaagagcatgttgaaaagttaggtctcccttccagaccaccctatccccaggcaccccaggttccttccctttagga

SEQ ID NO: 115744 - DNA, 1276 bp, Homo sapiens
gagatcctcctacctcgtatgggctgggattacaagcgcaaagccaccatgcctggcctgttactgcttttgataaattaatctgcttttaaatgtatgtgagtgtgtttgtatctgttcaggtgtttcctcttcccgccaatctgtagttcaacaaaaatagtgtagtcctcttctagtagccccacaaattctgaagttggttattcactctttttagttggtttcagttttgatatttaaagcagtttcagatatattgcaatccaagtttccctctaaacaaaattccaatttatcagttagtatggctcctttatatttggtgtttatgtaacatttattttgttagtatccacccttgtatctaaaagaataattgatgatacatttcctttcctgaagtctagaattaattgaaaattacttaaagttacttagaaaatatttcaacaagcaattctaaatctcttttagagcaattgtatgatggctatgatgaagagtatgactgtcccattttagatgaagacagagtaagtatgactttttcataaagtatgcatttgttgaatttcataggaaagttgacttcagttttcttaagaagcatttttttttaaacttttcttacaggtagttgatgagttagataaccaaatgagagaaggtggagttattgttgattaccatggttgtgatttcttccctgaacgctggtttcatatagtttttgtgctgagaacagataccaatgtattgtacgaaagacttgaaacaaggtaagaaaggaaaaacattagattcttaaagcataatgttaacttttattcagatttctgaaattggccatgataaaagattgttgttgtttgttttgttttgttttgttttgtttttttgagatagagtctcgctgtcacccaggctggagggcagtggtgtgatctcggtccactgcaacctccacctccctggttcaagcaattcttgtgcctcagcctcctgactaacagaccacgggcacatgccaccttgcctggctaatttttttattttttgtagagatggggtctcccatgttgcccagactggtctcgaactcttgggctccagcaatctgcccacctcagcctcccaaagtgctgaggctacaggtgtgagtcatagcacccagctaataaagggttttatttgaaaatatgactactttaaaatatgggcagtactttttgagtaaattaatatctcaactgacaatctgattgagtaaaat

SEQ ID NO: 115745 - DNA, 2613 bp, Homo sapiens
cactttaggaggccgaggctggcagatcacctgaggttaggagtttgagaccagcctggccaatatggtgaaacccggtctctactgaaaatacaaaaattagctgggtatggtggtgggcacctgtaattccagctactgaggagactgaggcaggagaatcgcttgaacctgggaggtggaggttgcagtgagccaagattgtgccactgcactccagcctgggcgacaagagtgaaactctgtctcaaaaaaaaaattttacatatgattgctaattaggaaatttttcatttcagtcgtcaagaacttttaagggcagaggccaggtgagactctgtctcaaaaataaaaggaaaggcagaaggtggaccgcagtgtgataagtagtatttcacaaacagtatttttctgtggcttgtcttacaggtacaccaggggttggaaaaaccacactaggcaaagaacttgcgtcaaaatcaggactgaaatacattaatgtgggtgatttagctcgagaaggtaagggacactttggtgttagatttgttttgttttttttttaaggtctggtaagtggagtgttagtgctgggtattgtcatagggtacaaaaaacagagattgccattaaagaatatatactctgttagggaatccacagaaatattaagtgtctaatgctatgtcctggttattttgaccattttcccttccgccttcaaaatggctggcaattcttgtgaatagttgggaaggctcctataaagagactggatttcggataggtagaatgtgaataaggagaatgtttttaagttgaacaaacaaaggtttggtactgctaaacatatatatgagcacagtgagtatattggtctcactggaaagagactgttttgagctcaggtgtgggacctgactatgctatggtatcttagattagtgtgagatttgcatgcaactgcatatattctaagatgatcattgtttttatttattttaccctgttttcccctaatctttcatcgctcccttatttgtgtcttcatctttttatagtcgacaatgatttgtacatggtaggaactcaataaattaaagcgaccttaagttgcctcattaaaattaagaaaacatatggtttaaattttaaaaatttttttacagtttaacatagatttaaaatttttttaagttcctgacagttgctactaaagtaactatttcagattgatctaatgtacatatttttttcaaatgatctaaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgattgttggtgctttggcagttatgtttttaaaagcaattttctccttgttgtcaccaagaggagtaacagttggcagttgcagcaatttgcagtactgcagtctatttttgaccactagagtgtcaccttaaacgtcttcagatacatagatcatagtatgatctctggtgtgtacgtcactcttgtgatctgttctctcagattgctgaagtataaccatgactcccctttggagagaccagttggtcaggatttttattcatagtgaattcttaacctgctttgattatcttcctcaattgcccaacttcctaggtcccatttttctgtc

SEQ ID NO: 115746 - DNA, 1100 bp, Homo sapiens
tgggtgaaagagcaagactcgtctcaaaaaaaaaaaaagaataaattttatgagttcaggtaacctctaaaaatctttgtttcagacatcacctccctaatttagccaaagtttagtatttggctactaaatagtccttgagagggacataatgcaaaaattgagaaattatcagaagcggaattgagagttgaagaattaagattctcttatttccatatttgcagatgtttttgtatggaaaaggggggaaaaaggcaatttttaaaaaagaaaaaaataaagctggtttattccagcaagcattattatgaaatttaatgtgcttatatgagacattcagcaaatatttatagaagtaaatatatttagaatgaaaagtcagaaataatattctagcattccagtgattttggtttttaattcatatttgtatttgattttagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactggtaagatttgctgtgaaggtagtagaagtagtggggcaaacctgtgcttaagggagctttcagataaagttctatgagtgcattttttcccatacttcttgctttcagagggatggaatttcacaggccaggtgcgatggctgtcacatgggaggctgaggcaggaggattgcttcaggccaggagttaaagaccaggctgggcaacatacaaagaacctgtctacaaaaataaaaaaatcagctaggtatagtgttgtgtacctgtagttctaactactcaagggctgaggtgtgaggatcacttgagcccatgagttcaaggttgcagtgagctatagtgttaccatcgtgctccagcctgggcaacagaatgagacattgtctcaaaaaataaataaataaaagttatttcaggagaaggaaagaaagcatgtctccaatggaagacaatggaattttttgaagattaagtcttaactgttttgttaacatatt

SEQ ID NO: 115747 - DNA, 1075 bp, Homo sapiens
gaaaaaaacctgatagggtttttgaaaatcaagaggtccaagctattggtggcaaagatgtttctctgtttctcttcagagctttggggaaaattctatattgtaaaagtaagaaatttttacacttttaaaatctgttggatatcacatagtcttaaaatggaaataaaatgtcacttttaaaaaaatgtcatgtattttggttctgctctaagagttagagctaggtcagatactgtttgcctaggcctaagacatagtaggaaatcagaatattttctgaccgtaagcaggattaaaagtaaaaacatgcaattgcaggccatatccatgtgtgtaaatctttaaaattatagtttgctgaaggtaagagagcagatcatctagacttgtagtggcaagtgttggtagcctaaagccctcttaacactgggctccagccaacagagccttatacaaattaccaggtagtttaaggtttctttcaatcgtcttgtatttctctaatttacaagcgttctgtctccccaaccagagatgtttatcgccttttctgtcttttttgatgactgctccccctcagttctttcactccctattgcccattttagtgtcccaaataatccctccttttgatagcaaatgcctgttttcagtctgatgaccctaaaggaaagaaattaggatttctaaatggaaaccttcataccatctgaggaaaatgggcatcacttaggtggcagtgaggacactcctctgtcactggatcctcttactttgaacctgagtgactattcccacctgattcttttctttctctcctttcttttcctccccaacatacgtttatcgtctcttgcattagtgaatggaattcgtattctttcatgtagagagcaacatcttcctacatagtaaataaaagagtaaagaccactgtattgagatgagaaatcaagggaagaaagcaacccaaagctgaaaaaggtgaaatgggagtgcattaggaaatggaatattttaagtctagagaagccataatctaagcatcagaattgttaatttagttcttgct

SEQ ID NO: 115748 - DNA, 1792 bp, Homo sapiens
ttgttgtggtttggtttggtttttttgtttgtttgttttttgtttggagacagagtcttgctctgtcgtacaggctggagttcagtggcacgagcttggctcactgcagcttctgcctcctgggttcaaacaattctcctgcctcagcctcctgagtagctgggattacagatgcgtgccaccacgcctggctaatttttctattttcaatagagatgggtttttgccatgttggccaggctggtcttgaactcctggcctcaagtgatctgcctgccttggcctcccacagtgcagatagtacaggcatgagccatcgtgttcagctcctttttgtattttaagttgtaggaacttattcagtttgtcatttaccttgtagttttgtttttatagttaaagggactagctaaacagcacaatgtaggtaaatgaaagatggcttcataatcatcacactcatggtgtaatttaaaaatcttctcctttggttcttattaatgcctgcactgtgaatctgacagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaattttgtttctcctgtcttttaacattatctagcacgcactcgctgccatgggtccttaagcacagtgcaccaatctccctcccccagtgtcaaacttttcaaaagatagggaagaggatggcaacgttgcgatgagaactgtaaactctttccaaaagagcccagtgtgtggtcattgccgcgacgtgccggctggtggcaccgagcagcctgggcccagagcggttgtcgggccgacagatccgggcggggcaaagccgggcggggaaagctgggctcgtcccgtcccggccccgcccccaccccgggagcccgataccggtttcagagtcctgggcagcgtgcgcgctcttcctggcggctgcgcaggtaagtgggaccggggtggggccacgtgaccgggagaggagggcccggcggcccccggcccaggtgtgctgcgacggacggctgcccgcgctcggcgctcagcctgccatagcccgcgggggaggccg

SEQ ID NO: 115749 - DNA, 1534 bp, Homo sapiens
caactcctgcaaagatccctacggagggtcagaaggaacctttagttcccggaaagaggctgacgcagtgtttccccgggatccctatggatctctagaccgacacacacaaacagttcgaacatacagtgagaaggtggaggagtataacctgagatactcctacatgaagtcgtgggcaggcctgctgagaatactgggtgtggtggagctgcttttgggggccggtgtctttgcttgtgtcacagcttacattcacaaggacagtgagtggtacaacttgtttggatattcacaaccgtatggcatgggaggcgttggtggattgggcagtatgtatgggggctattactacactggccctaagaccccttttgtactcgtggttgctggattagcttggatcaccaccattattattctggttcttggcatgtccatgtattaccggaccattcttctggactctaattggtggcccctaactgaatttggaattaacgttgccttgtttattttgtatatggccgcagccatagtctatgtgaatgataccaaccgaggtggcctctgctactatccgttatttaatacaccagtgaatgcagtgttctgccgggtagaaggaggacagatagctgcaatgatcttcctgtttgtcaccatgatagtttatctcattagtgctttggtttgcctaaagttatggaggcatgaggcagctcggagacatagagaatatatggaacaacaggaggtaagtgatttcataatccctcatttgtgtgtgtatgtttgttttttctgttatttgctcccttgttaaaaaatgtatagcgctcaaaacagaaagctttcatagaaatcttttctttcttcctttttttttttttcaatggtctgagattcaaaagtcctagtgcaatatctgacatgctttgactgggataacccactctggtgtttggctgttacataacattgcaagtagacaccagatgtgtaatatatagtttgttggctgcattattatgtctgtctgaagcttaagggaaagatacagctaccgaatttttgcaaagaagaagagtgtactcagtaaaataagtgtctcatcattaagtttgagaacaatcttaattctttaataaaagctcctaatttttcatttaaatgttacaatttactttctcccagtgagttgaataaagccaaataagaatgtggtaaaccatgtttgattttttttaagtattgagagattgaattgtaatgaacatactctgaaaacttgcccagtggttttgataatttgtctttatttgaggaagacgtatggtccaaaatgagaatggaagtcctacattgtttttatatttctagaacttaataggataataatgagaataaataataatgagaacaataagaagaataaaataataataactgaaggatgagataaaagccctacctaaaattattttggttgaacagtagcaaatgttagagtatgttccactggctacattat

SEQ ID NO: 115750 - DNA, 1021 bp, Homo sapiens
gataaccaccttatgatgaatgcagttgcccattttcttgaagactttttcttgtggtttttttctttcttttttttttgagccggagtctcgctccgtcgccaggctggagtgcagtggcgtgacctcagctcactgcaacctcctcctcctggattcaagcgattctcctgcctcagcctcctgagtagctggggctacaggcgcgcgccaccaagcccagctaatttttgtatttttttagtagagacagggtttcactatgttgaccaggatggtcttgatctcttgacctcgtgatccacccgcctcggcctcccaaagtgctgggatcacaggcgtgaaccactgcgcccagctctttaagactttttcttatcccagtgcagaggtcaggattattcccgcatttgagtgcacttagaggagataaggaatttgtctcagattgcgagccagtaaatgggggctgttaaaaccactaggttgtttcaaactcatcattctgacattacagagatcttgcttagtgttgatggccctagccaatgggttagttatcctttccagtgtgtttggtcagctgcaaatctggataagcgtgtctcctccactttgtctgtgtttaccagtggagacctcccaccaggtggacataaatggttcattcttttgtgctaattgggtgccgtaatccagccccttgggaatctgcccacccacacaaggatgtgctcaagattttcaggattctttctctctgcattccctgaagaggaaataataaaggagaaaataaaatccaccagtttggtaaccttcccagaaaaggaaatgaagttggtgtggcatgacttgttcttaacgagctttcttttcttttttttttttttgagacggagttttgctctttttgcccaggctggagtgcaatggcgcaatactggctcactgcgaactccgcctcccaggttcaagcaattctgctacctcagcctcccaagtagctgggtttacaggc

SEQ ID NO: 115751 - DNA, 1027 bp, Homo sapiens
cgtgagccaccatgcctggcctaagtgtgtgtgtgtgtgtgtgtgtgtatttttttttttttttttttgagatggagttttgctcttgttgaacaggctggagtgcaatgtcgcgatctcagctcaccacaacctccgcctcccaggttcaaacaattctcctgcctcggcctcccgagtagctgggattacaggcatgcgccaccacacctggctaattttttttttgtatttttagtagagatggggtttctccatgttggtcaggctggtctcgaactcctgacctcaggtgatccatccacctcggcctcccaaagtgctgggattagaggcgtgagccactgtgcccggcctataatttttgatagatgattttgaattattttccagagataaaattttaaatgtttccattatatcactgatttatttctgcaaattgaataaattcttaattttctgcatgcacataatacaaaaggtattttcatagttttggatttataccaaatgaaaaggattctcttgatgagcacctttaactgatttttctgttaaagttttaacaatttgttcttggaagtcagttcgtgaaggcaagtttgtcagtattttcacaaaactattcagctgaatccagaaagtgaaacagcaagaatttgcattgtaaaattgtgttataaaattggactttgaaatttcaaaaataagaaaaattttcatgtgtatttatactaaataccgttttaggaaactaggatcagggtgtttctgttggcgttggcattaactagctggatgtaaatttgaaaagccactcaagcagcttcctagtctagaaagtcagaggtttagattagatttccgacatcccttccatttctgacctgtagttcttgtctggaattctgctttgttataaactattgttctaaggagtttgttgtgatagcacatagttcattttgtaaagattccctgcgtataaagtgatgccctacatatgtgattttgtattaaaagt

SEQ ID NO: 115752 - DNA, 1061 bp, Homo sapiens
ttattggtaccaagtttgtgtataagttcatattatttcttggaaatgagaaatggagttctatgaagatttttaagacaattattgagtaaaatacaaagaataagatgacctggcattccattttttttactttatatatgtgtctaattttcaaatttaattggatgaattttgtaacaaacatctttagataacttacattctaatggtttttacagattattgaataataaaatacagttttgaaaaaaatggatgaagaacctgaaagaactaagcgatgggaaggaggctatgaaagaacatggtaaggagagctttattgccctgtcttttcttttagacaatgtctttttttttctttacaactttattaaagtatattttacatatgttaaaattcacccatttccaatgtacaattcagtgatgttttattaataatttactgagctgtgcagccattatcataaaccagttttagaatattgtaaccactccagtaagatccttcacattcatttacaattaatttaaatcttaatttaattccacctgtgggcaatcattagtctactttttgtctccaaattttaaccttttctggacatttcacaaaaatgtgatcatatacaatcatgtgccacataatgatgttttggtcaaagacagactgcatatatgacaatggtcccataatattataatactgtatttttactctaccttttctatgtatgtttagatatacaaatactgaacattgtgttacagttgtcttaagatattcagtatagtaacgtgctgtacaggtttgtaacctaggcgtgggataggctataccatctaggtttgtgtaagtataccctgtgatattcacacaataatgaaattgcctaacaatgcatttctcagaatgtatccctgtcagtaagcgatgcatgactataatagttggtctgttgtggctggctttcacttatttttaagactcatccatgttgcagtgtgtattaatacttcattccttttttattgctgaatagtattcccatcta

SEQ ID NO: 115753 - DNA, 1398 bp, Homo sapiens
attatgacttatagggagattcttaaagaagatgaatctggatcacttaaagctacaatagaagacattctattcaaggcaaagagaaaaaggtatgtaaccttcctacgtatcttaaaaaggtaaaatatattcattttaagcctttctatctataaatactcctcagtacttcattttagctgtgtttcagggaaactgacctattgccttctgactatggggaaagaactagccacctacccttgccccagcaggaaatggtctttagagactgtctacaatacctataattatgtgtattgtattccataagttaattatttactccactaaaaatgcacgttatgacattcttaatcagaattagaaaaaaagaaaaacaaaggaggtcaattggaaagttgtatttttttttgtggggggggatagtatatggaattacattaaaatgtttgtataattttaacagagtatttgagcaccatggacaagttcgacttggaatggtatgtcattattttttcttttactagtacagaactagtttaggttagagaaacattctgtcttgctagaaaaaacaatagcaaaacaacaaagtttttaaaagaatatgttaaaaatacgtgcatagaatatgtaattattaaatgccatttttactagtcaaaatggcacttgaggctgggcacagtggctcatgcctataatcccagcactttgggaggccaaggcaggaggattgcttgagcccaggagtttgagaccaacctgggcaacagaacgagacccagtttctacaaaacaaaacaagtacttgaaattggccctttcttttttccgatagatgcgccacctttatgtggtagtagatggatcaagaacaatggaagaccaagatttaaagcctaatagactgacgtgtactttaaaggtaaaatttaagtttatactaaatcatttaaatttgtaccaaaatcacttaaacttttactaaaaaagtggggaagaacactggattctaaaggatatttttaaagaatgcaatattttttattttttgccttgtatttttagttaatgctaatgatagctaagtagaagtactgccaggttatttagggaaattttaaaccaacatagctaattatttgtgtttttaatttctatcctcccaccccacatcaggatcttggtttatcagttatcccttttctttcttgaatcttcattctcctttgccttacttaactctgtctcctcagattacaaatatgttcgtattcctaatttatcaaaacctattctcaattctgctcgttctcccatctctcttcattggatcttttcctcattgaaatttcttctgacacatccaaatggttccatctttta

SEQ ID NO: 115754 - DNA, 1022 bp, Homo sapiens
tattttgcctttatctagtatgtctttttttgtttaaacagttgttggaatactttgtagaggaatattttgatcaaaatcctattagtcaggtacgtatctaagtgatagaattcagaattagattcctattttgcttccaaatgtaatttatttttaaaaattggacatgtattttgtgaattacccaaattgtttaaccagtttctggtatacttaaaaatgaaaagcgtaataactctaaaagttaaacgtaatgtgaactcatagctaaatttatttgccaaaaacagcatgagaaaaagtttctcacctgttgcttctttcttttgtaattactagtttattttagctatataaattatttttttttctgctccaatatcatctacaggaatagttatatatattcttaatgggaggaaataacttgttatattaataataatttttgtttttatttcaagattggaataattgtaactaagagtaaaagagctgaaaaattgactgaactttcaggtatgcataaaattacctttacatgactcaaggactttgctttatttacccaacctcgtagccctgtttatatggctgcttaataagtaacgtgaagggtggttcctctgtcttctctaggtgaaacaatttaataacatctcccccaccattatattcttaggatacaaggttaactattctaaattgagttctgcatcatagtggtaaataatactacattgaatataaatgtttttatttaaattctatatgtgcttatcctgaaatttttttttctttccttttttttttttttttttttttttggagatggagtcttgctctgtcgccaggctagagtgcagtggcacaatttcggatcactgcaaagtccgcctcacgggttcaagcgattccctgcctcagcctcctgagtagctggaactacagatgcccgccaccacgccctgctaattttttgtattttagtagatacggggtttcaccatgttggccag

SEQ ID NO: 115755 - DNA, 1033 bp, Homo sapiens
ggtgctgtcttggctcactgcaacctccgcctcccgggttcaagagattctcctgcctccccctcccgagtagctgggattacaggtgtgcgctgccacacctggctaattttatttttagtagagacaggatttcaccatgctggccaggctgatctcgaactcctgacctcaggtgatctacccacctcagcctcccaaagtgttgggattacaggcatcagccaccatgcccggccccagcagttttctatggatgttagtgaagtcatgtataaagatgaaaaatattctggagattctgacaggcctcttgaagccacctttttttccctccaatcagaccactgctgtaaaccacactgacactattgtagtatgcttttttcctatacccataacacagtgggagattaaaaataattttgtagggtaggaagagaagtggatagagagccaggagatctaggtttgggtgctgctggtcctgcagttaagcaggcatatgtctttgggcaagtcatttcacttgtttagattaattttctcacttatgaagtgagggatttggactgcttagcgaggtacttttcatctctaaaatttatgaatctaaaatacttgcagtaaatattaaatattacaaatggttaatattttaaaacttactcagatgagtaaaaactcaagggagctccaagttgatgaatagacaaagaagacatgattcacacagaaaaaacccagaaattaaatcagggaaactagtaatccaaaaacactctacccaattacataacattttattttttaatatattttaaatgagcaaaattaagtttccaaagcaatatgttgcttgtggaaccacagagaaactgttatttatagtgctgatagtcttacaaattagttcaatattttttagaaaagcataaaaattgttcctgaaattatatttagggaatgttatggaaggagaatgatcactctacaaagatactctttgtaacattatgtataatagtgacag

SEQ ID NO: 115756 - DNA, 1033 bp, Homo sapiens; identical to SEQ ID NO: 115755

SEQ ID NO: 115757 - DNA, 1033 bp, Homo sapiens; identical to SEQ ID NO: 115755

SEQ ID NO: 115758 - DNA, 1033 bp, Homo sapiens; identical to SEQ ID NO: 115755

SEQ ID NO: 115759 - DNA, 1096 bp, Homo sapiens
acaggcgtgagccaccgcgcctggccttaaaaacattttaaatggcagttaaactcaccatgaagaggacaatgtacataatgcaattgaagcaacaacatatgaagacctatttgtaggttcacatatgaacaggcaaagactatgttacaagtgctgctggctaccagtaattattaaacacatgctgatttcagagatgttaaatgtgaaaatgtattggtcttaaaaatgatgaaatatggaaatattaagagtaaaaaaatgcactctaggttagcattattttaaaatatgtatgctagtctataaggagattatttgtattctgtttttcagtatgaagtgagagtgtttacaaaatattgcagataaaattccaacagaaatatacattgaaaggattctgttctttaacatcatagatatgtaaattttgagagaaacataaacttttttaatatataggattttatttaaagaccttatttctattttaggaaacccaagaaaacatataacgtctttgaaggaagctgtggatatgacctgccatggagagccatctctttataattccctaagcatggctatgcagactctaaagttagtattatacattatgtataattgaattagaagttttttaaatgagttaagttgaagtgatgtgttaatatggggcccataaacccagctataacaaaattgttaagtacgagaattatgtagtgttatttatgatgtttagtgtggtgttggttagtaatttttattttacattttagtaagatattgttaaaggttttataaaaatataatttaaaactgtcggcagtatcaatagtacaaaaataggttgatgaaaaaatattttattaaaatgagatttaatatagtataataattgtaagttggttgtacctttattaacatttattattttattttgaaagtaatggccaaaaccacaattccttttgcaccaatgtcatatatctgtaaattaatagatatggcaagttcagctatatggaatagagctaagaccccaaaggaaatacttggtatagttaaagcttatatatatatataa

SEQ ID NO: 115760 - DNA, 2223 bp, Homo sapiens
gggtcacctgaggtcagcagttcgagaccagcctggtcaacatggtgaaacaccgtctctactaacaatataaaaattagccgggtgtggtgggaggtgcctgtaatccccagctactcaggaggctgaggcaggagaatcccttgaacctgggaggtggaggttgcagtgagccaagatcacaccattgcactccagctgggcgacaagagcgaaactccatcaaaaaaaaaaagaacatccaggatttaggaatcacattaaacacttactggctagccaaaaacaattatgtatccatcttgcttttcacacttaagtcatttagaagtcattcaatatcaccatatctagatcaatgttgtttttgaaattgttgcatatttcaggtataattatggtttatataatcaattgcttcctgttggatatttaagattttctttttttgctattaacaaataatgcttatatctatatttttgaacatttgtacaagtataaatgcatggtaaattcctagaggtaaaattactgagtcaagagttttacatgttttgtgaattttgatagatattgtaaagttgttcttcaaagaagtttcatttattgttttcccacatttagccaacattaggtattatgaaacttttttatattggccaaaactcacaggcaaaagaaaaagaaaaaagtctcattgttttagcttggtatttatttgcttatggttgaggttaaatgtagtaaaaatgaaaaacccagtactatagaagatagagttgaagaaatattccagaaagtacaataaaaggagtaaaataaagaggttcaaataggagagtaaagataagaatactggtggaattatccagaaggtccaatatgagaatgatacgagaaaaaaagaaaaaaagtaggatagaaaatcatcaaagacatagttcaaagaaattttatattgaaggacagaactttctagattgaaagggcctgttggctgggaagggtggctcatagctctaatccttgcactttgggaggctgagactgggggataactggaggccaggagttccaggccagcctgggtcacacagcaagacctcatctctgcaacgaagataaaagaaagggactgccaagtgcctaacgtattgaaggaaggcagaccccataattgtgaaatttcagaatacacaataaaccattaaccctaaacatttccagagaggaaaaactaggtcacacacaaaggatctggaattaaaattgtttggcttctcattagcaacaccggatgcagagagggagcagtcaccttcaaagtttgtggtgaaaattgttaccaacttagatacccagccaaactatcagttaagtgtaggtagaataaagacattttcagacttgtaaggtctcaaaaagagatttttctggggaaggtctggaagaggtaggtgattcaaaggaactgagaaggagaatgacatgggatctagtaatatgtatctaattcaaaacaggctgaagaacggcctaggatgatggtaaggagaaattccagaatgatacctgtgtgtcacatatggggaaccgtccagtttggagacagtcaggatgctccaggagagagatcaccaaggggatgaaaactgcagaactcctgatgtatttgaacatatcgagaggacagttagactattccggagaagattgggcctgaattagtgtcaattatataggaaactaaccttgggaatagcaacacagtatttccaggaaaaaaaaaatgttttaaataggggaaaacttatggcttagctgagaatatttttataggcatagtaaactaaacattgattattgttctatccaaaaggaagacttcactatgtagaaagaattgagaatgacactagttaaatatttatgcattactgggttcaagatgattgaaagataattaaattctcttctttcatagttggagatttatagccaataactgtgaagaatcacaaagtagcacttattagaataagtgactatcaaacaaacgttagaaagtgcttctggctgggcatggtggctcatgcctgtaatcctaacactttgggaagccaagataggaggattgcttgagcccaggcattcgagaccagcctgggcaatatagcgagaccctgcctcaataaaaaattagccaggcatggagataca

SEQ ID NO: 115761 - DNA, 2223 bp, Homo sapiens; identical to SEQ ID NO: 115760

SEQ ID NO: 115762 - DNA, 2223 bp, Homo sapiens; identical to SEQ ID NO: 115760

SEQ ID NO: 115763 - DNA, 2223 bp, Homo sapiens; identical to SEQ ID NO: 115760

SEQ ID NO: 115764 - DNA, 1050 bp, Homo sapiens
tttaggagtgtgaggcaggaggatcacttgagcccaggaatttgagagcagccttggcaacgtagggagactccatctctaccaaaaaaaaaaaaaccccacaaaattagccaggtgttaggcaagcatctgtagtcccagctacttgggaggctgaggtgggaggactgcttgagctcaggagttcaaggctgcagtgagctatgattgcgccactgcactttagcctggatgacagagcaaaaccccatctcaaaagtagataaataaaaactaaaagctattgagggtaatgtgctacaactttttaatattccatctacaaaattacataattggggtgagaataatattaaagcacttacagtgaacgcaacagtggactgtatatttgcatatagtacatctgaaattctttaatatttataaaagtggatctgtgtgtttatgtatacagaaacaatggaaaaacaaatatgctataaatgaaagtcagaggccaccagatcgttcaaaaatgactatgagagacttcatatattatctaccagataataatccaatgacgtaagtaaaatttatttctgctttactatctctttttttttttttttttttttggaggtggagtctcgctctgtcacccgggctggagtgcagtggtgcaatcttggctcactgcaacctctgcctcccaggttcaagcgattctcctgcctcagattcgcgggtagctgggattacagatgctcgccaccacacccggctaatttttgtatttttagtagagactgggtttcgccatgttggcttgcctggttttaaactccttacctcgggtgatccacccgcttcggctttccaaagtgctgagattacaggcgtgagccactgcacctggccttctgttttactttatttgggtatgtagttatataaatagcacttttatagtaaattttttagttttccaaaaacatgttgacaaaatttggaacacatatgtccttttaaatagaatttcataacaaaaagtagcagtatttcaag

SEQ ID NO: 115765 - DNA, 1036 bp, Homo sapiens
taataatagttgtttttgtgtgctattttccattagtttgtgatgatgattttactggtcattaaatagttagagcatatttaactgctttctctgcaggaatgtaaaatataaagtgcttgtgtttttcaaaatttccatggagtccagcacagtaatacatattgaatatcaaagacatgtgcaagtcaataatacaaataccgttttataatacgtagcccaaagatgttttgtaaatattatattgctgttatggattttgaaaatgagttgacatttctttctaccctcttggaatcacattgtaggtaaaacttagcagatgcttggaaaatacccatatttcacataggtattattatgcctttgatatgattgccatgctaaacctcaaaatataactatttacatctcatttgctatttgtttccttgtttttagtatacatctatttaaaaatgtgtttatttcagtttaactgtagaagttttaagaacaaaaggcccttgtgttgttgaagaaaatgaccccatatttgagcgcggttctacaactacatactccagctttaggaaaaactattactctaaaccatggtcaaataaaggtaactaattttcatttaaaaatgtgtaagttctctatttgaaatgaattgactgtttctgaattaaatcagttctcccctaagtacataaaatgcaaactaccattttattccagctaattttattgacacctctatcttatgccctccatggaatggtatctctgactttgtcttacaaatcttcaaaaaaattttattttttatagcaactgggtctcagccaggtgcagtggcttacacctgtaatccctgcactttgggaggttgaggcaggaggatcacttgaggccaggagtttgagaccaacttgggcaacaaagcaagacctcatctctacaaaaaaattaagaaaaaaaattagaaagtagagatagggtcttgattgattgccgaggctggagtgcagtgaaactatcttagctt

SEQ ID NO: 115766 - DNA, 2019 bp, Homo sapiens
atggtaggaactgacttttctatgatcggacaactttttcctcacagagcaaggatagaaattaaggtaaagtaaacccatcacatttgttgattggaaagagaccaaacattacaaatgttagtagtattattcgcttacctttggtttaaatcttagttcatcttttttttttttttcattgagacagagtttcactttgttgcccaggctggagtgcagtggcacagtctcggctcactgcaacctctgcctccgggttcaagcaattctcatgcctcagcatgtcacatagctggtattacaggcacctgccaccacgcccggctgatttttttactgttttagtagagacggggttttaccatgttgcccaggctgctgtcgaactcttgagctcaggttaatccccccatcttggcctcccaaagtgttagaattacaggctagagccaccgtgcccagccctttttttttttttaaactgttatgatggttttgttacatttatccctctttattgaaaagtaatatttatcagttctgatatgggtataatcttctttatgttagtttcatattttcttatatcttcttcatttctaaaatgaatttgaggcagtaccaataaaaatgcactgcaactaagatataagaagagttacataatgaaaagagaagataaatgtaccagagtactttggttaagggtagcttttttttttttttttttttttgagatggagtctcgctctgttgcccaggctggagtgcagtggtgcgatatcggctcactgcaacctctgcctcctaaattcaagtgattctcctgcctcagcctccctagtagctaggattacaggcgcacaccaccacgcccagctaattttttatttttcgtagagagggggttttaccatgttcgtcagcctggtcttgaactcttgacctctggtgattcacccaccttggcctcccaccaagtgctggaattacaggcgtgagccatcatgcccggttgagggtagctttttcaatgcaaaatgtatttcagaatttcctaggaaagcttaaagagaagaaatctgagtttacacagttctcattttctgatccgttgctttcctaggcccccttaactttgggacaaccagtggcactaataacaacagtgatgtcagttacagctattatatgcccaagaggatgagctttctctgttttttagtttctttgcttgagaaactttatacaagttttctgggtttaagtgcatttgagtgtcatcacactatgttgccataatgcattctcaattgatagtgagatctttactcaaccatgggctttttacttcatttctcatccctatcatgttcattacattaataaaaggaaccattaggaaggtatgttttttccactagaactaaattaggcatggattgtctggggacattacataaggggcattgtacagtgtaatgaaatagtcttgttatttctgcaagagatgaggaactttatattcttcatgttcattttctaatgttgatctttgataaaagaacaaaatgttaaaattctgtgaaggctagaaattgattttctggaattggagtgctctgctgatctgtgtaattaattataaatttgtcactgggctatttgtctcaaaaatcatgtatattcttttcctgaaaggttactatggctctagcaggtcgttgggtaaagtgtagaaaagtgagagtaggctgggcatggtggctcacgcctgtaatcccagcactttgggaggccaaggcaggtggatcacctgaggtcaggagttcaagaccagccaggccaacatggtgaaaccccgtctctactaaaaatacaaaaattagccggacgtggtggcgcatgcctgtaatcccagctactcgggaggctgaggaaggagaatcgcctgaacccgggaggtggaggttgcagtgagctgagattgtaccactgcactccagtctgtgcaat

SEQ ID NO: 115767 - DNA, 1046 bp, Homo sapiens
atcttaaacaggatacagtgttgtatgcctataggcccagctactctcaggagtcgctgaggcaggaggatcttttcagccgaagaattcgaggccagcctgggcaacacagcaagatcctatctcaaaactagaaacaactcattgatttggaggctttctattggaaattttttttttaaattaaaacctatataagttttttgagagaacttatgttttgaatttctctgagaaccatgtggagatcctttatgattctttgagtgctatgtctttcagaatcattgtggagagtcagaacaaatgaagtctgggtcaacagtgaaatagggtcttcaggaatcccagatttgggtttagtttccagagattctttttattttagtatataccttcttttctgaggctatcttgtaatcaaaccagtctttggcttatgtgcatagagcaccattttctctacattgactttaagttcaagcaaggatttgcctcctggtctggattcattcctggagtgttcactgattactttcagatataatgctgttgataggtatttagtgggcatgttcctgattaaattcatttacttcccactttgctgatacttataagagtaaatggtgaaatggttgtgataaaggtagggcatatggtggtgaacaggcatttcaaggacttctcagtccataaaaaaattgatttatatttatacacagctcaaagtgtagttcaagttttgacaaagaatatgcctgtgtaatcactaccccaaacaatagaggaaatgttttcatcacttcacaaggtctattatgtccctttctgaacaatcaaatgctgtcctcctggcccaaggcaaccactattttcattttaatcaccatagatagcttagtgtgttctagaatatcttatacatggtatcatatagtatgtaccctagtatctgttttcttccactcagtatgtttttgagattccctcatattattgcatgtatcagtagtttgttccttttgttttgtttaaaactagtt

SEQ ID NO: 115768 - DNA, 2512 bp, Homo sapiens
atgcattttcaatttacagtatactcaacttatgatgggtttattgggatgaaacccagtgtaagtcaaggagcatctctatatgtaactgtttttgtttaataaaaatgagattttatgtgtatcttgttctgcttggttttttaaatgcaacaatatgctttgaaatttttcacatgactacatataatcttacctcattattattattggctccgtggatttttatatattatttagtcatttcccattagacattttaggttgtctttaggttttttgttcatacaaataaataatacagaggacatctttgagtctctttcccacctttacaaatttttctttaggttgtttaaatatttatagtaatttctcttgttttcagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagagtaagtttcttacatatttaaaaagcctctatattacttgagaagacatgtacagtaatatggtatgtaacttaattttctgtctagatagcaattaatgatgcttattaattggttctgtactaatggtactgtgctaacgctgtttatttttaattaaaaaagtttatgtaaaaaaattaaacaaattaaagtggggagattgttctctaaagtttgtttctaagatgtatcacctcctgtgcattcccattaactatgattagaaatcacatctatatagagttaaaagtatgttgctatgtctgtcaataaagcacagattttcatgttgtacctctacagagcacctctgtgaacccacaaggggttagttcctataaaagaactagtggaatatgtattccttccctttttcttttttactctttgaatgcaaacatattgccacttatgagttgcttggggatgagggctaagagtttgagggggagtcttggtccctttccttaagagttcatatgtagattatttaaagctgataaccaaggaaaaggtaggagcagaccagaacaacctttctataaaatttatgttttctgtagttcagatttacccatctgattttaataaaagagtactggtagctaacatagtatgctttgtaggcatctcaatattatgctcttttttggcttattggagtcattacgtataatgcagaacagcttaatgattcacaaccaggttttagaaatcaaacagaccttgctttaaattccagcttttttacttgcttaagtattgcattgggaaagttacttaagatctctgaactcagggggttctctatgaggttaatgttaatatattttaataggattgtttcaagtattaaatgagataatgcatctgatggacttaagggttcctgccgcttagtaagtacttaataaatgatagctattactgtgttactaattagtatacttctgaaggagcaaaagaatagttaagtcaacttttagtttccctacttgacatataaaataagccactttaaatacttagaatttaagataaaaggaagatgctacaaattgcccaagaagcttgagctgatcctcatatatgttaagtttttattatggtctaaaaataagatgtgtgccttgcaaatagggacttgaatgttgcttaaggttttgtaggaaaagagtgttataggtaaattcctttgtgctctaaaaaagatgtttttgctgtcattttttagaataacatgcattttgtatttgtagataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaaggtattttctgtgtcttttctggttttatccacatctgttgattactgagaaaggagtgttgaagtctccatctgtaactgtggatttgcctgtttctttttttcagttctatttgtttttgctccatatattttgaagctctgttgttaggtgtgtacatatctaggattgttttgtcttggtgaaattccctttatcattatgtactatccttctggtattgctctttttttctgatgtttactttgctattgtagctttcttttggttggcgtttgcatgggtttatcattttctgtaatgattttctctatttttggttttcgttagtttgaatgtgatgtgtcttgctgtgtgtgtgtgtgtttttaaattttattttgtaatataaaatca

SEQ ID NO: 115769 - DNA, 2267 bp, Homo sapiens
gcctgggcgacagagcatgaccctgtctcaaaaaaaaaaaaaaaattctcatctgcatttaggatttttagaaaatctcctctagttagaagtacaaaaaatgaagttcttatttattcatttattgagatggagtctcactctgtcacccaggctggagtatagtggtgtgacctcggctcactgcaacctctaccttttgcgttcaaagaattctcctgccttagcctcccaagtaactgggactacaggcacacgctgccatgcctggctaattttttgtattttagtagagacagtttcaccatgttccccaggctggtcttgaactcctgagctcaggcaatccgcctgccttggcctcccaaagtgctaggattacaggcttgagccaccgtgcccggccagttctgttgttttaatttccatttgtttattacaaagtttgaactgtttattgtaagtagataaattgtagcaaattaaattcacagaaccacgtggaaaaagataaaatgaatacattggacattttgagaatggagactacagagagagagaatccagaagctgaaactgtatctgtgtgagtattcaggaagtagtaaaaaaaaaaaaaaaaaaaagtaactcttaggaatgatggtaataatttgttttctacttaataaggtctgaatttaattttcaagcagcatactttaagttcgttttcaaccataggtggttttgaaacattcataatactctctctgcttgatattgcttatataaattttatgagtctattgagttagccattacatttgaatgtttacagtatatgcccctggataattttatttatactaagagattttaaaagggaatatttaacttgaaatagaaatctaaaatagaatgtgaatctgactggtggattctgggctcttccaggggttaccatttatactatgatttgggactaatcccctggagttctacattattctatagtatccttagtcaggagtagtattctatgcttggcagatgtagatttttccaattttgtaataaaattctatttaaaagtgctttttcaagagggcttccaggattatgtctttttttttctctctctttttttttttttttgagatggaatctcgctctgtcacgtagtggtgcagtctctgctcactgcaacctctgcctcccggtttcaagcgattcttctgcctcagcctcccaagtagctgatattgcaggcgcccaccaccacacctggctaatttttgtatttttagtagagacaggtttaaccatgtcggccaggctggtctcgaacttctgacctcaaatgattcgcccgcctcggcctcccaaagtgctgggattacaggtgcgagccactgcgcccgggcggattatgtcttttcaggaaacttgtgaattatttcatattccaaatggtttacttattcatgccagggagaaggaaattggtgacttcaaaataaacattaattttatttctttgtggttctagtttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatgtaagtactctgattcctcctcacatttttggtaagcaagtacatgagccttaatataagcttcccttcacccacatacttacatacatacatacatacatttatttatttatttatgacggagtcttgctctgtcgcccaggctggaatgcagtgtcgcgatcttgcctcactgcaacctctgccacccaggttcaagtgattctcctgcctcagccacctgagatcgtgccaccgcactccagcctaggcgacagagcaagactctgtctcaaaaaaaaaaaaaaaaaattcacatgatctataatgtttttgtatttttagttgtgcgactgcaggctcacaccaccacgcctggctaatttttgtatttttagtagagacagtgttttgccatattggccaggctggtctcaaactcctgacctcaggtgatccacccgccttggcctcccaaagtgctaggattacaggcatgagccactgtgcccaacccctttacccccttttcaaaacagtactgcacaatttgtgtgcatcatt

SEQ ID NO: 115770 - DNA, 1012 bp, Homo sapiens
aacctgggaggcagagcttgcagtgagccgagatcataccactgcactccagcctgggcgaccgagcaagactccgtctcaaaaaaaaaaaaaaagaaaaaaaaattcccgtgatctataatgcatttatagtaatcaaaagaattcagaaagatagaccccacaggggtatttctaacagatgaaaccaaggcagttacttgttttttgattgggaggaaaagaatggggctttgagatatcctaaaaggagtaactcatgaaattttctaagatagctaaagaaaaaacattaaaagtattttaaagtctccattttataatgttgaattttttaccattttatacttaaattggacattttcaatgaaatctgttatgcctcattgtgaaacctaaaacattagaaaaatttgtttgtttttaagactcctcaacacatggaagatcaatcgcgtaaagattttgaagaggaagatgtcatattacagcctgagaaaaatgattcttttcaaaatgtgcagccagatgagcccaaggttcttaatgaatgtctaaggtaagcatcattttgttgatatataatctttggattttgtaaaaagttttagaactcaatcagttttttaaagcagaagcaatttagatggatttgttgtctgcgtgtctagttatgtagtgtttaaaaatataacttcacctttcaagaaagtttatgttgtagcctttatgtgaatttctcagatggtttgaagaaagctactcatcgtaaattagtacttgagttaacatgaatagccttatcactttattttattttattttactttttattttttgagacggagtttcactcttcttgcctgggctggagtataatctcagctcactgcaaccactgcttcccaggttcaaacaattctcctgcctcagcctcccgagtagctgggattacaggtgcctgccaccaagcccagctaatttttgtatttttagtagaaacagggtttta

SEQ ID NO: 115771 - DNA, 1382 bp, Homo sapiens
ccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcaggtatgtatttttctgtcctttaaaagttttttgaatgcttttttcagaggaaataaataattccatgattattttgtccttaagtccaacaacacttaaaaatctctaaaagtctaaagtcttttgtagccctaagtttctatgtttcagtgccttgaagaaactgtatgttcttttttaaaaagataactttaggctgggcacacctttaaacccaacactttgggaggccaaggtggaaggattacttgagcccaggagtttgagaccagcctgggcaacatagagagaccttgtctctacaaaaaataagataaaataaaaataaataaaataaataaaaaataaaatacaataacaaggtgtaagcctgtagtcccagctacttgggaggctgaggtgagaggatcacttgaaccctggaggttgaggctgcagtgagctgtgattgtgccatt

SEQ ID NO: 115772 - DNA, 1013 bp, Homo sapiens
aaaaatgtcactgttcttaatatcatttgaagttactcttttaggtaaaagaagaataggaaattagactgaatttgtactaaccctagcgtgaacacacattatttcttttggccacatctgtatctgcttttgtttcttgccccacctgacttacttcacttctaaaagttctttttgttttttcaagttactttgaagttcatgatcttctaacattttcaaggacttttttttttttctaacttttaaaaatagataatgacatttgtggtttgggaaagtaataatatgcaacataaaagggtttcctgaattccaagttttaacatttggaaattaaattttattcaaaaattaaaaacttctaaagttttaaaggaaagtgtttagaatttagtagacttttgttttaaatatataagatgtttaaatactcttttatttgtgctgatttactatgactgttcctctagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaaggtacaagtgtgtttttaaagaaaaagatattaagttatagttgcagattacgttaaactaagtgaggtttcaagatataacatatacaggatagtgttagagcttttaagatagttttgggaagactgggagagaggattgaggtcactctgacagtcaattgtgaaagttactgacatacaaaattgtatgtaacagtcttaaatcaatacaggtttgatagactcatattttctttgtgcagagatggtgtaattcctaggctcatacctggattgtaccactcatggttttcaggatctgccagatagttcgatttgttttcctgttaagaattagaattaggcca

SEQ ID NO: 115773 - DNA, 1115 bp, Homo sapiens
cattttaactattttttaatatacagtggcattaagtgtattcacattgttgtcccgttgccaccaccattcatctctagactttctttttcatcttcataaaatgaaactctctacccattaaatactaactcattctcctcctcttccagctcctggcaaccaccattctatctgtatatttagctactttaggcatattatataagtttattaccttttaagaattgacataactgttttcttttgtaaaataagatgtttataatcagaaagcaatttccctttaatggtacaaagtattttttagagtgtttattagaggagatccaaattttacatttttacattagttttcagctttttacagtcaagcgccctgcctttctccctgtccccttgtttaggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtggtgagttattgttatgtaattaaatttagccttttaatgcatttaaaatgtcaagttatagctcagacatagcttagaaatacaggcatctgacacttattctactcaatgaatacagtttccagttttgtttcagatttgctcttctggattttttttttaagtgaaaatagatttatttcttttctaattaatgaagctattcatcgtaaaatgttccattaggacaaaataatataaataccgcaaatcttactctgagataaccactgaaaaccttttgacatatcttactggatttatttccatgcacacattatgtgcacacttatgcaaatttaaacaataaagtcattacgtactataactttctgttattcactgaatactatgttaagtggctttctggatcaagaaatatgttagttacatcatttttgctgtataacatgctgttttgagtaacagtttaatctcttattaatgggtcttttggt

SEQ ID NO: 115774 - DNA, 1081 bp, Homo sapiens
ggctggtcttgaactcctgacctcaagtgatctgcctgcctcgtcctcccaaagtgctgggagtagaggcgtgagctactgcgcccagccggttctgtgtcttttatccctttttcttctaataattttcagttttgtgtttattttatcttcactttcatattacaggaaagaatggtccagaattaaaaacttactatgaaaaatttgtaggtagataactaagaattaactctgagtgagaaactagtagttaattccttttttattttcacagcataagattttaaaagaatgggtggtgggaattttcattttaatgactggaactggaatttcactctaaaagtttggttttcattaaaattatccttgcatgcatatgaccttattgttgttttgattaaatatctagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagaggttcggtttttttttaaaaccttggtactttatcttacttggttttcacctcttgtttcttttaggggatcattatttcttctcgtagtgattattaggatttgaagagttcattctctaaataacctctaccaaatataatttggggccttgtataaccttttgtgattgctcagtccctatggcccaggcccagcaagggagtcagtgtaacaacgagagaaatctgcttacacttgtacctggaagctgtttagtctactttctgataatctttcttt

SEQ ID NO: 115775 - DNA, 1166 bp, Homo sapiens
ttaaaatcagtttcactgaggagtgggtcagtgaagcttctcaagctgtcgctctggacattggttctgtaacttcttaatttattaaaatgcatttaagttttaagctacgtagtagtataaaaattttgcaataccctttaggccttggtttccattgggtaaaaattggcagcagatatgactagagttgaaggattatgaaaatgaagaagtaaagtaagaatggtagacgtacataacaaaatgataagagttaaaatttgcacataatacaagaaaaagataaagtcaggagcaagagacacaagaattttgcctttaaattgtttatgttcttgctggtgaaattttgtgaataattataaattaagacaaaccagtttacactattgtagctaaaagtatggaaagacctctgaaaatgtagtgcatgctgagaaacagaacatgtttggggaagtattttaagatgttacttatttttttcctttttaggaaatgaccacaagtgaacatatccaagatgaaccaggtaactgttatcaaggaaactgctaagactaccttgattaacactagtacagtgatttaatagtggggataataaatgaatcagtttgctggagagtttaacaaaaagattcagctattgaatgtgttgtctctgtgagaaatgtggattcttggaatgttattttagaaggtgaattaaaaaaatgtttaagaagtatttgagcatttcctctggatcttcacaaatgggagagcattttccttgaagatattatttaatgggagggaggcatggtcagtgagtcaaaaccaacagtgatgatttatttatttgtagcatataacctgaacaaaagactaccttagtaagggattaatggctcagaggatattggaatctgctcctaggagataaacaccttaattaaaaatcttttttaagtgaacagatttccggattcattcttttttttaatgttgatatatttcctcacaaggtaccaatgatggaagcaccgaagctgcaataactttacttacaatgggagatctagtattgcagtcagagatcagtagtgaacagggtgatggtaagaatgaaagctaagtcctatcaaaaatagaaacttttaaaacctaacttaagaaat

SEQ ID NO: 115776 - DNA, 1052 bp, Homo sapiens
atttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggat

SEQ ID NO: 115777 - DNA, 1048 bp, Homo sapiens
acactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatcatttctgttgtgtccttttaagatgactaaataaagaattggctgggtatcgtggcttacacctgtaatcccagcactttcggaggccgaggtgggaggattgcttgagcccaggagttcaagaccagcctgggcaacataatgagacctcatctctacaaaaaaattaaaaatcagccaactgtggtggtgtgtgcttttggtcccagttactcaggaggctgggatgagaggttcgcttgagc

SEQ ID NO: 115778 - DNA, 1005 bp, Homo sapiens
gaagcaagcagtcagaggctagggtgaaattacaaagttatacttctatgcaaacgaagactggacccccaatcagtctgattggttgtggacagcaaccattcagaggctggagttaaggttcaaacttggcaaagcaagcctccaccagcagtaagtctgatttgtcggggacagccaatttcctatctgccctgcggaaaaggtgggggggtttgcaaagggagtagcctttggtccttttgttacttaggcatggaaagttagggttttcctttcagtttagctctaggaagtcagcgtgagacagccttaggttccctgcttccagacttattctcctgccttaggtacagtcactatcgtgatattatctatcgctgtgtcaacacaacaccaatccaagcccaaccgcagctctctcactgccgcaccgcttcgtgagggtcgatccgccggggagacctgctctcctgcgctcgggactagacgcgacctcgcggggctgaggctctgtcccttattggctgggtcagggggcgtggcgcggcttgaccaatcgcgggcggcgcgcttaggcacgtgtgtggacaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggtaggctgagcgccccggtggcctggccgccggtgccaggctaggaagcaagtggaggaggggcacgcttcaacaactgctgctctcttgtccggagccccagttgattctgtgacgcacgtgaagtttgaagaagaaaagcctaaca

SEQ ID NO: 115779 - DNA, 1068 bp, Homo sapiens
gcggtggctcatgcctgtaatcccagcactttgggaggccgagatgggcaaatcacttgaggtaaggagtttgagatcagcctggccaacatggcgaaacccggtctctattaaaaatacaataattagctgggcatggtggcacacacctgtagtcccagctacttaggaggctgaggcaggagaatcgcttgatctcgggaggcggaggttgcagtgagccgagattgcaccattgcactccagccggggcaacaaagggagactctgtcccaaaaaataaaaatacaaaattaaaaataaaaataagatcctttttctccctctgggatttgtttttaagtgtactttgtcagtaagcaagcattggttggaatctcagatagtgactgatgggacaggaaaaataagatggtattctaaccttcaaaaagcttatattccttaaaataggaaaacaaatagagatcagtttaagttcagaaggtgtttaaggaagaaagatgttaaattgagtaggagtggccagaagtagagttgaagatgagataaaacatgaattaggcttacagaggagtaagatatggagagatggacaagtggggtggtgaagaagagcttgaacaagacaggcaggggtgaatcttttccatacgatccagtggcccagcgtggctgccacagatggggtggcccagtgtggcggccacacagagttggcacagaccactgttttttttttttttttgacctttattttggtaaaaaggaattgctttctaatatttctctcccctgtctcctctatttctgttttaggagaactacaagcagatgaaagcactagtaaatcagctccatgaacgagtggagcatataaaactaggtaaacacagcatttattccacagcttatgcctttacttaagatgtcctaaaatagttattgcttttaggaaaaatactggaattaagcttttgatattttttttttttttttgagatggagtcttgctctcttgcccaggctggagtgcagtggcgccatctcagctcactgcaacctccg

SEQ ID NO: 115780 - DNA, 1050 bp, Homo sapiens
atgtagaggtattttttgttttgtgtttttctgtgaagttgaatttacctgattaactcacaatacgaactgctctgcacgtagagaaaacagcaaatgaggcccagctgcttgtaggtgctgtgctggtctttataggggatacagtgaggaggattttgttgtctctgtcttcagcgagctcataatgaattggacacagcatataatgtgcaaccaacaaaagacttaatggttgcagattctgaactaagtgctttctatacatttttcaagtcatcctaatatatgatatggctcctttttttatcttcatttcgtgggtaaggaaaccggggcataggatggctaggaaacacacctataatcacacagctgtgaagtcatgagctctgctttgaacgcaactgacctgtgtacccaccactccaatctgcaatgaaaacagtatcagaaggcaatatgtataaattattatatgaattctgtggatggcttttgtattggtttagaagaaggaaagatacttttccaccttaactctttaagaatttatgatgtttctggggctttagctggtcctcaaaggagagaaggttctaaccatttcgagaagaattttgcacagaggtgggaaagcctgatgggtttggggcaatgaatccttttggctgcattgggggtttggagaacgaggctctataacagtttagaaagacagggcaagttttttgtgaatgtgattaagaactgatgctgtcattgatacaagtttccctctgcgtagcacatttagttcatagagatgcttatgtttctcatttcttgtcttcagttgattcgggaggagcatacttacctcgacaagcagatgtgtttccagatcgagaccactttggccgtacattctataatcaggcaattatgtcttctaaaaatattgcacaggtaatttttcatgaataaagtgtacagtggtgctttttactcttaagtatctttacgaattaggtactctgggatggcttgaaagtaaaacagaatttaaca

SEQ ID NO: 115781 - DNA, 1147 bp, Homo sapiens
tctactacatataacagtaataactctattactgttattcataataacctgtttaaaattgtgaggaaatgattgggggtgatgaatttttttttttggaaagtaccatgaaatttattagtcacaagtggctctgtgttctctcaaatgcatctttatacctctcttaagtcatccttaagagctaatttgacacaaagacttatatatacagtgtatcattgaaggttttcctttcctgctgttttggtaaatactagacagttttcataaaaaagcattttattttaaatatttactgatttagaagctgttccttctgcttctatttgacttctgacagtgtagttataagtcagcatttataactggtattatgtatgaagcatttaaaatatatggtcagtcataacatgataaaatgttgtattaaattaaagaaactgaaaaagatctaccatttgtgaggcatctgtgggctatgaaaaagagtaaacgtggtctctgcttttactcaggaactcccagtcctaaagtagagtgtcatgaaatcactgagagcctagctctaagatatgtctcccaaggagtttggtgttttcccaggcaagccataaaaatttagattgcagcagcttagtccttactcataaaatgaacaaattatttttttcaggtatgtatttttgactgactttacagagttttaaatactttattagaaagtcatagtttatctacatttatctactattgaaataacaggccatctaattgggacaggactaataaccagagcaagcccgtacttcattcactgcacttgaaattgaacaggaacttccatggcccctgccacagaaccgttttactagttccgatttttacccataatccaagggccaatgtattcaagccttttcatttgttgcctgtgatggcttactgtcagtgtaactttgtagggagggggctcagagttctctcagaaatgagaggccagaattggcatctccattaggagctcagttacgtacacagtttatgccgtaaccaactacatcatgaaagtgtgccgtctgtggttggccttcatcacacgcaattctgcttacggtacaggggatgagtacttaatagaagcctt

SEQ ID NO: 115782 - DNA, 1033 bp, Homo sapiens
gtcaccagctgcattagcctttaacgagagagtaagcctgtcctcagacgacgtgcactaacctctccccagctatgaaagtcctaggtggcatcttcttccaccagaaggctgtttcatctacactgaaaatctgttgtttaatgtagccaccttcatcaatgatcttagctagatcttctggataacttgctgtagcttctataatacatcagcacttgctgcctcaccttatacttttgtggtacaaatggcttttttttttttaaacctcatgaaccaatctctgctagcttcaaatttttcttctgcgacttcacctatccaagccttcagggaactgaagagagttaagaccttgctctggattaaagggaatgttgtgcctggcttgattttctatccagactactcaaaccttctccatatcagcaacaaggctgtttttgctttctcgacattatggattttttgtgaagataagtgaatgtattttatgtggcctggtggtgttaattgtaatgcaaatacaacatagtttttcactaaatggtcctaaattgctgtgccctttgagcagccgtatctctgtgtggaagaatgatagttgttacgtgttgattgcttgttaaaggtacaatttttacaggtatatagcacccaaaacagataactgttacattcccattgtattattggattttttaggaaaagaagtaaaaaataattcagagtaaacttttacttgatggtgagaaagatgttgggaagcattcactcagttttcagcctttgcatcatacaaaacaagattttgattgatgtggcagacagaaaaagcgaagtgcaaactatgtagaaaaatagtatgtatcatctaaaatagtttctgaaattgaaaatatgcttcctgtttagaactccttacagtagtcctgatatataatgataagccccagggataaactatttagtaatttccactcctttatacatatgtggatgatccttcaagtataccagattcagaatc

SEQ ID NO: 115783 - DNA, 1938 bp, Homo sapiens
tcttttgactctgagccctgtctctacccagctttctcattgcatccctgaacctctgccggtacattcgaacagtccttgaagctctaagtctagcaaccagcccttggagcctttcctgcttttcttgcatgcagcatggtgctgttgcttgtatagtgaagtataaaatcagaacccagaatgacttcagggcattaaccaggcatgtcaaatgaaattctagtgagattttctgtgtagtgtgaaattttgtgaaagtgacaacttcactgtgaattgttttcctataagtaactttaatacaaaaattcttttgcaatataatttctcaaggccattgttgtttttcctcttaggtcattgctagaatcgtggatggaagcagattcactgagttcaaagccttttatggagacacattagttacaggtataaaggtgaagaattgaaaatacgaacattttctgctgctttgaaaatcaggaatctcttgtttcaagactttgatacacttgacatgggctttgttgttgagagcactacaaatgtgtgagccacttttaaaaggaactgctttataaacataatttgtagcttaatggcttcatggatccaaatagtttaaaatgttaatagctagatgctgtggtgtgggtccctatctgtgactttgtgacattagttgtataaaaaggttcttatagtaaaattagtagaaaatacttgtagttctttttgtttttctggataacaataattattttgaaagtttcagcactgtttcctttgttctttactgtccaattcaacgaggaagttttatattgtgtttagcttcccagaaggatatagagtgagttaaaccttctcacagcctctgtgtaggtcttaagctgattcatgcagacactagattgagaattcagtatatcacgtcaggaaaaacaaaataaggatgtttataaaagttaattttttaaatctaaactgtttagtttataggcctttgaagaagagtttttgagatagatgctagacccataataatctatttgggacaaatggaagaacaaattttgtgaattttacttgttcataaaaaacttgaaaatatagtagttagtcaaaggtaataccagagtaggaaaaaaactagctgcagaaatccaaattgcaaatatacattgaggcttaaggataaatcacagtactttgtcctagtttgatttgtgaacaaaagaagggttcacactgggagtagaatttatgtttttgtacttaggtgtttaagtgattaaaagctttttgtttgatatatagacaggatttgtcaccaaattgttcagaatgtaacagtcattgtgtagcagtttaaaacaagtcaaagccatttctgctttctgtaaagatggatgggctgtctttgtcatctgcttttatggatttgcctcctacttgctaaaagccctgtggcactcttatcccctagagtacacaacctggtttcttccatctcttgactgtactggagttcaaatacatttagggacagagaaggggagtgagaaggagaagaagggaatgagaggctggtggtgggagttgggggtgggggtggcggataagaaggatgggaggaatgagaaggtgggaggcataaagggtgaggaggtgagagggaaggacagatttttctggttctcaaatgtctctggaagttcctcagggtttcctcctgcctcagcacttaccatgtgtagcctctagtcgtttcttggacactgtgctttcccgtttgtaactcaggtttgatcaggcagttggtgaagaccgtccctctatgggtgtccctagtagtgtggggacatgttccctactcagcgcatcctgtctgtgcctggagatccctaagtggggcctagtgtgggttgaatc

SEQ ID NO: 115784 - DNA, 1031 bp, Homo sapiens
ttaaaaagtcataaacccagacaaagccagagtaaagaagaaaaaaaaaacaaatctttaaagattcaggctgggcgtggtggctcatgcctataatcccagtactttgggaggccaaggtgggaggatcacttgagcccaggagttccagaccagcctggcaacatagcgaaaccccatctctacaaaaaatacaaaaactagctgggtgtgggggtgagtgtctgtagtctcagctactcaggaggctgaggtaagagggaggatcacttgaagcctgagaatttgaggctgcagtgagccatgactgtgctactgtgttccagcctaggcaacagagtgagaccttgtctcaaaaaaaaattcagttttctggcttatcagtatgttgatactctctcttatctgttaatttttcttcaataattattttgatattaaaaatgatatttttatagtatccctagtgtctggtacatactagacactcagatatattaaatgaataaatggataatacactaagccaattatttaatcaaatcaatcaagacaaatggataactctacatgtatcgtgaccctttctagaagcaaaagaaaccagagtctaggaccttaggaacaagaagattgtgacatgagctgttttataccatagacaaaatctctttgcattttaaacttggatctgatattaaagaatgtgtaaatatgcctctttcttgtgaattgaagcccttggaaaagcacaagacataaatcttctttgaactttcttttgaggatttgctcgaatatttgggtacccagtaggtatcgttggaaacaacggagttctcttttctgaatctgcaaaaaaggcaagtactgttaaaaatatttcaagattttctgttttaatttaacataacgttgaaggtcaaataatgagttaaaatttattgcataaaaatgcttaactagatgcctcagcaaccagaacactgtgtgcgcgggcatgtgtgtgtgtgtgtgtgtgtgtgtgtgtg

SEQ ID NO: 115785 - DNA, 1143 bp, Homo sapiens
ctttgaaactatgagctctgtatgtaagatattatcgtcattacatacatatgttatgaacatcaagttgctggctttaaaaaaagaaaaaaagcaaattaaagatgagttcaagggaaaaaataagaattttttcctctgagaaataaagcattcctaaatgtagcatttcctttagttcatttatttagtttatgatttcaatctgatttcagaccactttttagcatagttttacaaatataatcttatgattctaggttaatgatttaggtacttggaaaaaatatccaaaagcctgtttttcagagggagcaactaaagcccataaaggaaaatcaacttgccaaaggcccaaataactgtcagatagaacccatgtgccatcaacatacaatgcatggtcatttcattttgctttcttcaatccactgtcacctttagaaatatgaattttagcttttaaatgggaggtgcttttttaaattgttggtttcattaaacaaccctgcaaaatgcttacatgattggaaaacttggaacaatctagcctgtacacaccaagagtacctgacttctcctcatttttcaccctgacttgttctttaatgacccctccctgcctccctgccccataacctattcttttctccttttctcatctgtgtatatcatgtgcatgtcagcctcccttgtgtgcactgctaccacctggggtcagagaactgagaaggaaagatcttttgttgctccctggtcccaaggagctcactttcagggctgggcaatagccacagagcaggcccagattgttctcagagatgacggatgccttttggctccagacattgaaagaatggggttcactgcctccaactgcctggagttattctgcccccacctgggtaagcccagaaggggtacagtcttagaatgctggggaaacaaagcctccaggaagagcttgacttggtgtatattggggtgaaaattagaaagagggcttccctgctccccaacagagaccaggatgacttgcttctgaaagcctctttagaacctcttcaccaacaccccaggatgccctccagccagattcagagaggggagaatatgggaagggccaaagagatatttttctgt

SEQ ID NO: 115786 - DNA, 2521 bp, Homo sapiens
aaagaaccctacatttttagtttcattgggagtgtaaaaatgagaaatatttttatcagccgtttactagtataatttagaaattactaagtggatttatcatttagtactttttctattgctaaattacaaatatgtcaaaaataaaatatgtatgaaaatataaagcaaacatttaattgtgtgtgccatgacaagttaactgaagccaagggaaaatggcaagtaacaatgtaagagcaagtctgcagataaccctggatgaagtcattcaaataatgtaccaatttagacattacttagaacaaagacagaaaaattgtatgaatttaatttaaatgcatatgtctcattattaacttattgacccagcttgacagggtagaagacaaagtagagctcagacctggaacaaggagaattcagtcaacaataccaattaagcagctcagacaggaactcgatttttttgcactagactagtatatagtgtatacattgaagtaaaatattctaatgaattcagacctctcaacctgtcaagctctctgtgaaacaaaaagaacccatttatcatttctgcactaaaaagatctgcgaaatctcaacatgcctttcttgttaaaattcaaatactccattagcacaaatgcaaactgaggctattaatgtttccaggaagagccataaaattctcccttataatttgacctttccttaagcacgttaactcttccacatctgaattcttcccattgatcatatgagaaatttctgcctgtatttagtggacacacatctatttgaaaatattcctcctggttgaaaaggtctgtggtgtgtaatctaaagatattttagatgtgcagtgaactgagtttccagaatcttttttttttgtaatgtctatgtataatccaccttgattctttacaggataggaagactgaatacaatataaccaagggtaaatacaaatatgccttaaggatccagtgtgtatttaagtaacacactgctatttattccttcaagtctgtatacatgactaatgtccaacaaaaatgattacatgactgggtgttaatttagagatagttcacctgctgtgttatacctagaggttcaagcccttacctttaggaggtatgcaataaatgtctgttgttctagagatttgttcctggcaattgagaatgctgtatacaaaggtacaatgatggataccacacactggctccaccatgagcaacctattaggaaaaatgtaatatataatatgtaaacatgtaaaacacacacacacaccagagttctggggttccccaactttccctggcttactctccagacctcccttctatgatgctctctggggttccctctgggccatcccctttgggagggcaggagaaagaggacagtgggaggaggaaggaagaggctagagagtagggcatgagcacaggaagctgccctcatcccgcctcttgccctcctgttcctctcaccctggatattcctttcagcctagggaaaggaagtctgataggacttcctttccgttcagcctagggtaggaatagctgattcatgtccccaactccataaatgttttataaagtataaaaagttgccatttttctttgcctctggataagaaaattgaatacaatgaacaattgtgaataaaagagctgcctgccaagctactcaggtaacagaaaagtgcctggaaggacagacaggccaagtcttgaagattgagtggatccactctgtttatcaaagatcacataaatcttggattgatatccagggctcgataaaccaaagtcaaaaacgggattggtaaaggaaagaaattacacatgtatactaccagaacatcattttagaaacaaaggcccgtgcttgaatggcagcccccgtgtattttctttgcctttattctacattttcttgccacctacaagtggagttagtctgtctacaagctagagttagtctgttggcctcttagcttcttaagaactaacatcttcctgccctttctagtccctccctggagtacagcctgtcattttcctaacaactgttttctttgactcttccagaagaggtgcatttactttttatgaggggcagaagctcagtccacactgctaattatccctcccttgtggcctggtggagagacctccctggccctcccattttgtgggcatccactgctaagccaccaagctcttcagaaaaggagttcccacatcctccctgaaagcctgagaaatattacagtgatgttgtccaaaccactctgaaatgactaactggaagtctctcaactgtctttctttccctccctaggaatccgatcatgggacacaaacctgattgaatgcaacttggaccaagaactcaaactttttgtatctcgacactctgcaagattctctcctgaagtcccaggtgaggcttccgctcagtgttggtcagcctagaattccaaaggacaagg

SEQ ID NO: 115787 - DNA, 1764 bp, Homo sapiens
tatgattatttcaaaatgtaaaaactacaagcttttattttttctctgtaggttgttctggcttttttactatgattgtttgtaagacttctttttttgtgtgtacaagtcatgtggttctcattgtgttcattcatatttggactgactttatagagtgacaactgcatattgcataatgaaaggctgcaagcattgctgaagaattaaccatttctagacccaagacctagtattgctcctgtggagtaggaagatcaagttcccccaaactgtcactttagcctaatgtaccccattctcctctcctttctcctgctatcaccttcagtaaggattagttacctacctagttgtatagtgttatgctagaggctgtgtttggagattggcctttggacacacagcatctttactattcttgccaatgctagaaaggactgatattacgactttccctgtcaagcctatgagtacgctttacaggccaaggctcccctctgggaattaagcatctagaatagagccattatagtcatgctcctgtgtggggagcatgaaggtttccaaccaggactgtaaggtgataaaagcacatgtcagattcagtttcagataagtgtgttttaaagagaagagatgttagaggataagaagacatggagatcacaggatgatcactggattgggcccagggaagcctttagcttttcctgaacaaactggaaaggttttatggaaaaatttgaagtctgtttttaagtgggtccaagtctagtggtctctagctaactcatgtacttcagttcccctgaaatggaattagctgaacattttcctttagagtttcaagaatctttcattgttttttgagacagggtctcactatgttgcccaggctgctctcaaactcctgggctcaaatgaccctcccacctcagccttccaagtagctgggattacaggtacatgccaccacacctgcctaatttcaagaatcttaaattaacttagaaccaaggagcaagatgaaggatggatcccctaaaaaaaaatagagccatttttcagccaggtaaaacattgttaaaaatagcacctacaatataccaggcattatagggtgcttggtgagtgaggacactgtgaagaacaaaacaaatacagtcattacctttattacacttatattcttgtgagaggagaaggcatttaacaatcatatacagaccaacataaaatctagccccctgcatcaaatccaggcttcaaacagatttttgggaggtttgggtttaaaaaaacatagagacggggtctcactatgttgcccaggctggtcttaaactcctgggctctagcaatccacctgccttggcctcccaaagtgctaggattataggcatgagccaccatgcccagccacagttttgttttgttttaaggccagcagagttatagtaaaatatttattgccttttatgacataagtaaattaaggctcaagtcacccatatatctgtcttatgttcctgttggttatgatagcttttgttgttttttaataattggagttcacttgtaaagactgaagatagcctcaaattgcagctaacagattgtgcaaatggcacaagattgattcctttatactagtttatcccttatactagtttttaaatatggttttgagatttgatttgactatttcttcaggattgtaggtctcattcaagaccactctgaaagacttagtcatcttga

SEQ ID NO: 115788 - DNA, 1025 bp, Homo sapiens
gtcagtggaaaagaatttcatggtgacttaagtttgaaaactgtgacatactccatctaattttttgaggaggcataaattgtatgtgtataaacttgttcaattttgtctaaccatacatttccttagcctatttgactagtcacttctatcaccactctctcccatggatctagattcctgtaaaacacaatctgggaaaggatggattaaatgattgctgagtcccttccagtttttttattccattattctatgaatttttactaaattgtctcatcactcgtatgtagatgggagcttgtcttacttcattcagcttacaatggcttttaatccaggctttaaaatatcaatgaaagaatttcatttagaaaaaactgcctgtcccatccatgagtattcttaattttaggaaagatgcacagctttatgacactcaggctgatttcccagtttgggaattcttggccctggcttttcccacctgtctttaccttgcagacaaaccaaacaagacaaaatttaatcatgtttgcacaatgtcaaacacttgcatagagactatccccaaagtcagctcatgggtgttttatcttcacagtgccaaataggaaatagctacatatgtttcccattaaaatgagaatttccatgttggtatctggtgttgcattgagcttcaggttagctgcttattcactgatctttggaaggaggctgaagattgaacctcaagagttctagggattatctgcaggttgaaggtgttaaaagtcccaggcacattgtttgttatcgctaactgcggatggcctgaattttaataagcatggtcaactgtgcatatcttgtcatgtgaactaccaattagcacaccataatttagcaagttagtacatgcagatatgaacacccttgggaaggaagcaattttcgaatcagattattactgacagtgtacaatttacatgcaggtaatcattatcagaaagtcatgattatccagaaggaaaagtgatttt

SEQ ID NO: 115789 - DNA, 1760 bp, Homo sapiens
gctgatctgaatctatctgaaattaaaatacggtgtaaggaaatgttgagatacaagtatttttcattaatttttttctgaaatgctctgaaccctttcagcctggagacttttttccgctagcaaagttctttcccatgtgctcttatcattgtttctcttcctgttctgatttcagccttaagaatatgtataattcttaaaatggaacttcttagatctcatcctccaactcatcatttcctcttcgatcttcttctgtgtattctaggagaacatttcacatttgtcctgtacatcactgggtcaatattctgcaggatttgttctgctcttgagtgccttaaatgcagatttaaattctgctattgcattttgtatttccttgaattcttttgttcattccactggggacttctttctaaatctctgcctgtcattcagcccaccctgtttttattgttctctgtcgtttcatagtggcaacgtctgcatcttttataggagccaagtgtcattttctaaaattttattttgttcctatggaaagtcatttttagagatatattttttccaccaaatctcaagacagtgctcatttttccttgtgctgcagagtcttttcaaaggtcccatttagagctctgtttgtttcctccttcctgtataagaaggaggttcaggaatccctgaaactccctgtccaggttcagcatttgccagcagagggttgtagggactccttagcaaggctgcccacttgggagctggcaattttacccgctcatctagaacctggaagtcaggttcaggtgtataacctccaccctgggtccatggtccctgagcagccatgcatctggcgtgggatgctagcctgggaagaaatagtctgtctttactgtccaagtttctgcctgtaatcctagagaattagatagaacttgcatttcttctttgtacaaatattacagaccatgaccagcatgcactcctctccaggatcctcctgcctctgcctgtacttacaggtgtttttcctgagacaactgtccagctcaggctgtaacgcagaacagctctctcctctacccccagctctgttgggatctgaggtgaggcgctggaggcgggatggagagcagtggaaaaggaggtatctgataccctgcagtaagcttctttttcctgtcttgcatcctaggattaggggcaggtatttgaagagtgtgtcaaaaactttccaaccttctttgagtccagcagaatggtaaagcgtgggggcccaggagctacagtggccaagttcaaatatgggcttcacctcatgcacaaggtctctgtgcctcagtttccttatctatgaacctactttacagaggatttatgaaaattcagtagctataaggcatgtaaagtgtagaaatacatttttaagagatgtttaaataacaatgcttttacaaaatacaaagacagtcttaataatgattaatgcttttaacttgccattcaaggaaatgaataagaaatgttggtaaagcaggaaaagctgattcatcttgactcagtgttcaaaccaactgtaccattataaagtctacagtattattcagccataattggttcaggattatggtttctttgtagcattatcagttctctatacttgaagttcccaagagccaaacatttccatttttctttaatcagaatctgtcacatttcaaaactccctttcttctttatggatattgtgg

SEQ ID NO: 115790 - DNA, 1125 bp, Homo sapiens
caggatttgaccaggagtctccatttacagttcttcaaggccagtgcatttggtgagctggttggaaggaaactttggagtgttctagaaagaactagaccatctgaatcacctgtcctgatgcccttgtgtggaataaaggagaaggcactgccttgtgctgagtacttaagtgtgctgagcacctaggtactaagtaaagtgctagttactgtactaaacatacccatgggcatgtgctatcccctgagtttctcctgaacctatggaatattgccctcatttcctctattcccacccccagcactccttgaactatctgacatacaggacagctctcttaccacaagctacctgaatgtaaatataattcaaaggaaggacattacaaacaggaaatcagcaattgactatggaagctgaaattgctgtctggagatggccagatactcttttcctgggtggctcaaggagtagtcgggtcatcttcccagggcctcaattgtgtcctctccaagctgtcagtatggccctgtcatccaagacttgtcctcatctctgggttcagttctctgggataatttaaaacctacctccttctccccaagacctcataatctagatggaaggaaaagggggacattctcagttgtttttcataatcattttactactaccctctgtcagatcctgccccaagtcacacctagcctaatgttttgtaccttgactcaattgttggccagccactccctttccctccaattagggtgtgtccttgagttgttttgtatcctcttctgattataaactataaacatatacattttgactactgaccccaagccaaactacaaggaaaatattgtccagagggtgctaatatgggtgcttaaataatatgtgaattattattattttttgccaagcccataccaagatttattttgttattaaaaatgtgtgaacttggttttgagtattttacatttggtcattttgagttgcagggagattctgatttctgcatcttcttccaccctatgggccaagtgcccttcactgctactgaaggcttgtttatggcacatgaaattggctaggttattagcatgatttgcattt

SEQ ID NO: 115791 - DNA, 2742 bp, Homo sapiens
aaccttgagtgtattattttcttagactagtctacaagggatgataggcaataaatatgttccatgactattgttttatgtaagccacaaattaaatcatattttctagttgaattacataaaaagcttatgatctttaactgctgagatccatcttcattcagaattaaatggcaggagcttcccttaatttacctggccaaatcaagcaaatattgattttaaatgatctgtataggtctgaagctctggtttgaagatgtctgtttgaaaataccttttgtgaaaataaataataaagttactcctccctgtttatctgattgttaaattttgtcaataattatgattccttaaaacaaagtacaggctcctatgcccagaattgacaacagaaatggctttgagatgattcagaactatactttctcttattaacatctaatatgtatcaaagccttttctccccgtttaagtagagaagtaaccttaaaaatatttaaatgtgatcaaaggatcttggtcataggattcatgtgtaagaaatgtcataaatagcctcaatcaattactcatttttcatttccaaagttttaaaatagttgacatggaaaaagtattaatatgcatcgtatcttggaaacatgaagaattatcaactattctgtttctttaccagcaggtggcatgacttgttgctctgctggtgacaatataaaacctaacccaccctatcactttaaattgttacataattaaaagagattcctaaagtacttgccccaaatataaaagttgaaagtttaatatccttatgatataaagagttcttacaaataaataagtaaaactttaacatttcagtagaaaaataggtgtaggatatgaacattcaatttacatacacacagaaggtgggtggagaaagacacacatatacacataccaaatggccaataaacgtatgaaaaatgttcaacctctttataaattaaggaatacaaatgaacccaggaagatacacatttttacctccaagttgcaaggttttaacaaatgataccactgatcactggcaaagaggacaagataggcaccttcatattctgctatttggatataaacaaccttctgaaatgaaatttttcaatatatatgaagagtcatagaaatgctcacgtacttcacccagtaattccctaccaggaatttattctatggaaataagcagagatatgcacaaaaaatgttatgtaaaaaaatgcttattgctacgttatttctctatgtgaaaaactggaaaaaaacctgaagttctcaacaatagggcatgtataatcagtaatgattaatcaatagaattcagtatttggcctgcattattataaaccatatcttcgaagaatctttactgatgtgtaatgttgagtgacaagggaagggttcatgaaggtatttttcaatttgatcacaatttgataccaaaataatttttgtcttttccttgacacccaatttcaatgacacccaaattgtaatatgggttatcactgagcagtaggtgaacaggttattttaattttcttccttatctttttctgtgttttttacattttatgcagtgggcacatagtattttacagtcaggaaaaagtatacacattttcaaaaatggtaagccaagcattggagacatgaatcactatcgcttttgtattcctcatggaaatgagattcaatagtaagttacgtgtctggggaaaatagagctcatttgagtcagaggttggaaagctcttatgaatactaacctcagaaacctcaaaatagtatgtggtagaataatgacatggcacgaaaagccacggatgtcagtctgagttaaggttagagtagatacatacaacagtcataagagaaaaaaacttactaatctatgatctccagttctggtaacctctagggtcggtctgtgcctccatatcaaacctttatcacagtgcagtgtactggggctgctgcaacttggaagcctgggttctcgttctggctgctctgcaaatatattttgtacttaaccttgggcaagtcaccaactctctgaactgagagttttcttccagggctggatcgttattcatttttggagtttggcattctgatgcactttctagccctgcaaggtaagatgtaagtctccggggtgtctggccaatgctgaagcagattgaggctccttttgggccaacccttggatcagaggtgtccgaagtcatcttggttcagtcgttttttaataataagttgccgtgacataagttattggaaaggaccacagttgagggtaagaaaggcagtttgattctcttgtggaggttataaaatgaaagcagagatctgtccctgaatatgaggaaacctcgtatatagtttaacaatgtatttttttcttacataaaaatctaagtttgaaattaccatcagactaaatttcatcccatctgtggtagagatggttttaaaattgagactttagaggcagcagatctttatcctgtacacctgatacataagaaaagcccagttcagaggactttagtttttaaccttaaagacaaacatattcagacatatattgtataaggatgtattacaaactttttttttttttgagacagggtcttgttctgtcacccaggctggagtgcagtggcgcggtctcagctcactgcaacctccgcc

SEQ ID NO: 115792 - DNA, 1229 bp, Homo sapiens
ttctagcgtccatcttggatttttctttttttgtctgaatccccatctcagggtatgagtcgttatgaatcaaaggatcaccgcccaataaaaccattctagacagaaaccttttggggttgggggtgcaccattctcctcttctacagcttccagaccactcattgcccatggatacccaccagcctcccacgttcacacgactccatctgctttttttggtgtctgtgtcttctggagcattgaccaggccagtatagggtaccgttccctgcacccagagtttcactcccacctcaaactcttttacctcctggggtacatgtccacgctttactcctctcctgccctccagcttctttctttctttcctcccatttctcctctcttcccctcccttttgcctttgctctgcagagacactggtgccgtgacacacatctgagcatggctggtggggctgaccagtggtcaccagtgcaggatttaagtggttggagcttaatagtagctacaagtctttaatttcttcagcaggtttttaatggcctttgatgcacgttagaaaagacatggaaagtcctgaattcagagccttcatgctgggtattgtatagtcagaccagccctgtctctggactgaatgggtctcttgaaatcataaatgcattgcttagggatcagtagcctcggagtgacctttctcactcatggctttcctgaggctcagaaaggccaggccttgtcctgggtgagccagcctctcagtaccctgatggcatgactcagaaagctggacaatgccctagaatgactttctccattaagcccaagaaatattgcatagaatcagtctgtctggaaattccttatatggagaggttctgagacgattgtatgtttggtttgcaagaggatcatggtttaaaaaaagaaaaaaaagcctaaggcagtgatatcatattacttacaggcttggttaaaaaagatagagaaaatactccttcaaacgtttccaccctaattctggattacactggggacgacagcaaatcccattccactggttctggctgaccttccctgcatcttggagcaaggaactctcactgtctgcctgtttctcccagcacagcactgcagagaggcccagaggctataaagccctgccacgtgtttctccaaatgggtggtttttattatttctggaatgcagtccccagccccaa

SEQ ID NO: 115793 - DNA, 1045 bp, Homo sapiens
cccctggccatctgagttgtaggagactgttgttgcttgtgtgagattctagagggccccatccctgcctatctctggtgctgcctgtgaattatactctgttttggtgaaaatcacgctctgtccagctgtggggagcactgtctgggacaaattcccttctcagttcagtttgttaatagtttttaagaactacctttgtgcagatttgttccctggactgttgaaagggagggcactagtctttaaagacagtgatagaaaccctagtggaaaatgctcaccaacacagtatgaaatgatagaaagatactattgggaatttgggatctctggcttcaacctttttatttctctgccaaaagaaaatacgaaacctcagaggaacacaaagaaagagaatgatattaagcacagaatgattttaatctttggcagcaacccatatgcttaaaaaaaaaaaagagggaaccgtgtttccattgtcatgcacctgtcattacactgaatgagttctttttctctcttgatggatggtggtcttaaaagcttgctgtttttcattagcaaagtgaaatggggtgccagtgctaatgctttgtcattctgatggagaataatacatgaatcagtgtaattattcagtgtttgcataatcagcaagattttgaaggggaatgttgcacaactcagaagtggcctaatttcacctgacaatattccattcagactccaagcatctccttcaagaagcagtgaagtgttggtggatttccttaaggccccatacaatgatgatgggaaattgagttgtcctaaatcactagttaattatgatatgcccagcggtcacttggaggttcttgctctagatctcagtttatattcatccctattgttttagaaatgtcatttatttatcatgcatgaagcatgacatattgttccacgtgggttcagtaacgaaccaccagccaaatccattaaatttcattgaggagtgaagtaagacccagaaatgtgggcaatttgagaggaatccccc

SEQ ID NO: 115794 - DNA, 1095 bp, Homo sapiens
caattctcctgcctcagcctcccaagtagctgggactaagggactacaggcctgcgccaccacgactggctaatttttgtatttttagtagagacaaggtttcaccgtgttggctaggctggtctcgaactcctgacctcaagtgatccactcacctcggcctcccaaagtgctgggattacaggcgtgagccactgtttctggcccaaaatcttcttaaaaaacaaaagaaaatggcaaagcctagaaccaagatgtcacctttctcggtaaagctgaatcagaaaggcccatctttgttgctggggcaatatcttgaaggttacctgtgcctcatcacttgctctgtaactatttgtattccaggtaatatgcgtcactggatgaatcctttttagtgattaaaaaaaaaaagaaaggggtctctacccttatggggtagtgagacattaagcagataatcacaaaatgcagagaaagaaaggcaagcccctggcatagatgcttggtccctggaagcccagggcaaggcctgcgaggacacgccccagctgtgcatctgctgggtgatcaattggccagtattcctgtgccctcccagggactacccatcctctcctccagtacagacagaaggtgagtggtgtgctgatggccagctgggagggaggtcttgagagacatgtcaggggaaaaaattggttactatttgatggagtgggcttggtggtttgttgcctgggaaacttgctgactataaaatgaaccagaggaggatccagtttgctgtctgcactgacagatttacagacaggaaaacaaagccttcttaccggatccaagttaacatgaaaattaaaaggagtctatgcaaagcggagttcaggacagtggtttctaaagtttcttttacttacacaggaaagaaaatcacccaaactaggtgaatggtaagtttctctaaatgtcagaacaatcgattataaggcattactcagtttatagccaattatctacattgattaagtataaatttcatgatagttatgagagatattaagattttaaaaatggaaattattttataaaatactt

SEQ ID NO: 115795 - DNA, 1079 bp, Homo sapiens
gtgtcatcactgggttgtgtttttaatcacttttgacatttcacagtgattcctttttctaaacacatttttatttttagataactttagatttacagaccagttgcagagatagtacagagagttcttgtttccccttcaccctgcttcccctactgttagcaacttacataaccgtgctactttttatcaaaactaagaaattaacatcctgttagttaaactacatggcagattttttcctgatctctccaggttttccactgaatgtccttttaccatgccatgatccaatgcggtatcccacattgtatttagattgtggttctttctaaaggtgcacaccagaacagcattctagcagggtgtgttcctaaattatcctatctatggatatgtttttttttacgtaaaaagtagatgtttttttcctccaggagtggagagagggacacagtgaagcaattggcctctagctctttgaaataaatgggattccttgttctgcaaaacctggggtcggaccccgttcactccccttcctaccctgagcattatgtggactgacaccaggtctgtgaaggaaaaactgaagaataaagaaagcatttggaaaatcccatggttgttttattttattttattttattagacagagtctcactctgtcactcaggctggagtgcagtggcgcaatctcggcccactgcaacctccacctcctgggttcaagcaattctcctgcctcagcctcctgagtagctgggattataggcacccgccaacacgcgcagccagtttctgtatttttagtagagatggggttttactatgttggccaggatagtcttgaactcctgacctcgagtgattcacccagaatgctgggattacaggcatgagccaccgtgcctggccccatggtatttttatagcatttcttataaatcaaccaagtttcttgaaaacaataatttttgttcagaagtactgttgtgagtgaggagaacattgtgcagctcagcctgtggacatacagtggctgcagcgtgggccccaggctgctctcatgctcgctg

SEQ ID NO: 115796 - DNA, 1901 bp, Homo sapiens
ccctctcttcctgcttctcacctcctctccttcagaaacactggttttcctttatggcacccaccaccacacttgctactcctggctgccactgcatgaaggcaacaggaaagcccagcctggtaccctacacctgtgtaccaaccacctctgctcctcaacctcacttccttatgtactgaatttcttaagccctctcttgggataaacattaaaggtagcagcaaaaaatagaaacctgtctgactaagtgagcaagaagacgataggcgaaagcaggaaattttttaatctcatcctcttaaaacgtaaacaaaaacaaggcaacttgaaaatgaaatagcatggccacaaaataagagctatggtgtgcaaactgagcagtaaaagcataagatatgatagagatgcttaaggacagtagaaagatgagctatccacttctgacctcagatttcatggacgtttgtgataactcagattcggacagtgctttccaatgcagttcccatatgttaccccatttaaatctcagagcaaccctgagataagaattgtcgttgttcccattttgcaaaccaggacttggtaagatttagggactcaaacatgattcttctggttccagcttctgttgccgtgcacaatatgggaagcagtgtttcctctgacccacacagggacacagagcaagaccaaagtaccccagaggtccaactgagtatcagagcagaaaagagctctcaagagtagccagtccaaactcactccccattccccactgcccttttacagatgaggaaacagactcacaaagaccttgtaagtcacgagtcagaactgagtagtagcatcattacgggctggaagatgttaaaccttcccagttcctaatccttgtaggtttatttgtagaaggcaataaattataagtcagctcctcacagcagcccaagtggccagtgaccagcacttagtcagtgcttagaaaatgtgtgttaaacagatggaggaatgattcactgactttaattgtaaccgtatgcaaatcagtgcatttcttttatatctgtcttgacctacttttcctacccaaagatgttgtttttcactcagtttggaatgagagggtaatgtttgtagaaatcccaagacaatcagctgagaggccctgtaagtgcataaagtaccattagtggtattattgagttgcttttctatggtactgtgggttaatcaaaggcctttgtcattgttgttttaaacacaaatctccaatttattatttagttcgttgcttttattaacttatttgaaatgcaaatagcagcaaacacaggtcaacagctgcagctgtgggatgcagccagtgagagccaagggacaagatggagatgggattcccggggacagggagccatgggcttccccaccctccctggggactgactggggaggacacctttgattacagggatcggggagggtctcaggggcaagtgggcagcagaatctaaaaggaatgattgatctcagtccctggaagtggagaaaaatgactagacagcctgtaccttcctgataagtttcccctaatagattcttgctgtaaaagcaaagcccaaaaccttccagtaattgcttctggactgtgggaaatgacagtgctgaaggaaataatacaggcaaagcagtttcagtaatgccttgcacatagaaagcagttactaaatgctagcctttatcactctttcttgctctgtcacccaggctggaatgcaatggcacgatcttggctcactgcaacctcagcctcccgggtccaagcgattctcctgcctcagcctcccaagtagctgggattacaggcatctgctactacacctggctaattttttttt

SEQ ID NO: 115797 - DNA, 1369 bp, Homo sapiens
caggagaattgcttgaacccgggaggcggaggttgcagtgagccgagatcgcgccactacactacagcctgggtgacaaagcgaaattccgtctcaaaaaaaaaaaaaaaaaaaagaaagaaagaaagaaagaaaagaaaaaaacagaattgacagccagttcagaaaccttatgaagagctagtactaagttatcatcaccagagagtgaaaaggaccttcaagtccaagacagcactgcagacacatcacgccatgccaggcaggggactgaactcagtgctgcgtgcaacctaacattctgtgatgaaggattaagtcatgccactagcaaagtgggtgtgattggcgagagatgagtgtctgagctggggagaaaggaaagaaccaaaataatggcagaaatatttttatcctgtaaaagtaaaagtcactgtcagtgtgacaattgaaagaccttttcattccctctgagatattttcaaagtgattaacttgaaaaatcttcgatgtaagggctgtaacatgactgggggggcatcttttttttttctccttcttctcttacttcttggaggaaagatgaaataaaatggttttaagaaaacgaaagacatcctgaaaaagaaagttaacaaaaacacaaaaggaaaaagctccctataaaaagcttactacctgctccctgcagttacaggtatcattttatgttagcgcttatgaaatatttctaaaaaaaaataaagatgttcacatgggttttgcttccttgcttaaattctgtcacctcggtggagtccagggtctttgctgcttacacacattgtgcgggacccaacatagtagggacttggtaaatgttaaaccatcatcattaaaaaaacactttctcttccactttgagtcctttaagttttatgaatgcatgcgggcagaatattaattccagcacagtgagtgttgctcaggagtgattatgccacctggcttgaagccttccagtgcacttgtggggattttcatttcactcatcatttaaagtttgtcatgaggggtctctgtgaaagaaaaatatagaggagcctcggctgggtgtgggggctcacgcctgtaatcccagcactttgggaggctgaggtgggcagatcacgaagtcaggagatcgagaccagcctggccaacatagtgacaccctgtctgtcctaaaaatacaaaaattagctgggcatggtggtgcgtgcctatagtcccagctacttgggagactgaggcaggagaattgcttgaacctgggaggtggaggttgtggtgagccaatatcacgccactgaactccagcctgggtgacagaatgagactccatctcaaa

SEQ ID NO: 115798 - DNA, 1118 bp, Homo sapiens
catttattgaacaggactatatcactaccctagatgaaaaagcagtgccatataaccataaacatattcattacatataaaatatgcattactattaaaatgtgaaaaagctcataagtgtatcaccccaatcttgcatactgccagtagaacatgtactgcatgttgggagacaccgtgatagagcatgctatgtgctgtgacagagcaagctacaaagcctaactgtagaaccagatagactagaagggagaaatcctagtgatagcaaacatttcagtagctctgagatcccatcatgttctaccctcacaacaactcttagggtaggcattattattatccccatttaatagacagggctcagtgttacttgctccaaatgacactagtggcaagaggacttaaacccaggtcttctggctgcaagtcccaggccctgaaattttaccctgtaatatgctagctgtggtttggcaaatgtaggagaaactacatcatgtacaaggtatatcccagcactttaagcctcagagagttttctcaacattttctcctagagtaatagcttctgtggcttgtacagagcctccctaagcagcactgatttcatgatcgtcaacagaatccagggaggtaagggcagtgtgcagacccctttccagcctctggggagagaaagaagtggccactggaaccttggtggagaggagtattccaggatcccggtacacgatgggcatctgtttgtaaaaatgcatgtaaatttggcctccaaaatattccgtgtagtctagttctcactgaactgtggcccactgataacagcagtgttcactccctagagaggtcgagacagcagcttcccagcactcagaggtgtcttcctgattctccccctggctctgtgagataactccctttagccctttttttgtctgcagccagcaagacctggtgataatgtgaggcccgaggccgagctaatcctccctgtagaaatccaacagtgaagcgtcttgtctttatgactattcgccgaggatgtgtaaagggaaatgcaagccccaggcagcagtagctggctgggttccagagtcaaaactgaattaaaaact

SEQ ID NO: 115799 - DNA, 1049 bp, Homo sapiens
ttgaccttaagaagtcccttcctggccaatcaccaagctggttgctgtggcccagcctgatgctgccactaccaatgatattgtccccctcgcagttttactggggaaaaatcaactcatactatttctccctggcctagagctaacaactttctgagggatggaaatcagtagattctaggtttaatatgtgttatgtcggccatttgcattttttctttttttttggttttcttttcaatagccaaataccaaaaaagactaattagatttttgtttttaaaaggcagctggttttgagaccgaataatagtttgatgatttggtttgataataacagatgagggtgaaaggtcaaccatttccctggatttgatcaatggcagtagtttgatggcaaattaaatatcagataaacctgtcaagtgactccaagaatcaatatttactgggaaaagttgtttgagcctttaatgattacatttgctcccaagggaaataatgctagaaatatgttcaggtattaggataggaatacataaaaatcatgtgaggatgattttaaaggaggtcacttattatgttgttattgatcaataaggtattcatcatctgtgtttctggccaagcctagcgccaagcatgagagccacatttctgcctcttattggacagagccatctggagatcctacagggacctcaaactcagcatgcctccaagcaaactctctgtcatctgtcttcctgcttccctttagaatagcttattagttgaaagcttggactttggatactgaacacctggtctccatcccagttccgctactaactaatgcagaccgttgggctgttgctccactgccctgtgccgcctttgcctcctgtgtgcaatggggatagtggcttcctcatagcattaatgtgcacattacatcagatcacagacataaagagcttaggtcaggtcttgaatataccttagccatttttcttattcagccctttatgcaatattgattgcgcatctgctgtgtatcagaccctcct

SEQ ID NO: 115800 - DNA, 1037 bp, Homo sapiens
atcaaaggattagattttgtcactacccatttctatgtattagccttgtattcagtcatttttggacccaggagggatggcacctggcacatagaacgtgctccaatgtgtgcatgaccttaaaaccagcacgcacattgaattatgcttttgccacctttttgttcatgttccctgttgcctctgagacacccagcctagaaaaagttcttttccaagcctcaggctgagatgtgcaagagcggatgaatgcgaaaagatgaatgagttgattgggggagttaatttgatgcagaggacccctgagaaatccagctacctccagggctaggagttttacttccctggagacagattctgtgtaatttcctggtaacaggtggccttctgttttctgtgctgatgctattggtctttggggatccgtggaattagaaccaagtctcctaccacctttgttttctaacagcacctctgtggcaggggtgagggttttgtgtctcaccctgctttgggatcatgtcctccctcagggctgaggtaggtttttgctccaggggagccgaggaagtcttctgttaggctgggttgcctcgatccttctcctggaccctctccggagctctaagctggggcacctgggatggagagccgctcattgtagcttctcagagcatggttactgggtaaactatgttcacctctttctcttcctctctgtttttcgtgcttagaaatgatgtggtgggatggaggggcacagggagaaccacctgggggctgcttgtgaggcttccttatttgctggtacctttcctccctctgaaaaggaagttttggggattccttccggccaggcctctgggccccagcgttagttgccagggatagagaagacttctgtgaggggctctggaagaaaaggttcactacaaaactctgctgcttcaggcgtctcccctcctgcctcaccagctcccattctcttcaaatcaaccacacatttgctttacctgccatgtgggtttctgcagaaa

SEQ ID NO: 115801 - DNA, 1046 bp, Homo sapiens
tagaagtgccaagtgcttagaacagagcatggcacataatgactgaaatgtaaatattagctgtgattgttattattaccaccatatgaaactgttgctatggagagtcactgggtattttggagcccagtgtgacataagaacttggttgaagccaagagtccctggtcacccaggccagaggagttgctatcactccactttccacttcctttattatagttgagcgcttttgagatagagttgcttctcggacatgaaagcagccaaagtccctgggaaccttcattgtttgcagcgtcccttctacccacactttgagcatctctgtgactgtatcctgtttttgtaaatggagatataattcaaggaccataaaattcatccctttaaagtgtgtaatttggtggtttttagtgtatttacaaagttttgcaaccatcacccttatctaattctagaatacgtctatcacgccccaaaagccctgagctcatcagcagtcggtctccattcttccccgatgccgacaactgcgaacctgcctgtcctgatttgccaattctggacatttcatataaatataatgatatactatgtggccttgcgtgtctggcttattttagcctaacagtttcaaggttcatccatgtcgtagcatgtgtcagtactgcattcgtttccaggctgaacagtgccagtgtatggatagcccacatctgtgtatccattcctcagttgacggacacttgagttgcttccactttttggctgttgtgatgtcacctgtcatgactgacttctgcctgctttagatcagcaggacctctgacaatccatgaaggtgtgaagctgaggaaagtgatgggatagcaatctctgttactaacagaatcgggaagtaattacagcttgaaaaaagctggagaattacagcctgggcaacatggtaaaaccctgtctctaccaaaaatacaaaaaattagccgggcatggtgttgcatgcctgtggtcccagctactcaggaggctgagatggaggattg

SEQ ID NO: 115802 - DNA, 1158 bp, Homo sapiens
gaaactttgaaaatggcattcttgggcaaactgataactacacttattggctttgtggatgatcctacagccagggatccattcaaccctcccgtgctcttctggcctccaggagaaattagacctttggggaatgaatgctttttgctggtaataaactcccatggctccgaaggctagccctgtcctgaaggtgggatggcagcactgcccatggctcagggcctacgttctgtgctttatttcaggtgcgcttaatgatcactgatgctgcccgacacaagctgctcgtgctgaccgggcagtgctttgaaaataccggagagctcattctccagtccggctctttctccttccagaacttcatagagattttcaccgatcaagaggtaggttcgtgtctgagaatatctgtgcttctagtggcttggttgccttaggttcctctttgagagcactgggggagacaaaagaagaagggagggaacctcacagctctcctgaaataagcaaaactgcatgatccaaaatactttatttctatggctcattgccaaaagaatttagagcactcatttacaattaattggaatcattcttaatgtgcctgagatatagatgggaggggttggaacagtcaacactttacagatggtaaaaatgatggagaaacttgaaatgtcagagcccaaaagaaaacctgcgtttcctgttttctgaaataatactccaaagatatctggggcttttggcacctcgttttccaggcctaattatttcagatttcttttactttaatgcctggccccagtgtttgaacttgggctgtttgaacagcccacaaaagagagagggctttacaaaaggagccacgtaggaaaatggggcacgtctgtgacccaagaaaaagatggctaaagtagctggactgaagctggatcattcatatttctaatgcgtatcttattcaaagatgacacatataaagtgttgaaaactgtgtgaagttagtcgtattttgtaaaatgagatcaaagattttgatatgcttatttctgcttgggaatttatcctggctgggaaactttccaaagtaatgcaccttgtttatctagcttacatgtttatagcaattacagaaacaattcagacccatcc

SEQ ID NO: 115803 - DNA, 1615 bp, Homo sapiens
gtgaagggccacgtgtccttctgcacttaattttccttggccctgaggttcagagaaagctctgtttgtacttttcatcactggcaagaactgtaagcacactgcccaacttcatctgagtcacctggaggcttctttaaaaacactgatcagaaggcataataatgttcactctccagccactggggtggggagaatgtaaaactgtgaaaaggaacatttttgaagccacagctgtcagaaggtgtggcgtcatctgcatcttgaaacacataccaggatgggatcccccaggcaggcagctcctttctcagaggcttcagagctcactcacagttggttcatctttaccacttcaaaatgcaagctttggctgtgtcttcttccaaggccgctagagttcacgcatcttgcctcattcatctcggtatccattgcacctgcacatagtaaaggcctagtaagccgctgttcaattgcattgaaattccaaagctagggctacaattctcactctgcctactgtcctgaagttgttgtttgatcactataatgtcagaatgttttgcaagattatgtccccatgtgcatgttgtacccggaggcaggtgggcatttgtctagtagctctggggtcacacacattattagcatcttgcctcagggaagagagaaagctgcagaaggctggaagtggcccaatgacatggtgagcagttaagtggcctgcttatagctcatttgcatgcacatgggcactttccacattcctgtgcagttctgtagttattttctagtggttggtttctacccaagtcattggtttgtcttttttgccgaaaaaccagacaaaggaaatatgtaaagaaaagtgtcattgccaagattttcaataaggaagtaacacgatttggcatatttgcatctcaaataatatccctccttccccttctttaaataaggttgttatgaatattgctgcttaatcatttttactagattatggaagcaaaattttagcaccatggactgtgcacgtgtcagattttgccactaattacagaaaaaaaaatttgccctaactgaagaactcgagttccgtggaagggcagattccccagggtttatacttattggggtaggttctggaggacacatattttgattatactcaggcaggtatcattatggtcagagaccatgtcatattctcttctgccacccacaaagaaaggatgccacagctaaagtgaattgaaaaccactggactggaccagtggttatcagccttttggagctaggattgcccattgttgccttggaaaaatggttgagtaactgaataacaaacggaccttgaagaccacttgttgtccagctcttttccttttatccagtccttgaaacatactagttaactccagggaaaccaaaaccacaatttgggacaaacaaaaatgatactttttaaaaaatataagaacagctaaaaataaatggactgaaaaaatagaactatcagtacactttgagcttcaggttttggagtcttaatcactggagatcaattaacaaaaccagaactaacagacggtacaattgtctggctaaccc

SEQ ID NO: 115804 - DNA, 1215 bp, Homo sapiens
agtggaataaaagaaaatattttttattagtggtgaaatgacccagacagctttctcttgtgatagtttaacgtttttttttaaagggcatctttgcctttattctaggggtaatattcaaagtgtttcataaccactgcagcacaatcctcagttgcccaggtggtcactggtgttagaactggagcagagtactggcattcccctgctgggcaggaatagatggtggaggggttgttggggaggtgccagggcgagtgggtactggttgaggtagaagccagtagcagcggggctcaggacaaaggctgttcaccttccagtagggaagtatttcagcatttaagcaaccaacatcactatgagagtgcatgtctgaaactggtcctatgtgcatcctgtgatcctgtaacacatagttatagctggagatgatggatcagtgatgataatcacttacaccttttctttctttctttctttctttaaaacccagatcggggagttactaagcaccacccatcctgccaacaaagccagcttaaccctgttctgtcctgaagaaggggactggaagaactccaatcttgacagacacaatctccaagacttcatcaatattaaactcaattcagcttctatcttgccagaaatggaaggactttctgagtttaccgagtatctctcagaatcagtggaagtcccatctccctttgacatcttggaacctcccacatcgggtggatttctgaagctctccaagccctgctgttatatttttccaggagggaggggcgattctgccttgtttgcagtgaatggtttcaatatgctcatcaatggcggatcagagagaaaatcctgcttctggaagctcatccgacacttagaccgagtggactccatcctgctcacccacattggggatgacaatttgcctggaataaacagcatgttacagcggaaaattgcagagctcgaggaagaacagtcccagggctccaccacaaatagtgactggatgaaaaacctcatctcccctgacttaggagttgtatttctcaatgtacctgaaaatctcaaaaatccagagccaaacatcaagatgaagagaagcatagaagaagcctgcttcactctccagtacctaaacaaattgtccatgaaaccagaacctctgtttagaagtgtaggcaatactattgatcctgtcat

SEQ ID NO: 115805 - DNA, 4382 bp, Homo sapiens
agtacaacatcctggaagggttggaaaagctcaaacatctagactttctgaagcagccactggccacccaaaaggatctcactggccaggtgcccactcctgtggtgaaacaaacaaaactgaaacagagggctgatagccgagaaagtctgaagccagccgcaaaaccacttcctagcaaatccgtgcgcaaggagtcaaaagaagaaacccctgaggtcacaaaagtgaatcacgtggaaaagccacccaaagttgaaagcaaagaaaaggtaatggtgaaaaaagacaagccaataaaaacagagaccaaaccttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagacaagaaagaggagaaagaaaagccaaagaaagaagtggctaaaaaggaggacaaaacacctatcaagaaggaggaaaaaccaaaaaaggaagaggtgaaaaaagaagtcaaaaaagagatcaagaaagaagagaaaaaagaacccaagaaagaggttaagaaagaaacaccgccaaaggaagtcaagaaggaagttaagaaggaagagaagaaggaagtgaaaaaggaagaaaaggaacccaaaaaagaaattaagaagctccctaaagacgcaaagaaatcatctactcctctgtctgaagcaaaaaaaccagctgctttaaaaccaaaagtacccaagaaggaagagtctgtcaagaaagattctgttgctgccggaaagccaaaggagaaggggaaaataaaagtcattaagaaggaaggcaaggccgcagaggctgtcgctgcagctgtcggcactggagccaccacagcagctgtcatggcggcagctggaatagcagccattggccctgccaaagaactcgaagctgagaggtcccttatgtcatctcctgaggatctaaccaaggactttgaagagttaaaggctgaagaggtcgatgtaacaaaggacatcaagcctcagctggagctaatcgaagacgaagagaaactgaaggaaactgagccagtcgaagcctacgtcatccagaaggagagagaagtcaccaaaggtcctgccgagtcccctgatgagggaatcactaccactgaaggggagggcgaatgtgaacagacacctgaggagctggagcccgtcgagaagcagggagtagacgacattgaaaaatttgaagatgaaggagccggttttgaagaatcttcagagactggagactatgaagagaaggcagaaactgaggaggctgaggagccagaagaggatggggaggaacacgtatgtgtgagcgcctccaagcacagccccactgaggatgaggaaagtgccaaggcggaggctgatgcatacatcagggagaagagggagtctgtggccagtggggatgaccgagccgaagaagacatggatgaggccattgagaaaggagaggctgaacaatctgaagaggaggctgatgaggaggacaaagctgaagatgccagagaggaggaatatgagccggaaaaaatggaagctgaagactatgtgatggctgtggtcgacaaggctgcagaggctggtggtgccgaggagcagtatggattcctcaccacaccaaccaagcaactaggagcccagtctcctggccgagaacctgcatcttcaattcatgatgagactttacctggaggctcagagagcgaggccaccgcttctgatgaggagaatcgagaagaccagcctgaggaattcactgccacctctggctacactcagtctactattgagatatccagtgagcccacccccatggatgagatgtctacccctcgagacgtgatgagtgatgagaccaacaatgaagagacggagtccccttctcaggaattcgtaaatatcaccaaatatgaatcttcattgtattctcaggaatactctaaacctgctgatgttacaccgctcaacggattttctgaaggatcaaaaacagatgccactgatggcaaggattacaatgcttcagcctctaccatatcaccaccctcttccatggaggaagacaaattcagcagatctgctttacgtgatgcttactgctctgaagtgaaagccagcaccactttggacatcaaagatagcatctcagctgtttcaagtgaaaaggtcagcccatcgaagagcccgtccctgagtccatctccaccatcacccttagaaaagacccccctgggtgaacgtagtgtgaacttctctctgacgcccaatgagattaaagtctctgcagaggcagaagtagccccggtgtctcctgaggtgacccaagaagtagttgaagaacattgtgctagtcctgaggacaagactctggaagtggtgtcaccatctcagtccgtgactggcagtgctggtcacacaccttactatcaatctcctactgacgagaaatccagtcatctccctacagaagtcattgaaaaaccaccagcagttccagtgagttttgaattcagtgatgccaaagatgagaatgaaagggcttcagtaagccccatggatgagcccgtgcctgactcagagtctcctattgaaaaagttttgtctcctttacgcagcccgcccctcattggatccgagtctgcttatgaaagttttctaagtgctgatgacaaggcttctggcagaggtgccgaaagtccttttgaagaaaagagtggaaaacaaggctctccagaccaagtaagtccagtttctgaaatgacttctactagtctttaccaagacaaacaggaagggaaaagcacagactttgcaccaataaaagaagactttggccaagaaaagaaaactgatgatgttgaagccatgagttctcaaccagcactggctctggatgaaaggaaattaggagatgtttctcccacacaaatagatgtcagtcagtttggatcttttaaagaagacactaagatgtccatttctgaaggtactgtctcagacaagtcagctactcctgttgatgagggcgtagcagaagacacgtactctcatatggagggtgtggcctcagtgtccacagcctcagtggctacgagctcatttccagagccaacaacagatgatgtgtctccatctctgcatgctgaggttggctccccacattccacagaagtagatgactccctttcagtgtctgttgtgcaaacacctaccacattccaggaaacagaaatgtctccatctaaagaagaatgcccaagaccgatgtcaatttctccaccagatttctcccctaaaactgcaaagtccaggacacccgttcaagatcacagatctgaacagtcctcaatgtctattgaatttggccaagaatctcctgagcaatcccttgctatggacttcagtcgacagtctccagatcaccctacagtgggtgcaggcgtgcttcacatcactgaaaatgggccaactgaagtggactacagtccttctgacatgcaggactccagtttatcacataagataccacctatggaggagccgtcctacacccaagataatgatctttctgagctcatctcagtatctcaggtagaggcctccccgtccacctcttctgctcataccccttctcagatcgcttctcctctccaagaagatactctatccgatgttgctcctcccagagatatgtccttatatgcctcactcacctctgaaaaagtgcaaagtctggaaggagagaagctctctccaaaatctgatatctctccactcaccccacgagagtcctctcctttatattcacctactttttcagattctacctctgcagtcaaagagaaaacagcaacttgccacagttcctcttctccaccaatagatgcagcatccgcagagccctatggcttccgtgcctcagtgttattcgatacaatgcaacaccatctagccttgaatagagatttgtccacacctggcctggagaaggacagtggagggaagacacctggtgactttagctatgcctatcaaaagcctgaggaaacaaccaggtccccagatgaagaagattatgactatgagtcttatgagaagaccacccggacctcagatgtgggtggctattactatgagaagatagagagaaccacaaaatctccaagtgacagtggctactcctatgagaccattgggaaaactaccaagacccctgaagatggtgactattcctatgaaattattgagaagaccacacggacccctgaagagggtgggtac

SEQ ID NO: 115806 - DNA, 6018 bp, Homo sapiens
aggcctccctgtgtatttggacctgtgctacattcctaaccacagcaatagtaagaatgttgatgtggaatttttcaagagagtgcggtcttcctactacgtggtgagtgggaatgaccctgctgctgaggagcccagccgggctgtcctggacgctttgttggaaggaaaggctcagtggggcagcaacatgcaggtgagaactcctcgacagtgtctgcactgccgattgagctgtgtccagaggcaatgggaaggaaccatgtttaaagaggcacctcatgtggctgatcgtggatccacatgaggtgcctcctgtgtctgtcacacacgaaatatcctgagaacaaagtcagtttaacacacagtaggtagtctgaaataatattcttggcaccaccaccaaccacggccttggaggaaagacaccttaactaaagcagaaaccatttatctgcaaaatgggcctaagattaattgcccttcctccagtatgccaagagtcttgtgtgtgtgaatcaaagcggtcatatttccatatgagagctcctgaggaattgcctttcttcctttgtgttttatgagtagactgcggctaggaatatggccatttagaaaaacagctctccatgtgaaattccacagcaggagcattgctgaatatagtccctcacaggacactcccaactcccaaacatcatgcctgaccacaaaccatcccttatttatttaatgacagggtctccctatgttgcccaggctggtctcgaactcctggccttaaatgattcttagaaccagctattattaattcagctgtgatctttgcttatcaagttttatttgtggttctgtacaaaattacctagtaaattgtgcttgtatcatattatatagaattacttgttatttaatcatatgaaatctaatgagaggcacccagtggctccctactgaatgctagatggaatttatactattcaggacattacttacccaccccatacctccatccccaaccacacacataaagtaaaggtgcagatctttgttctcaggacaaaatgttagttactcacaatgagtgggcttttgagggctttgaagtgcgcgataaaatccttggattaaatatgcaatatcttttatgcaaaacttaccagttgtgttaaaggaaatacaaaaaattgtaccctaacggaagcacttctcttaacagtaaagaactgagaaactgattaattgctttttggttccagccttcagtttcccttagaaacaatagcttttctttgcagctttattctggttcctggaaaatatacattgaaaaatcctttgcatttcttgaggaaaatagaaaagttttctctcatttcccttcttcttccagtggtctaataccttgctattcaatttttttcatatggtttctgtttctgcccttaaatagctattttttttttctctccctgcaggtgacactgatcccaactcatgactcagaagtgatgagggaatggtaccaggagacccatgagaaacagcaagatctcaacatcatggttttagcaagcagcagcacagtggttatgcaagatgaatccttccctgcatgcaagattgaactgtaaaaaccaaggccagccacaccacaggatctgaactttgtttccagaaattcttcaatttgaaatcaccttttctaaaaagtcaattcatctagttaagtcgctgaacaattacctgccaaatgctatactgtgtcatggtgatgcaagtcactaaatttctcagtttttgctgattgctaagggaaataacagtatttccacaatagggttcaaattcctgcaaaattacctaccccagttcatctctgctgaacatttggaaaccatgcactagccaacccaactgacttctgctaggtagaggcatttgtcttagagagagagagagcgcgggagagagtgagagagagtgagagcacaaagataacgcaggagagagagagagaaagaatgagaaagaaaaggaatgcaagagaaggagatgtaatgacagagagttctggtgagatacccagagagaaaaagagagagcagggtggggtaaggaggagaaaataaaccaacaattaggtctgcattttctcaggcagtaggcattctttagtctacataggcaaagttttccatttttgtcagtctgagtcatcaaaaagagtcttaattttctaaaacaagttggctagaagaaagtaaaaagaacaacacttgttatgagggcatgtgatattttcacatcttaattaagctccttcagtttgaaggctgcacactgacataatgtagtgagtgtagactggccatgcaagtggtttgggccccattcagaactctcagactctaaacacacaagtagattgatctaaggcatgctcccagcatttgtccacccacttagtccactctgagtcgattaacctgcatgcagcaacacccaagtccaccccaattaactgaagcaaataccaaagcagttgggagtacatatggtagacaatttgccttaggaagtgacttgaatgtacaaagatacttgatgcacttattttttaatgtgagacagcaagtttataaaacatccatataggattatagatacttaaaggaacacgtgggtgagcgtgtgtgggggtactagaagctgatctgattggtccaacagtttgatgctgagtcatgcgtgttgaatcccacttcagtgcacctgtggcctctcagtcaaacaagttgtgcctttcacagcttctttactactgcaagttcaagactgaaatggcttctatgatcagaactgggaaaacagtgaatcttatggtggaagaggttctcagcaagtgtacagtatttaccttcctttgtcttacattggctttttaaattttccattaatttcaacataattatgggaacaagtgtacagaagaattttttttttaagatatgtgagaacttttcatagatgaactttttaacaaatgttttcatttacaggaaattgcaaagaaaattctcaagtgatagtctttttttttaagtgtttcgtaagacaaaaattgaataatgttttttgaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagtggtatcctacatacttctttcaagatcttcaaccatgaggtaaaagagccaagttcaaagaaccctagcacaaatttgctttgggattttcttttctggaaaaaaaaaataaaagaaatagtacattgaaaacaaatgaattctcaactcctacggttcatgtagagtttagagaaaatttccatcattgtcatcattgaactgtgaacctgggaagccagatcatgattaacactgacatcaagtttcaagttgcagatcaatgcacccagtgttcagatgaggcaaacttctccgtgacaactgtgctgtgctctgtcacattacatttcctgcagactctaagatctacggagtagagaacaatgacctcattttattttctatgttagttatttatttcaaaattaacattttagttgatttttgtctgataagtctatgttttgcactgctaactatgatgagggtttaaaaaaatgcttcttcagggtcctttcactgaggacctatgcagtctacttaatgctgtgaattacatttttcaaatgtttaattttttaaagaaaattaatattctatttttgttaggcttctctagaaatgcagcttttatttattaccccatttctttcaagtccttggaaaataacatattaagggtacaagaaattaacacatgatggaaaagtcattgtgacgccaatgaatttcattgagtataaactcatctacttcaaatttattttataacacaacctaagatactcaagataattatttaatggttagctcttaagttgaattggtctacataatgcgtgggaagaaaaccagatttttagccttcttgccaaatccagacctctggttgatttttctttgacagaagatgcaagttattttccaatttcacaattaaatgtatttaacctgaacattattttgctttaaaaactataaacattgtaggagaattatagccagtcttcagttataaccactccaccctcctcactttctctctctctctctctttttttttttttttttttttgctatgggatttaatgggaaaaatatgtaaaaactgtcactagtcagctggctctttttcctatgaaatctatcagtacctttctccatccgttgttctcaatatgaccacagagcctgagtataccaagaaaaccaatattcgcattacaggttgctcctgtccttccagacacctttcctgcctgtgtgactaacctaattttgctagttccataaatacacgattagtttagtaacagccatcacaatgtaccatgtacattcatggtgagagctaaagatcgacacagacttctaggagctttgttcatactgattacttaatccaattgtatagattgaatatttgagtggaaggaatttacactctgtttaaatgatgggattctatcgagatagcactcatgatcatgacctttttggtagtattcttaaacaaaattctacagagactaaatgttagcgatgatcctccattttcaattttaaccaattctgtcccctttctcaaaaccctgagccctgtgcatgctttctcagtcttgtggtgggactggatacaatgactaacttcccctcctcccctctttaaacaccattttccatggagttcaaaaaaattttttttcttaacgttacatatcatagtgaatggtttccccagtgtatatgaatgttttaagtgtctccaatagcttatgcagtctaggagctttccaatactcatttaattaagatttaatcatttgctaatggaaatcttaccacctttcattttccctctgttaccaaatttcagctcttaggagctgctctacaattctgaatttgcttttcttgcctctctttagtcacctgtcacaggaggttcctgctcagtaatgatattgtgagttaggataataactttttttttttgtgcttcagatttagaagaaaagatcctgtttccatttgaaaggaactgtaagcttttatcttttaaccaactgaacaatacaccaaaagcagcctagggatgagcatttctttgaaagcaattaggttattcacctggtattaaaactatttactgttaaaaaatctgtgacttcatgaagttgatttttaaaggcagcatcaaaaactgaaaaggaagggaaaaaataggcagcttctctgcacttgtttggagctccccaaaacaggagccatggagaagtggcatcaagaccgggctgccctttcgagaacaccctgtggcagttcagagacacgcttttcctacactgcatgcagcccctctttccagcactggaaagaagtggtcttgagcccagctgagaagcacttcacactcctctctcttgttctgaatggtgtttgtgtcagtctgcagctgtgtatggtattatgtcttataatcctgcatcacttctatcctatccagtcatatctaatgtagaaaattagtttccagtgaaagtaatatgtagtgcttttatgatatttgtgtgcaatatcccctcttccattgaggatatttgatgtaaaggaaaaaaaaaaactcagttccacaataaaatacaaaagtggcaaaagttcatgtgtgtgctgtgctgtcttttgctttgtgttcctgagttgggctttgccact

SEQ ID NO: 115807 - DNA, 1045 bp, Homo sapiens
atcccaaagcaaatttgtgctagggttctttgaacttggctcttttacctcatggttgaagatcttgaaagaagtatgtaggataccactgggtgatgtacttgtcaaggccctgaaaagtagcctaccatgccattctcccccactctcaagtagcacttttatgttatgggaatcaaggggtgggaggtatcattattcctggtagttatgggtttttaataaatatcattactgcaatatcagacttcaatcttgccagaacttcaaaaaacattattcaatttttgtcttacgaaacacttaaaaaaaaagactatcacttgagaattttctttgcaatttcctgtaaatgaaaacatttgttaaaaagttcatctatgaaaagttctcacatatcttaaaaaaaaaattcttctgtacacttgttcccataattatgttgaaattaatggaaaatttaaaaagccaatgtaagacaaaggaaggtaaatactgtacacttgctgagaacctcttccaccataagattcactgttttcccagttctgatcatagaagccatttcagtcttgaacttgcagtagtaaagaagctgtgaaaggcacaacttgtttgactgagaggccacaggtgcactgaagtgggattcaacacgcatgactcagcatcaaactgttggaccaatcagatcagcttctagtacccccacacacgctcacccacgtgttcctttaagtatctataatcctatatggatgttttataaacttgctgtctcacattaaaaaataagtgcatcaagtatctttgtacattcaagtcacttcctaaggcaaattgtctaccatatgtactcccaactgctttggtatttgcttcagttaattggggtggacttgggtgttgctgcatgcaggttaatcgactcagagtggactaagtgggtggacaaatgctgggagcatgccttagatcaatctacttgtgtgtttagagtctgagagttctgaatggggcccaaaccacttgcatggccagtcta

SEQ ID NO: 115808 - DNA, 1038 bp, Homo sapiens
catattagaattcttatttttggtgtttgctgcttggtttggttaggtcagggtggaaacatagatttgttagaggctggctgtctttgtggtttaaaacaagaaattacacagggagacacagcatatggagttccatttactgtttttgagtgaaaggggagaaatcacatgtggtgcatcttagcaaaattgctgagctgaaaaaaataaccacagctaacagcacctgaatgaaaggcagcatgaccatttcccaacaaaatggtttttttctaccagcaaaatgtgtggttattttgcaggtgacttcattctgggccactagaatgaggactaaactacgagtcagcaaacttttgttcaaatctaaagtcagtcactcagggctagtttttcctctttgtatctttctctcacttctctacctttcttctcatttttcccatttgtttccaacaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggct

SEQ ID NO: 115809 - DNA, 1488 bp, Homo sapiens
ttccccatttgcaaaaagaacatagaaatccatgcgtgtggcctcattcagaaccatgacatgtgcaaaaccagctgggtaggaacagctgcaaatcagtgctattttatagttatgaatatatgtaaaaattggttaaaaaaataattcagtaagtaaaaaacatttgttgtgcttgtgatatgaacaggcactatattttaagccattgttaatattctctgctttaccaccaagtaactacagaaaggaaattgtttgacttgattttcttggcctccatctatgttgtagaatatcaagggaaaataaaaattgcttaaagcctgctctccaggctttaatgaccagcattaatgtgcaaacaaatattttatgttacgtgttatactcaggggcttataatttatgaacgagcatttcccattcccttccaacaagtattttaaactgagccttattgtcctttttatagtcattattttgctgtctttgaaataacacctgagatttagggtttcctttagcattttgtcctcttctgccttaacagtgagaaggtaccagagcagagaatagggcagtcagaccagcctgtctgctctgcctgtcagggtgaccttgagaatatatgtgtctcctttatgccttagctgttctagctggtagacatgatgccttaaatttgcatcacagtttgagccattttctggttgaactgtccaaaattctcttgaagtaggtgaagcaaatagtattttatcattatgacgatgatactgggagccaagagaaatgagtggtttatttaatgtccttcaggacgttggtgcagtagcacctgatttagttcgttctggtatgtaaaatagaagctaaaggctgaggaaaaaccttgtttgtggaagaactagggccagagcctaagcccgcatattttacttcttaattctgcatttttttaaaccatgccccacgttttaagagtgtttatagttaaatagagatttagtaatattacctacaactaatttcctctcttttttactttcatcttctgctagatgctttatctgtggtttttgaggtcatgatgcaagaagcctttgaagtgccttccacccaacttctctccctctatgttttatttcattgcctggcaaagaagacagacttcagtgtaagtgatcttccctaaagcagtattaagaactttagaaaaggcaagcaggggcttgctctcaaaagctggaaaaaggtgtctgcagctctgtggccaggcacaaccaggaatgtgtgtttattgtatacattttggttactggtttctaacaaatggaattggaggttcttccacttgagagaatctcaaaagaaagtcctcgtgcatattttgaaacttgagctaggctgagtgcacctcagacattcagaaatgggtcattggtagtcactgagagctggacatggcatgtcaaagaggcagtg

SEQ ID NO: 115810 - DNA, 1089 bp, Homo sapiens
gctacaacctttaaaacagtggtttttagacatttttccatttcggcacacctgaggctactatatataacacctggaaacagtgagtcagctcagtggtgattcagttgggggttaggactgtatcaaaatctctcaaggggatatggatatagtttggaaaaattcctcaggtgtttctactggttccaagagggaagaatggagccctgtggggaatggtggttaacattactgaagaatttgaaacaaataaaaatgcagccacaatcaggatcattggtagtaaaatgagtatgcatgaaaatcacaagaagctcactaaaaattcagggttttgtgcccaattcccacagattctggttctataggtctgagacgtaggaatctatattgttaaaaacactctgagaaagtcgacatcctgcaggtgctaaagggtccacattttaagaaatctgaattctcaagtattcagttgtatgacacaacattctagaaacttagtagcaaatatttcttggcatatttcttgggaccttaaaagccaggctaagaaccagaaaatgctgtgtaatgtctgctttctcatgagagtctgtttttgtattgttattcatactttataagaagagtcactgaaccagttaggggggttgtgtgggtttctttttttcttttttcttttatgttttttttaagctatgatgaggtgttagaattggagccttagtttttacattatcagttgtcttatatcagactcacaactttctcaccctgaccaacagttcctgttaccaaacctcatgagtcatggcttctgtttcactgtcacagatgctgtaaaatgatagtcaaatattttaaagctaatggtggcaagttttattctgaataatacataggcatatattacagactaaattagataattttctctttttttcctgttatgttcattttcattataggttcaatatggaatttttccagataactttacattcaatttactgatggattctttcataaagaaagaaaattacaaaggtaagaaactaaccccagattcagtgtttatagggc

SEQ ID NO: 115811 - DNA, 1047 bp, Homo sapiens
gcagatgcccttaagagttctgagtatggcctgagttttgagaataggatgcttctcagttcctgctattttattggccgtggtttggcttcctaggcaagctctgtcttcacctgaaaatcctactcaacactggggacagagatctctttagccatgggataccaacttttagaactagagctagaacttgagagtacactttgtcactctttcttatgctcctccaagaaatacacatttcctcagaattgtaagtgtaatcacattttataagctgaaatctcagagtacctttagccttcatgagcacaaccttgttggggatatttgggttgtatttgtttctcttttctacactcacatgtttgcctatcttgacagcctgttggcctaggcaataataaagcttctgtcgaggtgagcaaacagctgatggcataggcgcacagaggggactcctacagtggctggctgtaatctgccaggctggtggtcagagcaggcgagaacaaaagccagtctgtttgcaggcaaattggaaaatcaatgtgttagttgtattcttttctctttgcctttcttctgacagaaagggagaatgctcatccagcaatccacagaattattccaggcaagtgcccattccagagactcactcacctgacatattactactggaagttgaaaagtccccacatttatttgtctgaactgcttaaaaagtcaccaacaggaattcttctcaaacttgccatccaaaattgaaccccgctggcccagtgttttgacttgtttatattccagatagccactcacgtaagtttatctttttaatgctgatgggggccaagaaaggagttcatttgcttcctggctgggaaattcaggaattgcattttgggcagcatattttatagtatgtgtgtaagtatttcactgcttttcctcagtttattttttgtgagagttcattgaaaatgtccaaggctgggcacagtggctcatgcctataatcccagctctttaggaagccgaggtgggagg

SEQ ID NO: 115812 - DNA, 1040 bp, Homo sapiens
acagaaatagaaactagctatgaattggattgtatcactggaagtatgtccaaccttccttttgctacaaacaaagaatgcctagggattcaactttttcatgtgttagagaatcagaatgtttaaaatactgagatgcttttcttctttaataaaaatctaattcttaagaaatcctgattagtactgagcttctcttccctcagaaatacccctaaagaaatccgtaatctcacatacaaacacatataaatctgctcaacactggcttaattcttttctgcttttaccctggtgtgcttcatctcctgggccaggctctttgcctgctcatttcttttgtggcagacttaatcctgacaacttcactaagcctagcatactccagaaattctggtttttatttctattctattcctttgttttcctccttttttttctttctcacctttctttttcccagaattattcaaaaccagtgtttaattaatatatgtgattttcctatcttaatcattgtattatttgtgattttgcagaaattttatctgcagttcctagccaaagctttaggagacatcaggaaatgtttgcatgtatttaaaactggctcatttattgctcataaatttcctactcaaaaaccaaaatatttcgcttatctctgtccaaaccaagccagtttccataactttatatgcttttataaacaggactggttccgggatccagtttttctcaacatcctgctgttcctaggtaaaggccctctgtagcctaaccttggccttcagtaactgcctctcagtcatgaagctgacctgtgagccagtgtgtgtatagctttagagaggctggagaagtcttaccagctgcttctgggtgcagtttcactgataggtcaggtggtggccacaaagccattttctgcttttaggaccatctccagatgggcacctcagtgatgactgtaaatacttgtttcttctcccattctccccacaagtaatcctccctggttatctacacatattgctctt

SEQ ID NO: 115813 - DNA, 1037 bp, Homo sapiens
cctgattcatagtaggttgataaatgatcaaatgcagaagagaggagctttgacctcatcaaatgctccattctgttgtaataagtaatttcatataggtatagaagtagaactattctctctgcagtttaacattcagttttgccttattcatgcttaaaaaatcccagctttcttacttttttgcctaagattattgaaggaaaaagtgtatctgttcactaaaggctgcattcattgtagcagccatgtatatgtggacagtctacttgctaccacacttgaaattctgcttaatgtgcactcataaaggacaagctcccaccccttcgaactcagtgtaattgttcagtatatgagcttgtggtgtttaagaaactagggaggcagaggtattttcatagcttgttatcctcttctctcccacaaagtgcagccatgatctgacacatgatcaatgggccgagccctttttaggatgcagaagatgctccctgtgtctgtggatcacaatagcaaacaatagcaacttctgcaatgatattttgcctccctggtgttcaaacttcttcagttaagcctgtctggaatctatttaactattatacatcaaagctttttttttttttttttttttttttaaatgaaaatggtgggggtggaaccagagaggaaaacctgtatctttgccaaggagccctctctccttcccctatgactcatacttaggaaagctgagggactttggaaagctgcctgagtcacattgaggcaggtctcctggcactttcagacactttttaaattttctcaggcagtaaaagatgtttttcaaattgttcattccctctttctgggccagcctaaaagcttttgtttagctaaagtatggcttttttatgcaagatttgccagccagaacagatgaacccggaactttgtatttggtttattactaaagaaacagctctttcatattcagaattgtaactgttccttcttatgattgtcatcctattaaaaggaattgcctctgg

SEQ ID NO: 115814 - DNA, 1093 bp, Homo sapiens
caggattatattattgatttttagtctgttcaagctgttcaagatcttctcatttaaccccctcattttacagcgctggaaacgataacagagaaggaacgtaagactttcccaaaggcacatagctatttgtaataggactggcatgtgtacagttatatgaaaattctactaaaaatcattacaattataaataaaattgggtggagggtggagaatcaaagttgagggttcaggtacctgggataccttaggtttgattctccttcctgtcagtgctatatatgtgacatgattgtacatctcctatacttactctcccatttacattttttcaagaaatcatcttagggactacctcaaatcctgtgcttactaagaatggcacgtctagttctgtacaggatcgtaccacggcatcttacaagaatagtgatatatcttctgatgatcagtggatcaatatataaggctataaagagcctgctaatgttttcctcttactctggagatctgatagcataacatgagtcagcatagaggctctgagaaaatgagaaaataacagacctattgttttgttttgaggatcacttaagcaaatatgtaaaatcagatcacatagaataattccctgacctcagtgagtcttctttctaaactgcttcctgtctgcctcacccatctatttctgcagttccacccactgcagttttaaagtgactttggatagctgggtgaaaaggaagagggcaatacattaagactcagttaatataatttgcataatgaaattgtcaaagtgttcttggcccaaaaaacttgtttataaatgaaagtgaaagggttgaatggataatttgaagagagtgccttttcggctctatatattcaatcataggatgtcttgccactgagtcagcaaaggtttttctccaacctactccattaaattttattttacgcattctttttttaatacatataagtatttaaaattttgaaatgtcttagttgtgcttcttaaatgtaaagtgcatgctatcccatttgatagcaatttctgcataagcctgtaggtgaataaaacaga

SEQ ID NO: 115815 - DNA, 1042 bp, Homo sapiens
gaaaggttaaataaaacagtaggaaaaacaaagatcaacgcctggaagacagaaaatataacctaggaaatacataatgcaaagggactcttagggcagtgttatgtcccttcatcagaataaattccaggtggacaaaagatttaaatttaaaaagtgaagtcatctatgtgaaaattcaataaggaaatatttgtgtactcttgaagcatagaggccttgttaagcatggcataaatgtcaaaaagcattttagtaaagcatatttatccatatgaaaatttaaaatgacaaatatagcaaaatgccttaatctgagaaaaatgatatgaaaaatgagaaatagtaattatagcattggttgtttattaaactggttaaacaatgattttttagtcatcaataatagaaataaaaacattgcaatagaaaaagcaggaaaggcagttctagtaagaagaaaggcatatagccaataagcactatgaacgatgtccatccaccctaactactaaagaaattatgcaaataaataacataatgaaatactttttacctgtcatattcgtaaaaatttaaaattaaacaatacctattttcatggaaacacatactcaaaaaacagtggtagtaacttaaattggcacatttttaaaggaatttattctaaggagaaatttatatataagtcaagaaaattaactgtagctttgtctataataataaaaataaatagaagcatcttattgaacaaatgtttatcattagggaattagtcaaataaacaccagaataccagctctggatggtgagaatccaagtgatttttatttctctgtatgtttctataatcattaatttatatgaaaattaccatatttgtttcagaaaagatagtttcttgcaatttaaaaaagattttcaaatggaagcttgtgaagaagccactaagggaattggatttttttttttttttttttgagacgaagtttcacttttgttgcccaggctggagtgtagtggcatgatcttggctcactgc

SEQ ID NO: 115816 - DNA, 1038 bp, Homo sapiens
gtgttgctagcaatccttggcgtttcttggcttatagatgcacccactccagtctgtgcctttgccatcacatggcactctccctctgtgtgcacatgtgtgtgcctcttctcttcctctaaggatgtcaattgtattggattaagccccctacaccccctccaaagacctcatcttaacttgattacatctgcaaaagaccgtatttccaaataagatcacattcacaggttctggaggttagaacttcaacctatatttttgggagacacaattcaatttgtaagtctctctctctttttttttaaaaatgaaattcagataaatttaaccactttaattcagtaaattaaccataaaatgaacaactcagtgtcattaagtatattcacaatgttatgcaataactatctctgtttctaaagtatttttattaccccaaaaggaaagctcatattcattaagcagttattcttcattacctgcttctccggctgctggcaacctagtctactttttgtttctatgaatttccctattctggatattttatgtaaatggaatcatacaatatagacctttgtgtctggcttctttcacttagcatgttttcaaggttcattcacattttaacatgtatcagtactttatttctttttacagtggaataatattcctttgtatgtatatactacattttatttattcactcatctgttgatggatgcttgggttgtttctatctttgggctattgtgtatagtgctgctacgaacatgcatgtacatgtacttgagaacctatttttagttcttttgggtatctacctaggaatagaatttttgggtcctacagtaattctgtctttagctgttttaggaactgccaaactattttccatagtggccagctgcaccattttacttttgctccagcagtgtacaagtctttccacattctcaaccaatacttttccatttttctagtcatagctctcctaattggtatggagtaatatctcactgtggttttcatttg

SEQ ID NO: 115817 - DNA, 1092 bp, Homo sapiens
tccccacctaagaaacaaagttagctttcaactctggacagaatttaggtttgaaaccaaggaggggaattgttgaggctgatcttggtgcacatgtttgttgggtttgggagtcactgggagaggagtttttaatgcctctaaaaatcattcttctctctgtattttcatttctaagtattacctttctttgcaaatagtaattgtttgggctctacttgcagatctttttggccaagtattctgcagtgattcacataagttccctgaacatttatttggaaggcagcatctgagagcatactttttttttttcttaatgacctctatatcttattactgcaaggcagcacagattctttttaatttgttttgatatctgaatctttggcagtcataaatttgattttgactgcaggcattttttactttggacaaaatgtatttctggagaaccaccaactaaggtgtactttttgagggtaatggttatatcttatttgattttatattcccagaacttagctgtgcttggaacatagctgagcctcaataaatatttgttgaatgaatgatggaatgaagtctatgagcaaattaatgccatttaaaatcctgactgtgtatacattgtctttctctgttcatacattgtttgaacttatttaatgagcaaataaggataaatttttaggtggtttcaaattaattacatagatgaacttagagtatcatatttgttgaatgaacaatggactgaagtctataagcaaattaataccatttaaaatcctgactgtgtatacattgtctttctctgttcatatgttatatgaacttatttaatgagcaaataaggataaatttttaggcggtttcaaattaattacatggttgaacttagaatatcagtccagagaagtcatgtggttagcagtaagcactagattggaattggaagactccgtatagttatgccaaaatgaatatagtctgattcttgtcagattctttagcattgctgacctcagttttcttatctttaaaataaacatataaagttgtgtaggaatcactcacctcatacatgta

SEQ ID NO: 115818 - DNA, 3446 bp, Homo sapiens
actggccacagacctttggagaaagaacaattgccaaaacatacccattgggtcttcctggtgtattggcactagttggaaaattttagaccagatgacctctgaagtcctgccaacttccggaatctgaaattgcaacctggatagactaagtgagtcccttggagccatgtgacaagtccaagctccagctgtggatgaggcctgacttcaagttcagaagctcatcagctagcccagtgtatctctttgtgtcagttttttttcctaagcagtttcagtaatataccaaaagatacagactcaatgaacattttgaaacctcctaacagtgtgacatagaattaattaaacctagaaaaaaattaacataaaaagaaattcaacaatgaaaatgtattatcttgtgggggaggtactaaaaagaccctgaaggagtcaggatgggaagaaagaggtgactggggtcttaggaccagtttagtccccactttgatctgtagctttgaactagttagtgaactctctggacatcagctttctagatgagcagatcatcttggatgcctcccaaggcacttcccatagctaaaacataatgtttcttaatgtcactgataagattttatcaccagatgcctcagactttgaaagcatgtagctctggctttttgtttagtttctcacgcagaattttattcactttaaaattgaagttccagccgccttaactatgaatatcaagagaaaaactaatagatgtaaaagtaaacaacagaaagggtagaagatctcttattctcttctggatttaggtgacagacttcatttactatcttgtttgtgaatatatttagtaaattttgtggtatgagaagttgggtatccactcttatttatcctctaggtaactaatttttatacatatgtacttgcctttttcctgcaaggcccacaaaccacatgtttttgatgccttgtatatacatgagatttaaaaggagaaggctaaagtaaatctgttctaatagctacagaaccatttgtaaattaaaccttaaactcctaaaatttcacataagaatatgtatccaagttcttttttttctacagtataaaccccttttattgaaaaatatttctcctgcctatttttataattgtaaagtcaaattaaggtaccaggaattatagctacagggcaatgagaaaggcataactaaaatatagttttatatttattatataaaccctacttcagtagggttttaagtgtaacgcagtttgatttgaaaataattaagagatcgtttcagaaactggtataatatttaagggagagctgagtagataaacagaagcttcaaggagagatttatgggaacagaagtttcagttgattgcatcatggtttttgaggccaaaggcaaataaattcctgagtatttccagatgctgtgtgtctaggcaagaggacatctgaggagctagaagtatttgatgtgaattctgtttagtggtctaggctgctttcattttcatgatagatttccaggtatgtttgttttgaacaggcagattttacattttgaggtctattctgtttttttaatagcaatgctgattttaagacaaatagtatcaccattttatacctagtaataggcaaagctgggacttaaaactaggtcttccaacaccagatcattacagcacatgaacagtgtattcattatgcactggctgttacatagttcagtgatggacactaccaagaggtgaaactcaatcattagtcttcattggtaaaaatcttggcagagttttgataagtcaaacactgaaattatgtgttcaagtgagaactttgtgcatctcatacgtatagattagtatagtcctccatttgctgaataatagcaggtaataacagacttacacacttacacagtgctttcagactccagttggaatggactactgttctctgaatgtgccttctactttcatatcttgcctatgctcttccctccccactgtctctttctaacagaatacagcctgtgttttaaggcctgtcccaaattctgctacactcataaacttaccctgattttcacggttgaatgtgatctctctgacccatctataaaattttgttttacctattcaggggtgcttacttattttgttttgtcttctgtcaaaaatatttctttctttctctttacctgagacacagtatagtatagtagacaagagtatggacttgagccagagtgcctggatttgaatgtcgaatgtgccatccatttcctccctcataaaatgagtgttaaaatagtgcctgtgctttagggtatttatgagactccaagaaattgataacgttataatgcccttagaacagtcttgggacaaagaaggtcagtgctcaataaaatttagctttaatgttgactatactagattgtaacatcgggagaagcaaggagtatttatttcccatacttctctcttatgggaaaatgtatttgatttctggtttaggtttccctaaccatccgcaccacccctgccccaagggcatcaaggtgtaagggccatcaaggctcaggaatgtggagaagtagatgcttaggaacactagtagttcaacacacatttagaaaggatatcacattttgggggaagcttcctgaccctaaaagacagcaaatcaaatctgtcatacgtgtacccgtattgctaagcttacagccacaaaccagaagggggcaacagatctgcttactatctgtgaagaagggagaagaagcctcaagaaaatgattcccagttaggaaaaaactgcaccataactgatctctgataagatgttattgaatcaataatcaaaatacagattagacacaaaaagagaggtctgttctgtgggctgggagcatgtaagcaattgaaatagaaattgtggaactgcttccagagattttagttttgatatctggcatgcacaagagcagctcagaatggctaaagttgtttaatgttgtcagcattccccacttttattttattggtttttttagaagctgtgcaagagtttctatttgtagagctgattcttatatagaaaactgggctgctgtgcagccttgcaggttagaatgaaatatacatttttttcatatttttaaaatcatttcttgtttatggaaaaagtaattacatattctttttttaaaaaaaatacttataaaggaaaaatcacttgtttttagtgtgtttcttgccagtcttttaagtatatctttccattttatttgttttaaactattaaacagtaagtgtcacatttcatctataaattcagtgcaattccaaccaaaatctcagcagaaatttttggggaacctgagaagatgaccctgaaattcaagtgaaag

SEQ ID NO: 115819 - DNA, 2182 bp, Homo sapiens
agtcttaaaattaggtagtgtaagcccttcaacttttgcatgttctttttcaaaattattttggctagtgtcggtcctttccattccgtatcaattttagaatcacctcttgtatatgtgtgtgtgtatacacacatacatatttaggtatatacacacacgcacatgcattattaatatagagacattaggaacaatatcaattcaagaaatacatattgaatgtatagtatatatttaggaactaacaaagaagattataaggaatatgagggaagagactgattttgcaaaagtcattctttttccattgcgggaaaatttaaactgccctaacaggatttgagatggaaataaatgaggacggattcgtgtctgtaagacaaatgattttcagctctgtttatacgggaaattttaaagccagtagaggctttgagagtattttttaatgcactaaaactgtggtatattcaaaggaaggatattatataatcccaacaataaaaaaatattacaactaggtgcagtggctcatgcctgtaatctcaacactttggttgactgaggtggaaagatcccttgaagtcaggagtttgagatcagcctgagcaacatagtgagactccgtttctacaaaaatgtttttaaagattagctggtcatggtggtgtgtgcctatagtcctagcaactcaggaagctaaggctgggccttgttgtcctaactacttaggaggctgattccagaagttcaaggctacaatgagctatgatcgagccactgcactccagcctgagtactagagcaagaccctgtccccctcccaaaaaaagattattagatggttgaagatcattagatacgtgaaacaattcaaaatcaacacaaatccaggatatgataagtagataaatttactgaatttatgtaacaaaatgtaagttttagagaaaacatgttttgagcaggctagaagaaggattgatgttgttatcagcaaacatttataaaagaggtagaacttaagatagccttgaaggttagatgagtagaggaaacaggagcaagtgttcaagatggaacaaatcgtacagctggagttagaaggaggaagtgagaactagctttatggaaactgccttaaccagagagatcagggtttgttggggaataatgagaaataaggaaggcagattagagagggaatagaatgttggcaggagagaagggagggttcaaaatctgtcattatcatacattgctagtggatatataaatcggtacaacttgtatagatagaactttggcagcatctgtcaaaattataagtacaataccctctggcccaataattccacctctaggaatttaacctcctgatacactcatattcatgccaaaaatgtccattgcaaaaagtaaaagattacgtccatcaatagaagcctgtttaattattctacagctgtacagtggaatactgtgcagtgattgaaaagaatgaggaagctttatttgtatttcctattgaataaattgtgaaatgtattaagtgaaaaaaacaagagtaggacttagtgtgtgatgtagccactgtggtttatgtgtaatatgtatacatgtgctttgatgcttatgtgtatatatgtatgtgtgtacataaaatatctctggaatgatacacacaaaaactggtaacattggtttcttttagggaagaaacctggatgacttctcattgaattgtctcttgtaacttttgaattttatatcatgggtgtatattacttattcaaaaaatacatatttttcatttcttcccttcccttccctccccccttctctttttccatctctctctctcacacacacacacagaaggaaattaaccaaattttttttttttttttaatttaaagacagggtctcactctgttgcccaggctggcatgcagtggcaggatcttagctcactgtaccctcaacttcccaggctcaggcaattgtcctacctcagcctcccaggtagctaggactttaggcgtatgccaccatgcctggcctttttggtggtgtttttttttttttttttagagatggggtctcacaatgttgcccaggctggtcttgaactcctggactcaagcaatccacctgcctcggcctcccaaagtgctgg

SEQ ID NO: 115820 - DNA, 1045 bp, Homo sapiens
gaggcggagcttgcagtgagccgagatcatgccattgcactccagcctgggcgacagagcaagactccatctcaaaaaaaaaaaaaaagaattcttgccctccactgcttcagactctacttctcttcccactggtcttattatttcatctggagcctcatcataggaagagtgaaccttcaaggtatttttttggctttggcttaagcattccacctagctttcccagaatgatctcataccttagatggttattccattttattcctctggtgtgctaactatgtacctctgcagactccagtcctgagtccctaggagtatgtgctgctgcagacatccatgcacaagtctttgtatagatgcgtgctttcatttctgtgggataaatagctaggggtagaatgattggagcatatggtaagtaaatgtttaactttttaagaaactaccaaattgttttctgaagtgattataccatttatagtcccaacagcagttccgcttcctccacatttgtgccaacacatttagccataccaacatgtgtttagtggtatcttattgtggctttaattatttgcccaatgagtaatgatatttcctttggtaaagtgttcgaatcttttgtcaattttttttgtttgtttgtttgttttttattgagatggagtctctgtcatgcaggctggagtgcggtagcacgatcttggctcactgcagcctccacctcccaagttcaagcaattctcctgcctcagcctcccaagtagctgggattacaggcagttgccaccacgcctggctaatttttgtgtttttgtagagatagggtttcaccatgttggcaaggccggtcttgaactcctgacctcaggtgatctgcctacctcggcctcccaaagtgctgggattacaggcatgagccaccatacccaacctgtttttattttttatgtaagtccaatttatcaactttttttttttaatggattgtgcttttggtgttctctaaggtaggggtcaccaacctttttggcaccag

SEQ ID NO: 115821 - DNA, 1002 bp, Homo sapiens
gtgtctttcttgccaataaaaatcattgattttttcatatcacattacatttgttacagatatcactgcttagaaattatgttagtaattaaacctaccgctagctagtgttatttcatgcattaataaagcagcacatatgttaccatatcccaaagatttcttaatatcttgataattgtatttcaatataattggtttctgttgtaagaaactaattctgagaagccttcatcagactgccagagggttcaagacaaaaaattgttaggaaccctgctgtgagatcttgtttgaaaaataggttcttttgcttagacttatttttatttcttcccttaggttttttgggttttaaatactctgggtctttgttttctcttcttacaaagaagactttcttagtttagaccttaccaagtaagacaagcatataattgatgggttttctgtcttcacaatgaaaatttagatacagccagtctcccaagtttccctacagcaccggaaaaaaggtgtggtgaggagtgagaagatttggacaggccctgagatgctacctgtcaggagaccagcgctggcagggtgctagacaggagcatttccgctttattttgatatcaccatcacccagtccttggtgaggtaagaagtcatgctctttcccagtggtagcagcaaaggttctgtgacgcagaaaagagaggtaacagaacagctcagctaacagctgctgacaggaaatgtctgttcagtgggcataaaaagactgcatttattttttatatttgtttaaaagaatttttatatcccatgttaattttaaaaacagttaggcaaaatactttctttttctgggcaaaggattaatttctacttcctatccacacgccctcttgttaatatttggaagagaaaagggttcctacctttgctttactataaacttagagcattcctaagaattagatttgcatctttattttactgatgcagagacta

SEQ ID NO: 115822 - DNA, 3041 bp, Homo sapiens
accctgttgatggtttttagtttaattagggtcccacttgtcaatttttgtttttgttgcaattgcttttgaggacttagtcataaattctttctgaaggccgatgtccagaatagcatctcctaggttttcaaattgatccatttttttaaaagctaaatacatggtaaaaagtttttttaaaataattctcaacccaattaaatcatttttaaaatgttttaaagaatattcttttttcctctttaatttatataaaaataatttctaaaaagcaagaaagaacgtttcttttaatacttcatgttggcagccatctggcaagaattgtaaaaaaatatgtatctttaacaaggttttttttctttttttgtcttcacagctgatcttgcatctttaatggataaaacatttgagagaaagttgcctgttagttctttaacaatatcacgggtaagaaaattttaacatatatattttccaagaacaaggaagaaagccagaaaggcccttcatgtagatgaggctgtgtaaataaaaaatagtttgcataggaaatatttttgagagtatggtaagtttttatagttactaatagatattttatactgtaatagcaaatttctttggctgaaataaaagttaatacatttaccagattctgatatcagtaatcagttttgtgtatctgatttattttttccaggatatgacattctgctgtatgataccatcagtttttttaagttgatacatccttcaaagtaatgatatttacccgttagtattggaagtgtttttggtagccaagaaagtctgtaaaagaatggatattaatgttaaagttaaactgcagcagagtgatgggtggaagaataatgttaggttaggaatcaggaatagtaaccattactgagcaccttctatgccagttttgaatgtattagttccttaacatacattatttttttaattctcactgctccctatgcaataaacagtctatgtaagacatggtttaataactttcccaagttcacacagcttgtaagcgtggaaaaactgagattcaaacccagatatctaggttctcttctgttgcctgcttcaaatatatctgggcttgtctttaacatgaattcacttcatgacattgggcaatgagatccctctcaattttctcattttcagcatgggtacggttgcatcttcctcccagggaataatgggatgctaaaatgagattttagctgtgaaaactttttacagaaattaatggcaccataaaatttaaaatattgttaaatatggaagagagagaggaaagaaattacctttcttttgaatcctggtcctttctttctgccttttagttgagaaataattttactgttcgtaagttacatttaatagactcataattggcatattggaggagaatggaaaggccatttttcgtcccttacatgatgggtaaaacttctgtatgccataatacctggtatttatttaggtagtacttcaaggtttacagtttttatgtacattttctcattggtgccttatactcttcgaggccagtgcctttatcctatttatgcagatggagcaaccaagtcccagaggggctatgccatctgtttatgccatacagcaaacaatcagagctgtttctcaagctcaggttctgtgtttgaaccacattttatatgcccttaatggatttctaagtcaagtccagaagtgctaggcatttttagaaagtctccctctttttactctcctctctttcttttatgaggttttcattatattcacaacatgcattgtcttctacgctttttttttcttttttgcctctgagtctctattttagaatagaatctgtgtttggaataatcctttttatttgtttatttggaccatagttaatgagcatactcagagattttatggtttgaagggagagtttgttggtaaaggaatcataggtttactgttgcatagcagagctaaatcaaagtagaaaaaatcgttgcaagactgagttctctaaatttagatgtttatgttctgggcaatagttttttagccatcagagtcttcattttttcagccatatgttcccatgtttggaacataaagaaaataatatcagggtttaaagataaaggaaaaaataggtaactagttataatcagtggaacactctccttgttctgagcaaggttcatgtttggctttcaatccgttttctgatcaaggttattctacacatagaaaaagagaagccattgtatattctttgtttgcattagcataaaggggtttcaaggatggagccataccacgtgaacattgttccactaagcatcaccatcgttccaataaaatgggtgtcctgtgttttctaaggtcaatgtgtgatctaggccctaggccaaatatatgacataatttatattcaaccaaaggtttctttttctgtcttttagcttatagacaacatttcctctcgggaagagatagatcatgcagagtattacctttacaagtaagttttccatttgatttggctatgtactctgtgatttcacaccccttttttacataaaagttggtatatgttgtgtataattttgacaccttctaagtttatattttaaagatcttttcatatgagtatagagagagtttctgattttttataactgcattttattccatactgtgagtttattatttaaaccagttccctttttatggacctctaggttgttctcttttttgtattgtatacgatgttataattgataaccttgtacgtatgtaatttttcacctaattttcatgagtatatatatttatagttttaatcgctattgacaaattgctttctgttgaagtttttacattcccactagcaaggtatgagagacatgtatttttacagcttggccaatagttaggtattttcacatgtttgcatttttttgccaatctgataggtgaaaatttatacacacacacacaaacacaca

SEQ ID NO: 115823 - DNA, 1061 bp, Homo sapiens
cggcctcttaaggtttattaaggaggattaaggagtacaagatgtaacgtcatctctttgatgacttgagactttttagactggaagttgcttagaaatatttaatagactaaatcctcttagatctaacaggtgacacaaggaatgaaaatgagaacaataatgtttctatttactggcagttaccgaatgacaaatgctttacatatatcatctcaggtaaccctgtgaggaaggtaccacgatccttaatttacacatgaggaatcaagtctcagagcaagggtctccatcagaatgcaagtggccgagcttagatttcagcccaggtccttccatctctagagcctttaactgttacatggttctgcaaataaaaattggaagagccactgcattatctcaaacctagtaggtcttttcttttaaattgagaacagtgcctctgcttctagttcttgtgttttagatgtatttgtgcctctcctttcagcagcattccttcaaagctctgggttcttggaacaaatcctatagctatttcctggcagcttctgatactgacaacagttctgccttctggaaagcagatgcttggttggtgcctgctttgcttttcaccccgcattttggtgggaataaagccccttattgatgacaagaagaggtgcctccttttggtttttgtccccacggttgatcagatacaaagacaagggagaatgatagactgtgatgacactgaaatgattctgtcactgaaaaactgtttgctgctgtttggaggactgttttcccccctgcccattacatagtactttggcatgccttctaacagctgagtaaaaagagaccaagaggaatgaaaaagaggtgaagttgaatcaaatgaaagaaacgtgagtcatgtgggtccaccattgtggacaaacctaccttcaactcacattttctttttagttttcccatttggttctctgccagttgacggtttgggtgtctggctacattttctttctttttctcatgagtcacctagagattcagttatttgagccaag

SEQ ID NO: 115824 - DNA, 1052 bp, Homo sapiens
gaaacccagagatctcttgctatacctctcagcatgacagccaagagagtggacagcattttaacttttttctttttttttttttctttttgagacggagtctcgccctgtcacccaggctggagtgcagtggcgtgatctcggcttactgcagcctccacctcctgggttcaagcaattctctgcctcagcctcctgagtagctgggattacaggtgcccaccaccatgcccagctaatttttgtatttttagtagagacggggtttcaccatgttggccaggctggtcttgaacttctgacctcgtgatccacctgccttgggctcccaaagtgctgagattataggcgtgagccaccacgcccggccaacttttcaaaaataaaacctgggtatataaaatatattagagaattcagaaggccaaatgagtaaagcatgcagaataataagacctggctagataagagacagtaaaagtacctcctcaataaatagttttaacttttaaccaaactgtattgttcttcttcgttagcatttacgaggtttcttctcagactccacatcattcaatattttgatggatatgttatttatcaaaggcaaatataaaagtaagtactgcaatttctatttgctgaaaaattctgccatgtttgctggcataggaactagggggaaaaatgagtcatgcaaaaatgattcttctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaatgattcttatatccctgataagtggctgaattctggagaccttaggaagtttgaaa

SEQ ID NO: 115825 - DNA, 1241 bp, Homo sapiens
cctctcctgagatttcctattccagagcctaaaaaatatgaaatgctttacatgtttcctatgtagtaaaaggaaattttacagcagaaaaatagtaaccaagccaggttattttcctggctggtaaaatatagctggagaactcttattattaattagaaatcaaaacgtgagggtgatgcatttccatatactgctggggggagtcattgaaggacaagccaagaggttatacacttcccagccttctgctgggccaagatcatttctttaactttctaagcttctcttgctgtgcaggggaattattttgtcttcttagtcagtcatgaggtgagtgaggtgaattaaagtgtctttgaaggcatgtgtttttctttctttgtatagctcctgtagtttttctttatttatgtctaagttacactgtttggtgcacagatacatcatcactgttacatcgtcattgtgaatccctcactttagcattataaagtgcctatctaggtcatgtttactgcttttgccctgagttcaaccttatctaatattagtatctccacccctctttttgcttgtttttctctttgttttgatcaggtttgcatttgaccaatatacagcttttcctatgctttatttttgcaatctttctgaattgttttgttttagctttgtctcttatatactgcataaatttctgtgttgctttataatatgatgctaatcttttaatataatccatttgtattaatgtgacatatatttgatcttgggtctcgtttgatgctttctgtttctataactttttctactctcttatgccatgtggttattttctctagttggtatttttgctctagtggtgactttaaaaccatagttttgattttcttaattatttaattcttttgacaagacctgttaattccctaatataagtaatggtgaaattactatatttcctctgtttttcatcttattttcttcctcccccatccaatacccaattttagctggtattttattttgatagtgttcactttactcttaaatgtacttgatttgtcagtttgaagtgatattttttggcctgctgataataaagataaggaaatgggaatgccttttctacctttcatctctttcccttctctttctttcattagtattaacattgcttcattgtccaggcatataacatttacactctgtactatagccatactcccaacttttga

SEQ ID NO: 115826 - DNA, 1038 bp, Homo sapiens
ggaaaatagcttgtgcccaggagtttgaggctgcagtgagccatgattccaccactaccctccagcctgggtgacagagcaagactctgtctctaaaaaataaaaattctggccaggtgcagtggctaacacctgtaatcccagcactttgggaggctgaggcgggcagatcatgaggtcaggagatcgagaccatcctgactaacacggtaaaaccctgtctctactgaaaatacaaaaaaaaattatccaggcatggtggcgggctcctgtagtcccagctactctggaggctgaggcaggagaatggcgtgaacctgggaggctgagcttgcagtgagctgagattatgccactgcactccagcctgggcaacagagcgagactccgtctaaaaaaaataataataaaataaaataaataaataaaaataaaaattcaaaaataaaagaaaaacgtgtttcttttagaccggtcatttgtagattcatgtcagagaaagagagaacaacagagcgggacaccagagcactgttctagactagcaggatttttcttcatataacccagagttttgtctacaagtatgcacaggcctcatttcttttaagtcaacagaagtaggcactgaggtggtttttggtacgcagtctcttctctgctgctgctgtcttaggaacatactgtttcctatgagtatgtcttgcctatggaaacgcttgactagcctcatctctgccaccacaggatccacggaagttctctttactagtcctgcgctctgttctcatcattgtaaataggaatttaggttttgtacttcaggttgtgcccttacctttgagagctgtactgttgtagattctttgtgagatatagagcactgtctgcctctgactgctttctcctgaaccctgccagcctccatttccaatgtttctggcagtgtttccagctgtgctgtggcttgaggtttctatgttctaattatgtatgtcaaagacaggctttgcactttgttcttcattcctatttttt

SEQ ID NO: 115827 - DNA, 1035 bp, Homo sapiens
aatcccttgtgatgactttaatactttttcagcctttgtgtagctactggttttcacatttaagacaggaaatcttcatttagtgatcttaaaagtgttggtatggaccccaccaatggccacactctaggaaactatggaagctgtgactggtgtttttgttccttttctgtttattcagatccatccctttgctttttcttccagatagaatcgtccagaggaaatgcctttttacagtcacaactctaaaaagttcagtctttattcaatatttcttcagagctgctatgtgttgaatgctagcactgagatagacgctagtgagcaaggagaaaacaagacaaatgggatccccatgttcctgacatgtacaaggatttgtgtgtgtgtatggtgtgtgtgtgtgtgtgtgtgtgtgtgtgtgtgtgtttagatggcacggccttgaaacaggaaagcagaaaaataagtgaaatgattatcagactatgtattgtgataagagctataaagtagacaaagggctgagatagaggaaatggcagagcaatgatgtgtccatctgggtgtggggaggtgattatggcttggatctgttttcccacccaaatctcaggttgaattgtaatccccagtgctggaggtggggcctggtgggaggtgactggaccatgggggtggatttctcatgaatgatctagcaccatccccttggtactgtccttataatagtgagttcttatgaaatctggtggtttacaaacgtgtggcacctccttcccccccacatcctgccctcgccatgtgataatgcctgcttttccttcaccttccaccatgattgtaagtttcctgaggcttccccagaagccaagcagatggcagcatcatgcttcctgtactgtctgcagagccctaagccaatttcacctctttttctgtataaattgcccactcttaggcattcctttatagcaatgtgagagcagattaatataggagaggtgcaaggtgagtgggttgcttttgagt

SEQ ID NO: 115828 - DNA, 1064 bp, Homo sapiens
aagtcatcagctaaattaagacgctgacagctcacataacaagatgcaaagcaatagtaattaagaaaaataatcacctctgctgctgagaggatacgtttggccccaggtgaagtagctcccaaggcatctgctttctaaaaggaaagtcttgctgttttgttctgctgtgaaggggtgaggggcaagagatccttttctgtattgcagcattcaccacatactctaaaggagagcattatctttgggaaataatcttatgtggggcagaaaaacagatttgcagaattacccaagatctcttatagccctagtgtggcaaacattgtgaactggccccactggcacacacaactcctttctccctgctttcctctaatggagaagtaagaagatgaaaacattcacctcttagactccttcgccaggagtagtggtcatgtgacccagttctcgtcaatgagatgggcgtgggagttgctgggtagagcttctaggaaagcttttaaaacggacagatgagactggatgcccattctgccttttgcattcttgtctttctcccttcttcctgcttggaacataaacaggaagtcagaaggagactgggttgcctgctcctcactgcctgctcactggagggaagagctgtatctgctgaagccattttcagcatggggtttattgtttgaagtcaaatacaagcctaactttaggacttttcagttcagaggataattcctcagcagtgctgtgggctttagtagaagtaaaaccacaaccaaaaacaacaacagtattgtatctgtctgcgtaccaatttccattagtaatttttaggcaatgacatgaattttttggagaactgaaagccagccctgtgaatgcaatgcaggcgtgcttgtcatcgggtcctttactctcttaatctggtgacaattctcttctctgaagataacttgcgaccaattccaggggatgtgtttgagaagcaggattgtattttccttgctggctccttggaatagtgcatctgttttagctatcttgagatttagaattta

SEQ ID NO: 115829 - DNA, 1922 bp, Homo sapiens
ccgttacaaggggcgggaagggaagggtcttacattcaggggagcgtttgcctcgcctgttaagctgtggcgtttgagggcccttgagtgctgcagtcggctgccccgggacggctgcctttcactggttctgggcgctggccggcgctgcccgagatgggccagtctttgtcccgccctgggcccctctgcccgggtctcctgcgtccgcacacagcgcccatcgtccttacatgcagcttgccgttctcttcctcccggcggttctttctccttggggcctcttggcctcacgacatgtttacataatgtttgtgactgtacgagttttgcgtgggcttgtgggttttgcccttctacctccactcccatgcgtacaagcaacagggaacagctgctgaggagcagattggccaccacaatcaagctattttcggaatgactttctttaaaaatgatcgcgtgttgcttactgattttaaaaatcaactggattttgcaaggattgcttagagtttaagtctgttatcttaatcgctaatcaggatggtctatcagtagatgtaaatgtagaaatttgaaattggaggctatctacaaattgattttgacagctgtattaagaagcttaataactgtcctttgaaacagtaatgacttaaatgatgaatgtgtaagtggtactttttttaccctaaagaaaagatacttttaaaattgcaagatgtatggtgtaataggtgtttggaaatgaaggttgtaaaatggctgtcctgacgtactactcacttttagaataacaaaagttcctgcagctttttaagtttccctgttatatcaaagctttcatgttagagtggtgaagaagctatgtttagtggaaaaggggaaagttccgttttttgggaaaggatctgttttccactttcaccttacctggcaccgtagttgttcctagagaaggctgtgccaggatgaaaattagcaaccacaaaagggaaacaatagtttgtaggtgcagatatcttttttagtctctagctatgcagtgcataaatttatactagcttggcagtacgatttttacttcatgcaatttaacgtgagcctaatgaagtactagtgttctgttttctttttcctaaaaggggccgccacccttgatgtggctgcatctttctcctagtcaggaattattaaattcctcccactgaaatatctataaaaatcttgtttgcacttctacctcaactctcagtggctttattaccattatataatgtgagcagaataagatttttgtaaaaatacatgattctagttgtaagcttttccaatatcaacatttcttattgtattcattgtttttatgactgtagttttgcttatttataattttaaagccattccatgaactcagtttttctaaatgttgtaaatgagctactacattgaaatgtaaacatctgtatttagaagaatttcttgaattttaaccatgttggattctgcaaatgtttttttaagaaaagaaacctggttataaagtgacgtcaaaccaagtgacataggtaatgaaataaatgaatttatcaaatataaactgcagagaggagcacagcagtaagtgggggagttctttttattggccagggtataaattgtgatattttttcctgagattgatatttgaatacatattggtgctaaaaagatatcttcccccctcaaaacagtttggtttaccagcaaaaggatgagaaagctgagagaatcaaagaaactgatgaggttttcaaaaacaatggcgaacaatgccatcctcaaagaggaaggatcagaaacagtgaaattcccctggaggttgaggatttttcttagttgaccctattcagccattgccatggtaaatctgttgagtg

SEQ ID NO: 115830 - DNA, 1038 bp, Homo sapiens
actacacagtattgttcctgttgctttgggattggaggaatagagagtggattaacgttttccttgtaatgtactagacatcatttgtaggcatttaacatacattgtcactttcatgtacatttttctcatttattatgttggctctgtgttatacatggaagttacttctattttactgatgagaaaacaaagtgtaaataggtaagtactttgtccaagggctcagagcgttcgagcctgaatctgaatctagatctgcttgactgcaaagctcatcatgctgttttatttgtatacttttatatcatatacatattcagaattttatactataactaactatagatcacagaccacatttttaagatagctaaactgagctgggaataatgaatgggtaagttgcaaagttaaacaagacagggcttaactttccacattttagaaaaagaaaatctttacctggatgagatataattggtaacaactatataaaaccgggttctaaagtgaatgcaccaaatatctgtgggtgcaattcttaatgatcttaacacaaataggtgagagaaaaccaaagaaatctcaaatttgattaaatttggggaataagagaaatgaaaaggcccgtaagtgctaaaattgaaatatacgtttagtaaaactcctggtaaagtaaatgaaggttttactggggaaacaagcaaaaaaatatgtgtttcacataaggagaatagaactgcctacaaggtgtaggaagttaaatttatactgaaaattagagaaaaattcatatttgagttgcattttatagatgactccgaagccattagtaaaataatttattagtggagcccctttatcctagatgcatatgtttctaccacaaatgaaaaagttaatgctaggaaggataagattccaccacttttgtttttactaagaaaggaattaaggaagagaagtatttcagcaaatcatgaatatactaaataaatgcaaataaattattaggaataggtggtatccaacaag

SEQ ID NO: 115831 - DNA, 1063 bp, Homo sapiens
ataccatctctaccactgtagtgcaaaaacagttatgaaaccaatggtatggccagatttgactaaggtcttaattagacaaactctaatatatagtagagagggatgttgaagagagagaacctactgagccttatgtcaccctatcatgagccattgaaagatatgaaacgaatctagaagattgatttgtatgaatcattaagagcagaataaaatagatttttaaagcactctacatcgatttaaaagggaaaacaactcagttttttaagtgggcaagttccacagaagaggaaatatggctagcaggtaaacatggaataatgatttacctcaccagcagaaaaatgcaaagtaaagcagtgacttttttttttttctcattatactggccaaagagaaaaaagttttgttagtatgtattgagaaggttgtagggataacattgaatatatcggtacggctattttaaagtaaaaatatctttgacccagcagtttccatttcttagagaaacacgtgagtatatcaggagtcatgtgtgctaggattagtccttgttagtaaccacagaaactccagacttcctgttcacattttgtctctggcattccattcataaaaagttctacactttttttttttttttttttggagatggagtctcgctctgttgcccaggctggagtgcagtggcatgatttcggctcactgcaacctctgcctcctgggttcaagcaattctcctgcctcagcctcccgagtagctggtactacaggcacacatcgccatgcccagctgattttttgtattttagtagagatggggtttcactgtgctgtgcaggcgtgtctccaacttctgacctcaggcaatccgcccaccttggcttcccaaagtgctgggattacaggtgtgagccactgcgcccggcctggcctgggtctacacttttttttttttttttttttttttggagacacagtctagctctcttgtccaggctggagtggggtctatgctttttcttaaacctcttctcaacttttcatacccttc

SEQ ID NO: 115832 - DNA, 1032 bp, Homo sapiens
accggactctcttccactgtgcagttgtggctgtttttgtttgtttgctccgtaactttcctcccactgtttctagaggtgggaaagatatctgtcatgagtcttcttacttctttcagactatgcttcctcctttctccctataatcttcagttttgaattatgtcataaaggcccactgtcccactctccagtctttatattgaaattgataagaatgtacataactgatccacccaaaccctggcctctcacttcctagacctctcttccagtgctcttcccatctatgctatatcagccactcattccacagtgataccctcgtgcactgtcaataactgcagtccctccatagttgccatttcatgtgttctgctctgttaccgcttcttcctatttttgcagctcactcctagtgcctcagccctaaccatcttctgaccccaatggaatctccaacccattgatcctattactgctcccctgccccttaccctcttgatgttttcactcccttttatgtggaatttactcatctaaatttcatgattaatcagtttaattacttctttggatccctttccttgctctttgcttgtttggcaaaaccagagctctagttaaaacaaactctggggttttttttgcacttgcccctatgtaactgagcatggccagaaaaaaaaccacacaaccacacatggccacaaaccttaagtgggtctgtaatgctgcctgatggttgtactgtattttcctagtctgcttactcttccactcctctaaatgactatttcatatcttattttccccaaaccttctatatctcttttcccatcctcaccttcagctcatgaccttgcttcccactttgctgagaaaattgaagtaatcagaacttccatagattgccaccactccacatacctctggcactctatttatgaaagggtctgcgcagcatctgctcagtacatggctgtcttcctgcctgttaccttagattaactgttcatattcttgtctgcc

SEQ ID NO: 115833 - DNA, 1391 bp, Homo sapiens
attctcatcctatgtgacctgtcagcagcatttgacacagctgtttgcttcccttagccttgaaaccatttcttctttgccttcgaggacgtcacacgttcctggttatctgctgtctcagtgctggtccttgtaattctccttttcctttattttcactgacctcttaatgttggagagccccaagtcttaattgtttgtttatttgtttctatctatgctcactttattggtaatctcatttagtctcatggcttgaaataccatgtaaatatcaacaatacccaaatttagatctttagccccctcctcaattccagtcttacatgtgcaactacctattcaacatctcccctaaatgtttaataatagacatcaaagtcagcatatccaaaactaaactcctaaactttctccccaatgcctgctttacccacagactctcccatttctgtcagtggcaactccgtcctcctgtagctcagaccaaaatcttggccttatttttttacttcactttttcttttactcttcagatctgttctttcaggacaatctgttttctgtatcgtcaaaatacatcgaaaatcctatcatgcctcactgcttcctccactgccaccacccttgtccaagccactaccatcacatcttgttggattactgaaataggttactacctggtctgccccttctgccctatccccttccaacagtattttctcaatacagtagccagaataaacctttcgcaaattaagacagtccctgtcacttctcctgcaatggctcctgttacgatctgaatgtatgtgtcctcccaaactgttgaaatcctaactcccaaggtattaggaaatgggagtggagtcctcatgaataggattggtgcccttaaaaagtcctagaggccaggtgcggtggcttatgtccgtaatcccagcactttgggaggctgaggtgggcggatcatgaggtcaggagatcgagaccatcctggctaaaaccgtgaaaccctgtctctactaaaaatacaaaaaattagccgggcgtggtggcacgtgcctgtagtcccagctactcgggaggctgaggcaggagaatcgcttgaacccaggaggcggaagttgcagtgagctgaggtcacgccactgcactccagcctgggtgacagggtgagactctgtctcaaaacaaaacaaaactctagagagatcccttgccctttgtctcttgaggacacagcaagaagtctgtgagctagaaagcagccctcaccagatactgaatatgccttgctcttggacttcccatcctacagaatggtaagcaatcaatttctgtcatttataagctatctcatttatggtattttgttatagcaacccgaa

SEQ ID NO: 115834 - DNA, 1092 bp, Homo sapiens
tttttgctgtatctgcaagatacagatacagagcctagaatgtagtagacacttagtaagtatttgttaaatgaattgttcgtgatggtgcaaaatggtaattatgttaaatgttcaccaatagacctatatatcacaatgagtaacaaaatctgtataatgactaggaaagttaaggcgtattttgaagtttgttacagaacaggcctaaaacactttttgtttctacagatacctgtgtatttaattccatagagaagaacgctacaaggatacataaccaaatgcatactaaagtacttctggggaggggaccgagattaagagagatagttgaaaggagcttgaatttcatatgtattgtttgcttttcttttttttagcaatgagaaacagtcacatgttaatgttttacattaagtttttttaatgaagagatgagaaaaaacaaatacatattaagaaaataaagcagtgagaggaaatggagagtaaagggtagggtagagagaaaaggaagaggacattgcctttcttaaatgtcgtatttggccagcagtcaatctgaaagaggggaaggagtgagcaatgtgaatatgggggaaagagcatgcaaaagtaaaggcccttaggtgggaacaaacttagcatgatctgggcactgtaagaaaaccagtgtgatgaacatagtgaaaaaggggacagagactactaggtgataagttcagagagatgggcaggcacccatgttaggtacagctttgcaggctgtgatgaggatataagatctgtgtgataggaaaccactggaagattttgatggggggaatacatgatttaattacagatttaataattacagatcatttttgctgctttgtctcagacaatgggttataagggaacaaaagaggaggcaagcaaatctgcctaaaccatggactagggtagacagcagagggggtgagaagtggtcaattcagagtatattttgatggtgtattttaagagtcttggctgatggttaggatttgggatatgaaggaaatcaagggaaataaggatcattgcttctgatctccataattggcc

SEQ ID NO: 115835 - DNA, 1886 bp, Homo sapiens
ttcaatcatttttcgttaattcaccatgtgtatgtaaaataatatacccaaaacagatctcttcaggtgtttcgcaggggttttgataaggacttgactttttattagcccttaagtcagtagtaatctggacggaattagagatgggttgggttggagaaaactgcgtggcactaggacccagggggctcccgtgagcggatcttggggccagattgcaaattcgcggtgactcagtctggtcggctccttgcgctcggcggccgcggcggcagcagcagcagacgctggcggccgggctgccaggagcagttccgccgggtttcactgtccgtgacttccttcggggcacctcaggcaggtccgcggcgtttggggagcgctggggttgtggtggcggggagaacgggtcagctgcgcgcgggaagcctctgggcctgtgcaccgggagtaacagttgctccgtctcttcctgtgtctggctttatttgcagcaaaccaagatggagtatgagtggaaacctgacgagcaagggcttcagcaaatcctgcagctgttgaaggagtcccagtccccagacaccaccatccagagaaccgtgcaacaagtatcctttccgaggcctggccgccacccgcgcagctcgccccgcgctgcggcccagcccccggcggccgggggctcccgtcgcctccgcctctgcccctcccccatcctccgagaccggcctcctccctgggtccgggcgcgggggaagccgccgctgcccctgccgggcgactcgcgcacgcggccctggtgcctgggccgggggcgccgccgcgtggggctcacgccgccaaggccaccggcttccggcgcgcaggaggcgggggcccccggccgccgcccgggatcgcgacatgtgcgcgggccgggccgccacgtccccgcccgccgctgacctgccgcgggggtagggagcgggcgggcgggagcggcccgggcccacacaatgcgccccgtgggtgggggtggcaggccgagcgggaggccgggtggagggcgctctgtgcgcggcggagctcgccgcctgactggccagaaatgggtggagctggcgcggggtttgaactgcagctgtgtgggtcttgggggtttttccacgtccttgccctaaaaaggctggggacctacaggtgggggaaaggggtctctgtgcctcaccctggggttactggtgttaacacctgttgcgaactccttgtcacccaagtgagattttctttttaaagctttggctcaaggctgactgcacaattatgtaggtctttaccgagtgtgctggtgtagtgatcctgttgctacggttttagagacaggaaaggttaagagaaccaaaactctaccacgtatgctttctgtagtgccctaaaccgtgctcaaatggagagctcttactggatgcagtaaaggaaacattcactctatatcatgaataaccttttaacccccgttttaagcctaaagaagttagttaagtctactattttttgcagaaaagcctcttgatttttattgtcaaaaagcagcaaaattacttaatatggagtttggtaagtaagctcttcgtgtttgagtttatttacatttaaaacatctgtaaagatgaagttatttaccccgagggtttcgcagaaatactgcattgccgtaatttaaaaccttcaatagatgacaaaattagtacttaccttcttggttaatgtagtacttcccatttaaaagtggaagggataatgatttagatctgcttggattttttaaagccattttgtttggatacttctagtactgaggaaagaacacttttggaatgtattgccgtttgtatcttgtaaacagt

SEQ ID NO: 115836 - DNA, 1732 bp, Homo sapiens
catactgctgtttcagagtgccttattttgtttctcctaagaagataatatatttaattattattttgtataggcttttgagtactttttgaaagaccgctataataggataaagagatgtagcttaagttgtaaaaaggtaaactttatcaggaaatagttttgaaaaattcattggcatatcagcttgttgttaatctgggccattcactaaaacaagaattactgtcttggttggagaaagtagttacaccttgcagttttactagagactatgttgttggttcgtttactttctgacccataaacattgagggtattcaaatatgtaataaatagctaataaagtgttactggagtttgattcatggatttaatcagaaatttagatttgttgggtgacaaaacattttaatctttctgtgtagtaaaacacaattgggaagcatgttagttaggggttgggagtcagggcttgaagaaagatgtaatagagcattttgtcacagctgcctcccgacagcgatgaaatacctgcaaattggtatcactaaaaatgttgcatcttggggatgaggggaagaattgtacagctgtagtgcaataatctcataatgctgactttataataagatatatagccttgtgcataaatggcactttatctttttggattctaaagaacaaatgagtctgagaagtatcttttttttaaaagttattctataaagttaatttctctaaatgatcttcaactctgaaagacttgttttcatttggaatgcttttatttttgtcattttatgcttaaatacctttctatttagaatggtttaaagttgaaatccaagaatttttttgaatattttttgctatattgagcatgctgaagctggaactttcttatgttgtattgcatgtaattgatacatttcagccataaagcacctaagaggtttagcaagcactagcgtgtttttgaaatagatgttgatagatttagtaagatatccttattcttagtttaaaaaaaaaacgcaggactgaaaataccaccaaagagatccttgatttttagatttaaaatgcttaatttcttcctgagattacacagagaagtttccttaactactgtttgttctagaaactggaacaacttaatcagtatccagactttaacaactacttgatttttgttcttacaaaattaaaatctgaaggtaagtaggatttgtattgataactatttaaagtttctttaagacctgtttaaatgtactgagaattattcatttcaaaggatttcattttgtagtaaccttgtgctttatagatgtgggataaacagtcttagttaataccactcagtatttacatgtttaataagaattccttttttttaatgtatatacagacagagtctcactctatcacccaggctggagtgcagtggtgcgatcttggctcactacaatatctgcctcccgggttcaagcaatgctcatgccaaacctccctagtagccgggattacaggcatgcgccatcacatccagctaatttttttgtatttttagtagagacagagttttgccttgttggccaggctaaccttgaactcctggcctctggggattcgcctgccgcagtctcccaaagtgctcggattgcaggtgtgagccactgtgcccagccagcattcatttttaatagggtgtttgtataataagtta

SEQ ID NO: 115837 - DNA, 1011 bp, Homo sapiens
tgtatatcaggaaacaataaagcttgagcacagtggccatatatataaacgaaattaactcttaaatcagtggttctcaaccactggcaattttaacccccagaaaacatttgacattatctggaaacatttttggttaacacaacttggaggggtgctgctggcatctgtggctgatgatgctacttaacatcttaaaatgcacaggacagcaccctccaacaaataattgtcagtatgtcaaggttgaaaaaccctgagctataaatgatagagctaatcttttgttaatcagttataattattttaactggttatagcaagtttgaatgtcaatcaacttttgaatataaatgtttttaaaacttatcggcacattttgaaattaagactacttcaaaactcattactattactattttattacagatgaacccacaagatcattgagtggtcttatcttgaagaataatgtgaaagcacactttcagaacttcccaaatggtgtaacagactttattaaaagtgaatgtttaaataatattggtgactcctctcctctgattagagccactgttggtaagttatattacaacagttttgcttactttgtttgtaactgggtcatttttagagatgacagattatttccttaggaatttttgtctgtttcatgttaaattgtgttggggaaactttcattgcctttaaatgcttttgaaatggtgtaatcatggtaaaagcgctctcatccagtgaaactagtgaccctggataagaggagagcctgatcaaacttagcctaatcagagttggttaaaatggggcatcaacaagtgatattaatttgcggacactactttttcttgagcatgcagattagagttctgtttgtttttttgtttttttttgaagcagtctctgttgcccaggctggggtacagtggcacaatcttgactcactgcaacctctgcctcctggattcaagcgattctcctgcctcagcctcc

SEQ ID NO: 115838 - DNA, 1056 bp, Homo sapiens
ggtgcaggttgcagtaagctgagatcacgccattgcactgcagcctgggtgacgagcgaaaatctgtctcaaaaaaaaaaaaagagttcctgttttgtcttgtgggtttgaaaaatatttatctcttacttacaaagcattggctctatgacctccctgcagatattcttgtattaaacagtgccatcattgacactgattttacatttgatgggtagaggacatttgtggtttgagaaaaagaactccctagattactctaatgtactcttacgtaccttaaggctttacctactcttgacactgttaaaaagaatggtgagcgtgtgccagccttttccatttcggatccaggagagaaatctccatacgtaagtggaatggaatttagaaggaaggtgggtttcctctgagtgttggcaactcagctgaaaggaaaggagaggatatagaaacgagttatgagattgtttcttcctaaactgtatttcattataaacctatctttaagtgccatttggttcaaactacaatactctgtgtctttaaatttgaaaggttagaagtaataatactagggagagaagaattggttttatctcctaatgagtactttcaccttccataaggtttttgaacatgtttaggagctgactttatctttggaattatttaagcacttaggtatcatctgacttattttaaaacagagattggtgaaattgacttatgtaggcatttttatttcttgctgtgtattagtagaatacgaaaggtctttcattttagtttatgttaagtagatacttaagtattctaattgtgagggaccactgcagttttcagtatagaaacagcttttatttagttgctttactacagatgaaggagcttcaaacataactgcagtgtattttcaaatgacatgatgtctaggatttgataaaaaagcaattaggaatgtgaaggtggttgtgggtagaagtatggatgaaacaagattgaccatgtattaatgactgctgaagctagttaatggatacatttagttcatta

SEQ ID NO: 115839 - DNA, 1211 bp, Homo sapiens
gtttatgtgaggttttttttccacaaggtacggaatggtgatatgggtgttggtggtgagtgttactaattttttgagacagggtctcactctgcccaggcatgagtgtggtctcatagtcatggctcactgcagcctcgacctccttgactcaggtgatcctctcacttcagcctcctgaatagctgggatcacaggcgcataccatcacgcccagctgattttcttgtatttttagtagtgagagggtttcatcatgttgcccaggctggtctggaattcctgggctcaagagatctgcccgcctcggcctcccagaatgctgggattacagcatgagccaccatgcctggccaaatgttattatttacataaaatgtgtttgtgcacacagttgctcacatggcaatgcctgacataatgctgttggatttcctaaagaagtgtgtttttgttcaaggtattttgatcacaactatagcctccaagggagaattgcagaattggcctgacctcttaccaaaactctgtagcctgttggattctgaagattataatacctgtgaggtaaggatatttgtttcatacataattgggtgttttctgtttttcttgtcatgttgtgtattagcagcttttgggaaaaatagttcctctgaaacatacagcttctcaaaacttagaaacctaaagttacctttgtgttatattacatttgtaaatcatttatttttctataaaaactgttacattataaacctcttttactgtatttcacacaaggacgtatcttgcttttctgttctaaaattattcttggatgtatatgtatgtaatatacagtttttgtcaagcctaatcagttaaagatagaatgaaatttaccaaattcctggaccatgagtacttttttagcttctctaaattgtttttatgcctcttatatgagatatctaagggatgctgaacttgtgttttttgtttttgtttttgttttttgagacagggtctcactctgtttcccaggctggagtgcagtggcaccatcatagctcacctcaacctcctgggctcaaacaatcctcctacgtcagcctcccaaagtagtggggactacaggcatgtactaccatgctagactaattttttctttttttttttggtagagatggggtcgcgctgttgttcaggctgaccctgaactcctgagc

SEQ ID NO: 115840 - DNA, 1009 bp, Homo sapiens
ctgcaacctctgcctcccagaatcaagtgattctcccacctcagcctcccgagtagctgcgattacaggcatgagccaccacgcccgcctaatttttttgtatttttagtagagacagagtttcaccatgttggacaggctggtcttgaactcctggactcaaatgatccacctgtctcaacctcccaaagtgttaggattacaggtgtgagccactgcgccggaccattgtcttcgttgtaatcatacattaactctgacctgtgggtttttgtgtgtgtgtgtgtgtgtgtgtgtgtgtgtgtggttttttttgttgtttttttggggtttttttgccactgattagatcactagcatcctttttgtttggggagagaggatgatttctcatggttagtggatacagtaagtatctctttaattagcaggcttccaatttgggtagaaatctattttttgtggaaaccatatttggtgttttgactctgtaaagcatcgactcctatacctctcaaagagcggaggttgaaggcagggcaggcacaggaataacctgtcaacaacaaaaaaaccccacaggaataacctaacctaaaagggaaaaaagaaactatccgccatggtggctcacacctgtaatcccaaggcctaggtgggtggattgcatgagttcaagaccagcctgggcaatatggtaaaaccctattagaagaaattggccaggtgtgatgtgtgcctgtggtcccagctactcaggaggctgtggtggctcacacctgtaatcccagcactttgggagactgaggcaggtggatcatttgaggtcaggagtttgagagaccagcctggccaacatggtaaaaccccatctctactgaaatacaaaaattagccaggcatggtgtcgaatgcctgtaatctcagctactctggaggctgaggcaggagaattgcttgaacccaggaggcgaagattgcagtggactgagattgcaccactgcactc

SEQ ID NO: 115841 - DNA, 1035 bp, Homo sapiens
gatgatataataatttgttttaaaattgaatattagagcgggcatggtggcccatgcctgtaatcccagcactttgggaggctgaggcaggcggaccagctgaggtcaggagtttgagaccagcctggccaacacagtgaaaccccatctctacaaaaaatacaaaacttagccgggcacaatggcaggcacctgtaatcccagctactcgggaggctgaggcaggagagtcacttgaacccgggaggcagaagttgcagtgacccgagatggtgccactgccagcctgggcgacacaccaagactccgtctcaaaaaaaaaaaaattgaaggattaaatttatggattttagaaggcattttatgtgggctgagaacattagtccatacaaattaatcagcattcttcagtttgttttcaaatggcttcatttttaacaaattctgataatttaaatgtgtctcttacagggagcatttggtgcccttcagaagatttgtgaagattctgctgagattttagacagtgatgttttagatcgtcctctcaacatcatgattcccaaatttttacagttcttcaagcatagtagtccaaaaataaggtacttatattgccagtactaattgattaactgtgatataaacctgaccattatcttagttttcattacctaatatttttgacattagcaaaagatcaaaagatattggatgttccagagaggtgaacttatgtaattgaaattgactacttcagtaacaaaacctgtgaaatgttgactctttgtgaggaaatttttgttaaacatgataaaagttttgtgccttttacagtggttaattatattcatgatagttaacaggcatcttctaacttcctttatttaaggccaggattagttgtgggttttttgtttttgtttttgtttttttagctttgattttagaatcgggatacatgtgcaggtttgttacaaaggcgtattgcgtggatgctgggggtttagagtacaaatgaatccatcacctagg

SEQ ID NO: 115842 - DNA, 1032 bp, Homo sapiens
atagaacaaagttacaatgagcatatgttaaattttaaactttgtttctaggtctcacgctgttgcatgtgtcaatcagtttatcatcagtaggactcaagctctaatgttgcacattgattcttttattgaggtaagacttgttcttgtctccctcccaaccccccagctttttttttttgagaaggttaggtgatgctaactgcatgtagttttgctttaaaacaagaatcatttataattctaaactcaatatttaattaaattatttctgatagtattaaaactggatatgggatagactaacttttgttagctgagaaggcacttttactaatttttctacttgtatcattctacaaacactgattttggtggcggggtatgtttagtatcttgactactttaaaaatttttccttcaatatactgttcaaattgcatatggaaaccaagtccctcagctcatgcagtttttgaaatgtgaaaaattggtgaggttagattaagttcatttggtagaatctgaaggcacagactacaaggacagtattttccattggtttccattgtaaaattagaggcatcaggaaaaatagactctttaggcattttgaactttctgataaaagtggaaagaaaagagcataattttctggccaggaaccataagcaccacaatttcttctcaaaatctctgctacttgataacaattaaaaggattgttaaagttccttaagcaccttcacttttattttcatgaaatggaattttaaaagtcccttagaagtcagactgctgatactactgttgggaaattataaggaagagtagggggggttacgttactttttttctcgtcacttaaattgaccagcttctttctgagcatcttttaccaataaactaagagtagtagccataaagatcctttagccatttacaagttaaaaccaaaatgtgtcttaaatagttttactgactactacctactatggaacagatactgtgtttgatactagggatacttaa

SEQ ID NO: 115843 - DNA, 1050 bp, Homo sapiens
atcagtttagggttaagttagaaaatcagtgtatactaatatttgtcgattattgaatctgtatcacctttttataaatcttgaatctattaccacctctcaccttaaaaatcagggttggtagggaatagtcttttgtctctgcttctgggtgagcaaacaaatgctcctatgtcctaatgacatggtttcttaaaaactaaaaatttcctcaaagtacagctgattgtactctatcagaaaagaatagctcttcatcttttatcaaaatcataatctttgtcagttattccacatttaattcttgtaatctaatattgtaggccaattcagtcagtttttggtacctttgtagggtttctttaaatgtcaccaacttgcagattacttattacttgtgtgtaagcctttctaaaactagaaaaaattatttcttgtgcaacagaatctctttgcattagctggtgatgaagaaccagaggtacggaaaaatgtgtgccgagcacttgtgatgttgctcgaagttcgaatggatcgcctgcttcctcacatgcataatatagttgaggtaacactggcaatttaaaggctctttcatcatctttcccctaagagaaatactagatagaaaatacaacataccggatgggaaggggactataaaatagttataattgtcttaaaattataagttatctttgtggggagttttgtatttctgggtatagttgtacatactgtataactttggaagtgttttaagtagtatgttatctagagcctccttttcacttccaaagttccatatggtggagagaagagaggatcttttttaaaggttgcagtctaagatctgttaaaaggctagcattcgtggtatgcagcaactcctgttctaaaactttacacatggctgcatgaggtaggcctgttttttctttgaaaagtcaggcgggactgattgaaagtttagtgttaactaaagtgaagaaattttatcagttgcttggtcacagctggggagcctaatttataatgttacagttcttt

SEQ ID NO: 115844 - DNA, 1050 bp, Homo sapiens
cagtgtttcttaaatttaactgtattttatagtcacctaggaaactttaaaaattcaaattctggccgggtgcggtggctcacacctgtaatcccaacactttgggaggccgaggtgggcagatcacgaggtcaggagatcgagaccatcctggctaacacggtgaaaccctgtctctactaaaaatacaaaaaaattagccgggtgtggtggcaggcgcctgtagtcccatctattcgggaggctgaggcaggagaatggcatgaacccaggaggcagagcttgcagtgagccgagttcacgccactgcattccagcctgggcgacagagtgagactgcatctcaaaaaaaaaaaaaaaaaaaaaaattgcctaggttgaaaaccataaggtcaaaagcttgcttgataataggactgaattgatactaatggtgtgatttttaaactgactaatattaaggatattgtgtttccagtacatgctacagaggactcaagatcaagatgaaaatgtggctttagaagcctgtgaattttggctaactttagctgaacagccaatatgcaaagatgtactcgtaaggcatcttcctaagtaagtgttccctcttataaatgctgccttgttctttaatttcttaagtgattcttcattttcatatttttataaaattcattcttttgccatcagggagtgagattctaaagaagccagacttaattttattgttggtaaagagatttttcaaaaagcaattgcctattttaaaaaaaattatgtgagtatggtttgttctaaattataattgatttcggataatttacagcacagtatttttgtggggtttttttgttttttgttttgttttgtttttaaaaaacaatccttgttatttaaccacagactctattgtgaagttttgttttttttccaaaaaataatttcccactagttgtgatgcaacagaatttagttaacttaatgttaagcccatttttctaaaagtaaagtaatataagctcgtgggaaaaaactaaattgcagaaa

SEQ ID NO: 115845 - DNA, 1012 bp, Homo sapiens
acacctggttctcctgcaaaatacctgtatcttacaaaatatagctctatgtattgtaagtcttacctagttaaattatgctagctctaatgtttaattactactaatctttctattttagaatttagaaggactttgagcatgaaagtttggctggcccacatttcttaaacctatccaggggattttatatttgactgcttccttttctctattagcgtttcttcagttaatgagagcagacatatatcactgaataagttcaaagacaatattaccattgattatctcattggttttattagtacatgtaaggttaagacttattaattattctcttgagatcttaaggtctttgtttcatgaatttctttctttataggttgattcctgtgttagtgaatggcatgaagtactcagacatagatattatcctacttaaggtaaggaagcttttttgatgaatagggaacaagatttttatattgacttagtacatctttggatttggccaataaaacattcattgagaatagatctcctgtaaatagacttcctattatccataataggatagaagcataagtttaagtaatgataaattcttgcttaatttggtactagatggtgacattggtagggttattattaatttccccttaattacttggagttattttaaaaacattcttatatatgctgctctgaatttgattcaggtaacttagattataccagccagtggaggccatgtagttggctgaaagggccgtataacctaacaggtgtgttaggtcagtctattcgcccctccataaggaatatgttctgtacatgggcgtggttcttaatcactctggaagtatatttcagaattctgtgcatgaccccatctctggatattctgtttctcttactcatgtacatactattagcctataatgaatgccaccaaaaatttctcttaaaaaaacaacagggtgatgttgaagaagacgaaacgattcctgat

SEQ ID NO: 115846 - DNA, 1304 bp, Homo sapiens
aatcattttaattgtttttctaaatacttttgattcaagattggttgaatccatagatacagagggccaactgtatatatattactttccggcaggatctcagaatgtgcccagtaaagtccattcacaacattgaccaggatgggagcatgaaatgaatctcttcaatttgagggaaaaatatgaacacataatactcaatctgtcctttaaagataatgtttcttgtagaaacgcttcctctgagtaaacctgacctgattggctggcaaactaacaacaatgaatggcttccaaaagagagggttggggtggggggaggggaacctgctactgtagaaactagtagagcaagctcataaatgatcaggatcctgttgagcgcagtttcaagcattcatcataatcttcagtatacccagaaagtttagcatgtgtactttattcttcctagtgcctatcttcagttgccacagcactgcagtctggattccttccgtactgtgaacctgtgtatcagcgttgtgtaaacctagtacagaagactcttgcacaagccatggtaatttttttaaaatgtcttcctcttcttgacatggtggacatttttctaaagataggtataatgtatacagactttttaagtagttaattaaaaccaaacttacaaaaaacattgtgtctaatttcagctaaacaatgctcaaccagatcaatatgaagctccagataaagattttatgatagtggctcttgatttactgagtggcctggctgaaggacttggaggcaacattgaacagctggtagcccgaagtaacatcctgacactaatgtatcagtgcatgcaggtgagacttgaaaggtgaaaatgaattgaagcctgtttctctgtgtcacattggggttaatttcttcttatttcttgtaggataaaatgccagaagttcgacagagttcttttgccctgttaggtgacctcacaaaagcttgctttcagcatgttaagccttgtataggtatgaatattttctactgctatgaatatggttttttaaagttaacatttacatcagctttgtttttttattattaaactgaaattgcatggaatcccaacatttataaatgtacactttattggttaaagtaaacttgctgtgattgaaacaggcaagatggcaggaacccctaatatttccttgagcttgccatcatctcagctttttaggtactcctgtgactggaggaaagcttagtaatatactttagagtaaaggacatgcccaccagggaagccttgg

SEQ ID NO: 115847 - DNA, 1282 bp, Homo sapiens
tacaatatactgctattgaaaagtttactacatagtttaaattttttttctagctgatttcatgccaatattgggaaccaacctaaatccagaattcatttcagtctgcaacaatgccacatgggcaattggagaaatctccattcaaatgggtaagatgtttttccctatttaaaagcataaggcctggcgcggtggctcacgcctgtaatcccagcacttcgggaggctgaggcgggcagatcacctgaggtcaggagtttgagaccagcctggttgacatggtgaaaccccgtctctactaaaaatacaaaaattagctggcgtggtagcgggtgcctataatcccaactatttgggaggctgagtcaggagaatcacttgaacctgggaggcagaggtttcagtgagctgagattgcaccactgcactccagcctggtgacggagcgaaactttgtctcaaaataaataaataaaatataaatttttaggtgccttgatatttttgtaattgctttaattttaattatttgtatttctatatttatatgacatgtcagagttaatacgggaagcaaaatatttcacattgatattttaacgttcaattttttcttttttgtttttttctttttgggatgatctctaggtatagagatgcagccttatattcctatggtgttgcaccagcttgtagaaatcattaacagacccaacacaccaaagacgttgttagagaatacaggtaccatatgactgaactgtttcagtgaagagaaaatttgttgccttttaattttaatatgcgtagagaaaccaaagcaaaactagcttttaaaatcgagcttattttgtatttaattgctatttcggattttcagtaatgaaatagactgttgcagctacattctataaccagttttcagtggttatatattcagtggtataaccagaaaaacacttttttcccctattccagtgttttaatacttcctgcaatggatcccagcaaagataactattgaaccacctgaattttgcttttaaattaattcggagagtaactgggagctgggaagtaatttttttttttaatctgtccaaatgtagtcaaaaagattcagtggcaaattggttaacagtggcatttgtagtttgtatttcatcatataattttcttcgaattgggaatttaggcagtatgttatgggattttttttttaatttatttttttttttttaggaagcttgtttctcttttgcatttatagagagcatgt

SEQ ID NO: 115848 - DNA, 2237 bp, Homo sapiens
acattcagatttgaaagacttgccattataaaattattgtggaacctaaagaaacttctatttatttttaaatgtgaatgcttaactgcaaataaatgttgagtgtaatgtatatgaaagtttcttgtgggatatcagctggtgaatttgttacatagtttgtttaacaaattggctttatttataagattatattttaagtatgattatatcctacataaataagtcataatgccctaaagttgatggattaaattgatattattgagaaacacacttgggattcattagattacctcttatcacaagtggctgcataaagtattgttttctttatttcttacccaaaaaagtggggttttttaattattaaaatcattgtcaatggctaatatctagattttagcagcttttaattaccattatctcaatatttcataaagccaattccttagtctgccgttaatttgcttttttccgattagtatatcctgcactgaactttttcaatggaccatcatctgctttatcgcatgtttcattggattgttcatacttgcctgtttaatgagaatgttgcatagtttgtgtcttttgaacataggttttctttctcttgcttcatatgaatctgctggattttagtattatctgtgtagtttgcttcaagtaatccttaaacatttttctttaccccccaccctttttttatgaaaggttaacctgtaagtttttgagagaacaccattaaagcacttcatggtttgttttctgtttgtattttttcctgttgtgtatgaatgtatttacatgtacgtacctttgaattgcagaatgcagttccgagttgcacttattttagctctttgtaagtttaaagacttcctcaatttttatggtgaatatatgtttgcccacttcaaaattgtaaaaaaaaatagtgtgtaattagtataatgtattatctattttgtgctatacctttaatagcagaaacagaatatttattttttcctgtggtccacatatcatatgtcattgcagtggactgtaaatttcctttattagaattttatttcaaacatggcttaaagttagtggactgttacctgagttatcagaggtttgacaacatgagatttgacattgtagcatagcaatattctaatccattcattcagtgagtaccatgagacttaaaatctgacagttgattttgatgtaaggtaacaaatttccactggttggtttggcaaatgttaatcaaagaaaaaatttttgaaactaccaaaaatttggtttaaattccctagataatttccaaggaatggaaatcactttcacctgtattagtttgagatgcttgagaaatataatcacatttactgatattttctcatgaaaaaaactatagattttattattaaattctgaaattttggctggcttttgaatgaaggttctctaaatttgtccatttaactgctcatcttattaacagaatgataccttgacactcgattgagcgagaaaagcaatttcatcatggtttttggtgttctctcaatctttagatttttttaattccttttgtttttctttttccaagagtatgccatatatgttgctgccccttattttagggggtggtaataaacagcactggtgaaatcttatgtttattatcatacacaaattctgttggtttctgtttctgagttatttgttgttttttctttattttttctccttccccctcatttgctcatgtcttggttggcgtttggtggtgtataaccgtgattgcgttaccttagcaataacaattggtcgtcttggttacgtttgtcctcaagaggtggcccccatgctacagcagtttataagaccctggtgtgtattattcaatctttttttttaattcatttttcttcactctttctttctctatctcacttttagatatattttcagttggttacaaaaatcacaatcctttatcattgccaaccatgtgactaatcttgtcctatcaggtttgtgaggtttttcaatagcatcgtcatgtatatttattttatgttgtggctaacgactaattgatgcatgggataagattgtcacatgcttgctgtgttaaaaaagcttgattatacataaaaagcatttaaatatccaccagaaaaataaagatgcatgcaaattctataaatttaggtttttgcattacgtttctt

SEQ ID NO: 115849 - DNA, 1061 bp, Homo sapiens
ctctatttcaaatcaaggtcatttaatatatatttagctagctttaatttctttctaggccagtcaaaactgtaagatcattggttttatgtttttctttaatccggtaaatgaaagagtatttttatgggtgtcgatttggtgctttcagttcatttctgatgctgaacatttattgcacagggggttattttgttgtgtgatgcaggacattaaagtccagtataaactgaatgagttgaggttccttgactgtgggctaatagggacagccattaaggtaatctcttctaattccttatgatcatagttaatttttaaatgtttccttttttaagctagattctattgtgacataaactctgaggtttacatatatcttttgctgagtttgacaaatacaatatcaacctaagatgtatttcttgcttgttacaggattttatatttttttgtgatgccgttgcatcatggattaacccaaaagatgatctcagagacatgttctgtaaggtaactaataagtctttataatgcatcatcttgagactgttaatatcctagtggaaaactttaaattatgtttacattttttgtgaaagttaggctcttcaagtcagtattgatagtttacatatataacctttattcttggtaacaaagttggcttgatcttttcttaaaatacagcagtgactcttatctgtagaggatgcactttgaaagtattttcccaagtgtaccactagtttaggtggtcccattattccatttaaggaaaatagtatatgtttttcaagatggaaatggagacttggagtataatctgaaaaagagtaaatctaaatggctgccacaggagtaagcccatgtcattatttgctttgttaataccctcttttgattaactcgtcagtactcaaccacagtaaaaaataaaatgcagttacacatttgaatcacccaagattaaagttagtgaactatagtttgtcgtgaactcaaagcttgtgtatttgcagtttgaaaaaatacgacataaaaattgtattgcttggatg

SEQ ID NO: 115850 - DNA, 1223 bp, Homo sapiens
tttcacgtgctttgaaagaaaactcagttgggttttggcccactgtttttgtttttcactgtatgtttcactgagtacctaccatgtgcccatcacttttttttttcttttttttttttttttttttttttttttttttttttttgagacagagactctttcgcccaggctggagtgcagtggcgcaatctgagttcactgtaatctccgcctcttgggttcaagcaattctcctgcccgagcctcccaagtagctggcattacaggcacatgccaccatgcctggctaatttttgtatttttagtagagatggggtttcaccatgttggccgggctggtctcgaactcctgaccttgtgatgcacccacctcggcctcccaaagtgctgggatttacaggcgtaagccactgagcccagtgcctaggactatattttaaaataagcaatgaaagattctgttttaatttgggatggactatattcatttggactcttgctccttgagctcttctgtacttaaatgggactagcagttctcatctctgagcttcggttttgtcattgagttatgttgaggattaaatactatactgtatgtgatgccagaacttagtatgttgcctggcacactaagttgactcagtaaaggttaggaactgggccagtacaataaatatcagggttttgacattcatctttagattttcaacatgaattaagacatatctgactggaagccagaagatgtgctgaatgagcatgtacagaagatgtacaccaagttgaattacactttagattgaattggaggagtttttttggcttgcttgcttgcttgtttactccaagctaaaatttaaatctggaaagatttcaccatccaagctgtctaacctagaaggtagtagaaatggactcaaagcttccagaatgtgtcagagcccttcatatgtgttgtcctacttcagtcttgagtcctcaagagctgttttccaaaatggctttggcattttggaaaagtgctggattcaccttatgttaaattatgagaatgcaaaagatgagaatgacttgtagcttcaaagcttcaatgagctactaacaagtcttgagcactttcagatttattacctctgtggtctcatcaccaatcatgaattaactgttctaagacaaggtatgaaatagttctcggttttgtaattagagctaaaagtaga

SEQ ID NO: 115851 - DNA, 4822 bp, Homo sapiens
ggtggtatgtacctatggtcccagctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacaaccccaaataacaaatgctcttttgtgttttgataggttggatttctgtttgcttaatattgggaatactgggggaaaaaaagatggtgttttcattctaaggattgtcctaaagaaagtgctactttatttttaagaaagtaaggccacttgttatataagaaataacaagttcccattgggtcccattttgcaaaaggggataaagaattagactgatagcatcatacgaggcatatttcactatacaaagtgttgtacacctgtctatacaactctcctacccagcttgacctcacttttcatacctgatgcagcaaacaattcagtgccataggagaaggaagcagcatggttataagtgactaacacgatattaggcaatttgtccaaatttctcattttctttataggtaaagatagcattcttatttgattaattttttgttccactggctttgaaagacaaacgattgttaaagataaaattgtttttgttctttttcttataggtccttcagtcttggagactataagggagcctctgcacccagggaaaatgttaccctttacaggggggaagggtaaaccagtagggaatacagtacaatcccaaccctactgggaggggcgggagggaggtgttgccgtcactgtattaagtcgatgttgggaaacgttttaacatctggagcctttgtgggtggaaatatgtctccagttacaactccgcagtggatgtgaagaagcaaaaaaaaaaaaatctattcagtctactcacaaaacagtacattgtggaatattatggggaattgtaccaaaacaagaaccatataaatgatgcctagggacaagaaagaggaacaattctatagcgcacaataaaggaaacctaagaatgggagttacaaatagtaaagaagctttttttttttttttaatttaaagtttttttatgtaagttttcccacatgatggggccttgttttgcatgttgatgaagaactacacaaagaaaactaatatagttaaaagtcagcttgccttcccgtagtagaagcaggttcttggaagttacaatttaaggtaccccaaaaaagttggaaataaaacaaaacaaacataaacaatgaagcaccctgtgaaatgccaaatgagtcactccttttaccttttttggggtgggcagggagggaggaataaatggggttgggcatatcaaactaaagatgacatcttaattttgcattgaacattaatgtagcggatataatttgatgattatacttcattagatttaatttctaggccaagatgttactttttaaagtgcagtttaaggttcaggcatgcattctggctcatagtggttgaaagtaatttaaattagtgggaaagtagcatgcttgcatcacatagagtgagattggtattcatttacctatgttgcgccagtttgtgttgcagtttaccaattcaatatagccctgcatttaaagttcctttttaagatttgtggattttatttttattaagaacatagatatataaagtactgtagtttacaggtaggccttgaaatatcttttttaggatctgttaggaataagattgatattgtattgtgtgtaacctgcacaatgtggaaagctgatatacctgtgcaaaatctttgcctctgtgctgtcagtgtgatgtgctttctgcatggttatatactactagtgattttatcaaaacttctaaaatttaaattacgtggtaaaagatctgtaaaaggctgcataaatgttagttggcacataaagacaattgtagaagttgaaaaatgattgctatatttcaatgtttattcccactcaacatactgccttctaagcttccctttttttgttcaaagcatgatcttaaagatatgtttaagttaatggatgtaatgcagggttcctacactgtattttggcgcatgttggtggccctctgtgccctagatatatgcacacagggtgcaagttaaaagctacagagtgaaagttggtttggatcctcttcatttcatttgtttagcttttctgttatttttctctacttacatgtattcctgtgaataaatccttgttaagttaaccctttacttttccttccatgtgtattttcttatatactgtgaatgtgaaaacctaactggtacacttgatcttgtgttcatatgaaagtgcaagtctttattaatttggattgcctgaacagtgtatcccatgatgatgaaggaaaatggagagatttttctttttaactctgctggtcagagatgaagccacgcctttccatttttcaatgctgcatatttaatctgcaacaaaaatgttaagccataacagcctttttatattttagtttgtcacctttgcattgcagaataaatactgaataaccatttttataagcagttgctcctctttgcatggttctattctctaaaagtgttgaatgatacagccattgcactgaagtttgagctgtgtgcgtgtgaatttatactgtttcaaaaatttcaaatgcatggtagcatgtagaaaggtttttgttactatgtgtgtgtgtgtgttttgttttgttttgttctgttttttaacgttctttcacctttcctctactttggctttgcaaatttcagtctgtagagcctgaaattaaattattttatagtgcctgatatttttaatattataagttggattcaaagggtatacagcattttgttttctagtaccattgcttcactgggagctcaaaatttgcctccctgttagtctttaataactgagtagagtagcttttttattcttagattatagtgatattctgtagtgcttcaaatacttagaattctaatatgagagatagtttaatattctggaatagagagtattttaaattgaaatgaccaaattcgatttaaaacaaacacataacaatcttcagtaaagttatttgaacctgtggttgacaattctgtattgactaaaggcaatattgtcacctgtctcattaaaaattagtttccagttaggcagatgaataacactattaaaaatgcacccagttttgtagtcacttgactttttttttttatttaaatgaaatttaatttgaaaatagaaaataaaattaggtaaatatgactggcaacctgaatttgagttgggattctttgtgtatttttcccccttgaggttattgtttcttcctaatttatatttcagatacatagtgtagaacaggaatttgcagaagccatttaagttatcttttgaggtaagctctgatttagcatttattctgataaaatctaatacatcatgggatatatataaagcaacttaattcttgtggtgtagtcttaatagttttgaatgttgactgaatgtctataaaattgtgagtttgtctttgttacattccagtgtttctgcctcttggcatgcttaaagcacggcttacttcatctgctccttacacactaaaatgctgttagtgtgctcaactacagaaatagccgctgctaagtgatgtagattttctacttgaatatttttatgttgtaggaacctcaggaggtcagtgtttactgttttatatatgccttctttttcctgtttgagcttctctctttgaaggattctaacagaacaaagctgctgatcaacctaagttggaaacagaaagtgtaattaatataacttaaatgcatgtttggcagttccatgttacagtccattagcgagtgaacttagtgccacaggtattcatttattcaggaaagaattttgctttttgtattgtctaatctcttcaatgacttcatactgtgtaaaaaaaaatcactttttaatattttttggttggttatttcccaaataatcaacatgtaaataatcttttaagagccagttctgatgctttacattattgctacttgattttgttatgcaagttagatttcagaagaatagattttaaaacacttaaccaagccattacatcttaaaaacaaaacaagtagcatacattttgtaattaacattgataaacactgtgatttttttggttaagactttttcattgatctgaattgcttaaattgcatatattgtaaaataggatcagatgtatattttaaactaatttcaatggattttcctcttgaaatgctttgtctactcagttataaaatattcagatacaagttttatctcaggtgaatactcttgtattgtttttgctttggtgacatgcttataaagggtcatcctagttacattctttgttttttaagtgtatttcattgagaatctttccatttagtctgatttttttcctaatattctagcaggctggggtggtataaagccctcctgacaagccttttgcctacaggtttacctgaaaatgagctacatatggtcgtcattttcttcaaactctcaaaataggaaagtggaaatttttctcccctatataaaattattctgcctagca

SEQ ID NO: 115852 - DNA, 1941 bp, Homo sapiens
caaggaggggaaactaacttgctactagtgttgttaatgaagtataggccttggaacatttaagaaaactggtcttcagatagttaagggcttgggataatttaagtgaaaagtgagatcagtaatgagctgtgttgttaacaatattatctggtaataataccatgcaatatagcgttgtataccaacttagtgcattttatactgtattaaatatggagatacttctaatgcctctctaaaattaaattttacataaaagttagttttattcacctttaggctttccaagtgaattgtgactaattttttcaatcttacatagatctttcacccattagcattacttacgtagataattctttatgcctagttattatacatattaatttttaaggtatacatttaaattacacaattgttcattgtggtttgtatcccagaatgtgttgtgttttttaaaagatgcataatagctgaatgtatgcatgactttgaaagaagttaaaatggtgattttttttcacctcttgtacattttaaaaccaggccaaatctatttgccaagcagtgtatcactaataagaaaagcagtttttccttttattgcagtttttgtttatctgccatagaatttccttatactgtggcttggtattattcaagattagctatttcgctggtattacatctttttaaaagcctattataacatggttagcctataaggcagtgttggtccccttctaatattggcctcataaaggggttccactgtactttccgcatattactgtgttgttgttttcctttgtggatatataagcaaattgagcttgggtgatttttatggagacaataattagacaatactgtataattagttttacttaatagattatcatcttgtgagaagagatgtttaaacgtggtaaatcacttcatattacaaaacagttttacacttaatatgttaacattgggtgcaataatttagtagcattagctttagttacaaatataactggatctttctgctgacaacttaggttgtatgagttatgcttaaaagctttaaatctgatgtttcctgtacctgccacactatgttagaatgtgtccttcaaacatatcctcctgcaacttctcaaactgtactaaattgatatttcttgaagtctaactctgtgctaacagatctccattttaaatagaatacggttttaatttttgataagctgctgaattttaaagagagttttttggggccaccaaatattttggatcatgcagagaatatatattgtactgtagtaattttgtatttacatttgtatgatgtgacataatagatgtgaatgttaatcactgcttgactatgttaataaagttgtttaactatagatgttgcactctgatttttaatgaaaggaaatgagttttctttttccctcttaccccattttggatctagataagccttatgttttttgggatttttttccttgtttttagtttgaggttttgttttgttttttccttagcttacacattagtacacttttgttgttgaacatcatttatttcttaaaacaagtgttttcttatttgtatagtatagtaaaaacctgtttttccacattttaacttaactccttgatgtgttttaaacagttgattataggttctgctgtttgaggataggggacatactattctgtaaaaggaattaaaggcgaaattgtgaatataaaaagttgatgtaaggagagattgcatgagtgtgtatgaatgtatgtcctattaaggcttcctctttatccttcaaacagttaagatttgtaatttggggaattaacatttataagagtaattttttcttcaggttgtaaggcattaatatagttgcatgttactaattaaatgtattaacacatttca

SEQ ID NO: 115853 - DNA, 1657 bp, Homo sapiens
cttttcaagctttgtgttacttcttgaagaacttgaaacaattttaagaaagacaagtgaacagttaaatgaattgtaatacaactacctagtgataactgctgttaatatcctgtgcacatatataaatatatggtgaatttgtgtttttagttatatccagaattgtttgttaatatacatggacatacctacatattattctataagcaatttatgcaactgtcttactgttgttggacattcagaagttttttctaatttttcactcttagaaataaagttttagtgagagtcgcaatgcttaaatgtttgcaaacatctgtagcgatttcttagtgaaactagcaggtcaaaggtagttggtctagtcagattacctttcagttaaattgtactcattttcatatccagcaccaactccagtggattctgtcatgtgtgctgtaagttgtgatttaatagcatgattttctaactttaggaaattttatatacaaaatctaggtttttatattacatatttaacagttatttgagtcttatattgcaggcagtgttccgtgatctcatggagcttaacattctcttttaggaagacagtagtgtgttaatggtggcaagtgcccataaggaaagaaggagatggaaggtgatgatagagtgggggaggttgctttttcaaatggagtaagcaggtaggtctgagagggtgttgtcatatgagcaaaaagctgaagaaatgatggatgtctgaggaagaatacttcaggtaaagggaacaataaggacagatgtcccaagaaccataatgcgtttgtgtaaaacaaatgagagggttctaatttgagcacccagagtaagggagaagagtagattagatctaagagataactggaaggccagatggtatagttgttatatctgaatgaagtaaagggtcattgtagggttttgggttagaaaagtgatgtaattgagaatagactatagcacaagagtcgaagcaagtagacccttttggggatgctactatgaacagggaagagttatcagtggcttgaatcagggtggtagtggggaaggtgaaaagtggctggatatctggatatgttttaaggaggaatcaacatttgtcaacatactgaatttgggttgtggagagaagaatcacagatggctcttaagacttttggtctgacttgagcagctggaagggtgcagtttaccttaaccagagtagggaagatctggcatttggttggagacatccatgagaagtagagtaggcagttggagttcagggagataacctggctgaagatggaaagctggaagttggtgtataaatactgtttcaaatcattggacaagaacatcatctgaggactggaacaattaaagatggtagggactaaccctgtagcactcaacattaaagtctgagagctgactaaaaatcaaaggagcgtagtattgtgatgtatattgtctgcagtgagaattacatttatagcatgaaggtcattattttggcagatttctgtatggctatgggagacgtagaatgagggccatctccttcctctcttctagggttctacaaagcttgggcttctgttttcctcaaggccaagttcagtggctttgtttcttt

SEQ ID NO: 115854 - DNA, 1031 bp, Homo sapiens
aatgtgggaagtcctcttatttgacctgtgagaatggaaaatgcttacttggatccttttgcacatgggctgctcttctctggccagtgtgcatggcctccatgaacagagtggtgtactccacaactacagtgcaggtggagaggcagatggcctcaatcaggctaccaaagtttcctcagaaacccctcagcagccagtagccttggttagtcaagccatcatccaggataatgagcttacaggaaaatcactggttatgggaggcgaatcagcctctgagacaaaagaggaagtgacttccagtaaaaacaagttaagacatcaaataggagaaggacttccgctttgccattccttctccaaattccactgaaatcacaaagaaatagaaaaataaattcaaagcagcacaggaaaaccagaaaaggtgcttccagcaaacaatatagaaaggaatttttgaaaaaaataagaaacgtgggaatcagtagagaaatctagcagggcataagaacctaaaaccattcaaaggaacaaagtactttgttaactgaagaaataacggagccatacccctaagtccccatcaattcctggagttgctcttggagcagctggctccattgtttgggcttagatgagagtcatgggtatagttttctgacatagtacagcagccccacagcaatggtatgctaaatgaagtcagtctcttaagaatctagtttgcacatctcttctcaactccccattcagtgactgttatgttgctagcttgaaaattggctagggtgggagattttacattgcatggaaatcaggaaatgctgcaaactaggacttcccccactccacccagagctggctgtcaaacatttaccaacatattactgttccagagtaagctaaggtcagaggaaaaggacaataccctggagggtcaggaaactattctaagaagagacgttacctacagagtctgcctatccctaccaaatcccatgaggcagattcttgtaatcaaaact

SEQ ID NO: 115855 - DNA, 2546 bp, Homo sapiens
tcctgcctcggcctcccaagtagctgggactacaggtgcccaccaccacgcccggctaattttttgtattttaagtagagacggggtttcaccatgttagccaggatagtctcgacctcctgacctcgtgatccgcccacctcggcctcccaaagtgctgggattacaggtgtgagccaccacacccggtcacaacttaattttattaattgtacctttatgggtgattacaaagtgtatgcatatatgtttgtatgtaggtatatgtatatatagttaattgtaaactttattaaagcatataatattgctttatactgtttaaaatcatacaataaatgagaaaaatttatgaaaacacctcacctgagcacaggattgcatattagttaatgttggctttttatattctcaagtcatttttatctgtttttttatgaaactaaaaatctttttaaattttagggggaaaaaaatagtggctttgatgtcctctaccataatatgaaacatggacagatatcaacaaaagaactagcagattttgtaagggaacggtatgtattttttaaataagtaatttgtttaacaacttaatagcaatttaaattttagaatataaataatggagaaaactttatttggatttggaataaagtaattgttttaaaatatgtactgtaattatatctatctatttgtatctatcatctacacagctgagggctgtatagtggctcaaagtggctcaaagtttaatacccctggtttgtggattccttcttgaaaatattatctacatatttttcactggatatgctagcaaggtgatataatacagttgagaagtttgtaggataaaacattaacatttgttaaccatgctaaaataattagaaaagactaacttttctgaacttcagtttaattttgtgtttttgtaacttttatttttaaaagtcctaagtatatattttaaaatcttgcaaatttataaaatgtgattgttgttaagactcttagaatatagcgaatttaaaagctattaagaataaatataatttgattatgattcaaaatcaaacaactcaaaagctgctatcctactaacttaaagctattttgtggctaccccaactttgtaattatttatatgaacacatttaaaatctttaccttgataatatagggatactttggctttaaatttaatactccatttattcatgtattctttcaacaatgtatatcccatcagtgctgtgtaccagctacttgtctggattatgggaatatagtggttaagataacagcttctcccttcatggagtttacagactgataggaattggggaataaactattctataagttcggttcttttcttactccctcctctctactggaatcaacaaggaatgcaaaagctcaagtgctctgggtaaggctctccttcctccgggcttctacattatcattggcaggagcaaaggaaaggccgcagaactctgcatctcttggcatgttccttagccttccctcttcccctacacttcactactatcactgtctactttgcaaccatcagggcagatattatgcctttgagccctgtttatgttagtcaccttaagaagtccaggactcctgggttatccttcctttgcccagaatctatccctttctgattctttgggtagtgagacaatccgtcatacttcccctttactactttatttttctccatagtatgtataactgtctgataaaagtgatatttcatttatttatttttctgtctcttcccactagaatataaacccaacaagggcagggatttttgtctttttttgcttattttgtctttttgctctatttatgcacttgtgatagtgcttgtcacttggtaggccctcagtaaaggtttttccatagaatgaatctgtaacttcattatgctgatcccagctatcattatttttgcctgaacttcagcagtagctcgtaactgctctatctacagttgttcttgttttcctgcaacttactctgtctactgtagttggagtggtttttttgaaatatagtacagatcagttgttacctcttctctttcagccatctcaagggcttcccattgctcttaagataggcctgcatattctgaccctaaaactacctttcaggtcttattgttctaggctctatgctaggcatgggatacaacagaatattgtctcacaggagaacatagaaacaattaacaaaaatgagtaataacaaaactgcatacatagtacaaagagatacatgaattacaggctgctccttattctttccactccagagatactgggtatcttatagacaggcttcctctgtctagtccaggctttgtaaatacttattcttctcttcacctagttaatgcctacttattcttttttttttttatttagaactttaatttccattcaaaagaagtaaaatataaattcaataagttggttaaaatattcctaaaatgactccacatttatatttta

SEQ ID NO: 115856 - DNA, 2611 bp, Homo sapiens
ttatttatttatttgagacagagtttcgctcttgttgcccaggctggagtgcggtggcatgatcttggctcactgcagcctccgcctcccggattcaagcgattctcctgcctcagccttccaagtagctgggattacaggcacccaccaccatgctcagctaatttttgtatttttagtacagacggggtttcaccatgttagccaggctggtcttgaactcctgacctcaggtgatctgccagcctcggcctcccaaagtactgggattacaggcgtgagccaccgtgcctggctgattagggatgtttaatctgtactggaaattgaacttctttaccttgctgttaaactcacacattgatatactaatattaacttttttgggtgaacaaagtattactcttgtagtaatagtattttaaaatgacagaagaacttaaaggagcaggaaagagtcacagtactatcagcgagaggcagttactgttaatatttcctttttgttagagagctggtttttgtgcaaatttggttgggaaagagtttggagattagtttagatattctgagtttgaggtggttcacatatcttaattatgtttggggcagttagatattgaacaggtgggtcagtgcaagagtagtgtgaagatctggatttagacattagaagcagaaagttggttggaccaatcaaagtaaatggagggatgatggtggttgtagaatgttcccctattaagggtagcacacattgagaagagccaggcaaaaggtaaaactataagttttgtagtgttaagaaggccaaacaggccgggcgcagtggctcatgcctgtaatcccagcactttgggaggctgagtggggcggatcacaaggtcaggagtttgagaccagcctgaccaatatggtgaaatcctgtctctactaaaaatacaaaaattagctgggtgtggtggcgggtgcctgtagtcccagctactcgggaggctgaggcaggagaatcgcttgaatccgggaggcggaggttgcagtgagccaagattgcaccactgtactccagcctgggtgacagagccatattccgtctcaaaaaaagaaggccatacaaaatgtgtattctgtatttataggttacatgtctgtaggataatttgtgtcttttagaattctatatttaatggctgtggatgttttttacggaataaaatctcatatgctaaacagtagttatataaaacacagttttctagtgtgaaatatttgctaatattttagatctgatcacaaaataaattaagccatgaatgaagttcaggatttcagacttgatgatatatttagttttgtgcaaatgactgtcattaatctcttgttctattaaatgtgcatcacagtgttgaagaataataaaactaagtacaacaaagaattattaaatacaaatgacacacttatcacagtgaaccagcttacagagacagagagaatacaagaagtagcactcatgtatttcctgttcagataagcattggtactaaagataaaaagagttgtgattccattaaaattttttctgtggctgagcgtggtggctcatgcctatgatctcagcactttgggaggcctaggtgggaggattgcttgagccctggaattccagattagcctgggcaacatagcaaggccccatctctacaaaaaaatacaaaacttagctgggtgttgtggggcatgcttgtagtgtgagctactcaggaggctgaggtgggaggattgcttaagcctaggaggtcaaagctgcagtgagctatgatcataccactgtactccagcctgggtgacagagcaagactgttttaaaaaaaaatttgtgtgtgtgatataaattattttagttctataccagaaaggacatttgaagataggccggaaattcatgactacatatatgtacttatttttaacatgtaatttttgaggtatctttttgttttgcacttttaattgtattttgataactttgctgtttttggtcactaaataagaagtattatgatgtggatatttgatttaacagagctaccatagaggaggcatactccaggtcaatgacaaaactagcaaaatctgcaagcaattattcacaacttgggtgagttaatttcttcctctttttcagtgtttatttaggcaaagttcttaaggattctaggttccttttgaggacataacagttcaaaagcatagtaaaatatatgcttatttaaaagtatctgtaaatattaatatattcttcacttgatagaaaatataattgaacttgctgaatcagtcaatgcagtcaaaactaaatgaaatttattttttccctttttaaaaactagtcattcaatagtgtttgagattataaatgttatcttatgcacatgcaatgtatttattctagttgtctgtaagttcctatttaaattctgttgtagtttaacagtgatctttaaaaactcacttaagataaactttattgaaatgattaagatgcattaaaaatgtctcctgtgattttatagactgtcattaaatcttccttttaaaaatttgtatt

SEQ ID NO: 115857 - DNA, 1094 bp, Homo sapiens
ttaagacttgtgataatgtaattaacccatttctatattcctgaggtccaaaaatattttaaataaccaatgacaaaaaaaattcaaggtcagtctgtcaatcattttattcattattttaatttcatcttttgcctaaataaagttgccatatataccactattatttccactggttccttgttagaaccttaattttcttttttacttttaataagttattcccatattttttattttcttagaacatttgcaccagtatgggatgtattcaaaacatctacagagaaattagcaaattgtcacttggatcttgttagaaaattacaagaattaataaaggaagttcagaagtatggagaagaacaagtaaagtctcataaaaaggtatcagtttttttcttgttaaataattgattggtcagatattgaatactttatagttcagtcattttgatggatcatttcatactaaacagactaaagaagaagttgcaggaactctggaagctgtccaaaccattcagagcataactcaggccctccagaaatccaaggaaaattacaatgccaagtgtgtagaacaggagcgtttgaaaaaggaaggagctacacaaagagaaatagaaaaggtaatcataataaaaattacatatctgtggtttcaaagcaccttgacatacaaaattgcatttaacatttagatcaaactgaaaattatctcattttaaagatgaagacactgtgccttacagtcctagtgattacccaagtaaaacacaggagatttgtaaagtatgttatctgtggtaaataggttagcgagcactaaaaaacaatgattgatttgagacggagttttgctcttgttgcctaggctggagtgcagtggcgcgatcttggctcactgcagcctctgcctcctgggttgaagtgattctcctgcctcagcctcccaaatagctgggattacaggcgcatgacaccacatccggctaattttgtatttttagtagagatggggtttcgccatgttagtcaggttggtctcgaactcctgacctcaggtgatccgcccaccttggcctccccaa

SEQ ID NO: 115858 - DNA, 1041 bp, Homo sapiens
cattaaatcttaatagtttgtacttgtgaaaaagttctgtatttgattcatctattttctctatttgtaagcagtatatatttttgttaaatgaatgaacaaatgggcatttaatggcaagattagggtgttaagaaggttggaatggagtggctattagaaaattttttaagtgaatgctaaataattatggttaatgtttagtgagctcttactgtgtgccatgtaccatgccaaccactttgtaggcacactttgattttcagcaactttttgaagtatgtactattattctcattttacagatgagggaaatgttcagaggtaatgttgagagatttgtctaagctagtacatggcagaaatgggattcagttctgggatttttgatcctggatcacaaatcaagtcacatgctttggaaaaattagactagaactaagtgtagatatgttgacataaattttaattttgagaatgcctttaaaccagggggacttgaccttaaatgtgaacctaaactgatgaacgataaccttttttccctgggtcacaaatgatccagagtatatttaagcaaaaagaaagaatacagagaatgagcttgaagtggatcagtgtttttcttaaagtattacactagagagtaattggaacattaaaatgtgttctgaatcaagccaattttattttgatttgccatttttttgtgactttttttcttttccctgatgcaatttttcccactctgctttggcttcctgggctctttttactgctttttgcttttatatgccagtgtcatttcctaagacactgctcagccaaaggctgacaagtatgtggcatgtgctgccttattcatggcagataccgttgctagatcattgcattcgtccccggaggagatctcagtctctctcatctcagtgctgtaggcagtcactgccaatattgagtgttggtactcatgttgaaacctgtcatctccagcttagttcaatagagactttttgtttgcgaatgtcagaaagccatata

SEQ ID NO: 115859 - DNA, 1050 bp, Homo sapiens
aaaacttgtcctgttgatggcctgagatttaggattgattccgaagcaacagggattattaattaaatatttcacatattttgtacttttcctcagtccacaaaacatttgtggtgatcaaagattaccgttcagtaagttgcttttcttcttgtaacatcttttcaaagttttaatccaaattaggtttgaatggattctttaggttgatggcttttcttatagcatttatttattcctacctgatgattaaagcatcatatttaagaattgttttgctttgaatcattgacctcttagagctgttcttctgttctatgagtttaattgaactcatagtggtgttttaaaataatgtgtaaaagagcatcaggagacagagccaaaatggttttatttgcttttatacaaactaaattgcccttgtgacccaacataaaatttaagtgctaagagcagttatttattttgacaaaagaattaattgagtctaaaacagttaaaattccagttgtagcaaactattcattaagactctcactctggctttagtactgtcaaaaaaaataacttgtcttatgattaaatagcagaatgatgggcagtggactgcatttgaaggagatgctgaataaactttccacttgtgaaacagttcagaagtgacatgctacagggggggtcagaatgtgcattgatatccagctgagttgtcaactggcactgagccaggcacgcaaagccttgccatgtgaagcggcatgtggagcatatgccatttgtaaaagaaaatcttgttcatgcatgatttaatggtttttttaaaaaggtagtatttagttttattatgccagaaatcattatttctatctttaatagaaaagtttgtgtggatggtactcaatttaaaatttttaatatatattttttgatttgaagtgatttggcatctttcaaaatgtgttttttttggacatttttctatttcaaatggattttaagaggatgtttagaaaacataagagaaatcaagatatgtttactatagga

SEQ ID NO: 115860 - DNA, 1031 bp, Homo sapiens
ggggagggagagggacattaagacaatatttttagatccccctatttgtagagaaatctttcttgttaatcaatcagtggctttcttttttaatggaatgatcaataataatgctgatcatgaatttgtacatagttaagcttcacatctcagaagaaccagtaacaaaatcctctatcatctactctctgtttcaagctctattttaaaatttcttcatatagcaagttataccagttaccattaataaattaaaaattatttcacaaaaaaagctagactttcatgaatttatatataaaaagtactaaatgacagcttagtgggagataattttttagtctcatatttagcttctgggatatttcattaggagagtaattcatgttttgctactttctcacactgccaaataatttgatatttcacatatatgaagtatgccatattttatggcaattaaggctagtctgagcagtcagtcatttcagggctattttaattgttttctaatgatttccactttatcatcatcctcttctacaatctatctctcatagcaatgctaaattaattgtccttgaagatctctttgtgggtggatgtgtatgatcttacatgaaaactcttcctatttcctgtaagctgtagttcacattccttgacctgctatacagttagagagatctggattataatcccaaggtcaccacttaactagtctgtaattagttcatttattcattcaataaatatttacttatttacccaacttattatttacctggcattttttaagtattgaagatacagtgatgaacaggacagatgaggtcccaagcttatgttctagtagtatttactatcttggtagccctgttcttcccatgaacaccaccgaggattcagcaaccacctttaccatgcttgtttcctctcattaacagtactgccagcttcttgaaagcagaaactgcatattcttgtgtctctagttttgtggcatcatatgtaattggttttcagtaaat

SEQ ID NO: 115861 - DNA, 1223 bp, Homo sapiens
actgcacctggccccatattatacttctaatgggtctgctgtatcatctttttatctaaaacaataaaattatattttgtggccctctaaaaagcaaacatgatttgacctttataacattatttgacgtttataacaaaatttagtataatgaataatgtactttctttgaagttttaagatatctccatatgcttattatgtgtaaggtgacttaagggaggcttaggaaaagaaaagaaaattttatctataaagtaaatgttctatgatcttttgataaacaatagactatgttttattaacataagaaaagtctaaccaatagggttgagtggttgctaactttatttctgtcatccacatttagcatcagcagttatgagcaaattatgtgtgaggatgcaagatgtatccataagtttaatatgtttatcaggaatgtttatgtttctgtaacaatatatatttattttaaaggtataaaaccaaggaaaagaaagacctttgctttgccaggaatcattaaaaaggaaaaagatgcagaatctgtgtaagtattttaaatatcgtcaaaatcctttttgtttttataagtgattaagaataagacttttgaatttggaaagaaaaaagtattttggaaataactcaaaagtatatgtgtaaggtgtgaaaaacaagcctttctaaatattaataaatacatttgccaattcctctggttttagatcaaagtattattaattatttgaaaatgttaagacattatagacaaaagctttaatgtctagaaatggaaagttttgaaatatccttatttttgtaaaatgataaatgcatattttaaaaaattaaaagtgcaaagaaaactaaaaattcatcaaagtcttaatgcctaagagaaaatctctggtcaactatttgatgaaaatccttctagacaattctgagtgtacaggcacatggtgatacctatacatacattgatggaaaatgttaaataggggagagaaaagccctaacattttaccatttatactaggtcatcatttttagatggaatatttggtccacttataagtctgatttaccttctttttttttttttgagatggagtttcactgttgttgcccaggttggaatgcaatggcgcgatcttggcttactgcattctccacctcccaggttcaagcgattctcctcctacctcagcctccca

SEQ ID NO: 115862 - DNA, 1037 bp, Homo sapiens
attctgtttttttcttgggaaacatgccagaaatcaaatctgtatactttattttaaaatgtggtgttcttactaatttattcttagctctattaaaatacaacattgtgcgtgcatttgagttcatttaagagcttgtcattttagaaataacagcaacaagaaccatggtcagtacttttctgtgctttttgttttattttaaagaagggttgcttatatttcttgattaaatgtatttctttatgtgtaattaaagaagacatcaaatggagctccctttggttacagtgagagagtagatttaccaaatgctgttaagtaatgtgtagacagacatatttttcaaaactgttcattagataccgttcatgttgataagtataggggtttcaaacaatctctgtcctttgcttattgttcttacctgcgtaactattgtttcctttgatcccaaaacattttgatcttttacagcatcatagtgtaacaaaataactaaaaatattttgtgaaacactgtgttttatgttacttaactaagataaaattagtattttgttttatattttggccttaaaatacaattatgatttgttaacaaatttatatgaaaaataagaaatagacttataatgagttacggggttaaaaccatcagtgtatttttggagttacaatgtttaccttaccacttggttactctgtttgatacccttggttaactaattaatgaaaagcagcagatgtgtttggcattaactttagtactcattttatttctgcattatttttatgcattttatttctgaattatttgtagcattaaattgatgatgtaaaattaaatacaactttaatacttcatgttttagtttacatatattccttttaaataaaacatttttaattcagtaactgatactattttataatgatcaatattatccaattttgaactttacttagtacttatccagaatacaaaagaatacagaattctaatactgaataagaagtgattgatgaatttgact

SEQ ID NO: 115863 - DNA, 2579 bp, Homo sapiens
tttagtctagtgtctaatcatattggcaaatttcttttcaatttaattttttgttttttaatttggaaacaaggtctcactctgttgctcaggcttgagtgccgttgtgtgatcatagctcactgtaaccatgaactcctgggctcaagcaatcatcttgcctcagcctcccatgtagctgggactacaggcacatgtcaccatgcccagctgatttcttaaaccttttttttttggtagagttggggttgtgttgcccaggctggtcttgacctcctggcttcaagccattttcctgcttcagtctcccagagtgctgggattacaggtgtgaaccactgttcctggccaacaaaggttttgatatgctcatactgttggtaggaatgtaaattgatactgtctgtcttgtggatagtttggcagtattgccccaaaaaagaaatgtgagttcatttttgaccatgccatctccctgctaggaatttactgttacagttatagtaacaaaactttacacacacacatacacacacacacacacattgtattagtgtgtatatgtgtgtgtatacatatacacacatatataaagtatatatgtttgtacacatgcagacacacttgatcaagattcatgcatatatagaaagtgataaatagatatttatttcaacattgtttatattagcaaaaaactggaaacatcaaagcatccatcaaaatgggaactggttaaataaattggtggggtaatagatgttataaaggattaagttgatctgtgtctgctgatatggaaagaacttaataaaagcaagtatgatattttaagtgattgctgttttaaaaataagataaatatgtggatatatgtattatatttattttagaagaatgagttacaaggtactttacttgtggatacctttggggccaagaattacagtgatcagtagagaaaggagacttgtttttacttattttattttgagatggggtcttgctctgtggctgatgtgacttggatttgtgtctctgcccaaatctgttgtcaaattgtaatccccagtgttggaggaagggattggtgggaggcaattgggtcaggggatagatctccccctcgctgttctcgtgatagtaagtgagttctcacttgttgtttgaaagtgtgtagcatctcccccttcactctcttcctcttactctggccatgtaagatatgcttccttcctctttgccttccgccatgattgtaagtttcctgaggcctccctagccatgcttcctgtacagcctgtagaactgtgaaccgattaaacttcttttctttataaattacccagtctcagatagttcttgatagcgatgtgagaacagacgaatacagtcacccaggctggagtgcagtggcaacgatcatagctcacttcagcctcgacctcccaggctcagccattcctcccattccagcctcctgagtagctgggaacacaggcatatgccaccatgcctggctatgttttttcatttttagtagaggcaatgtctcactatgttatccaggcttgttattttcttttatttgtagcctataaataataacttacggcctattcatggcttcctcttactaattattttttaaaacatcaataggctatcatggtagggaaattattgttcatttcttattcctttctttaaaggtctatgtaatttaaaaaattatttttagcaactgcatcttttgaaagttggccaaggaagtgtaattgctctttttttcttttttctttttctttttctttctttttttttggttttggcctatgtccacattccaaacagaaattaagaaacatttcattgactcttgagctccattctggtatatattttttaaattgccaccactactttagccagagtaaacaactgcctttaagattgatgggtgaagttgcctgttctattcttgttcatactgcttttgacctagggcttcactccagctgtatgggccctaatatagaaatcatggattgaatgggtaaagatgaacacaggtaatgggtacgtttttattaatatcaggtttctgtgcatagttctagcagtaaaaagatagtacactgagaatcactgcttttaagaaaaactttttattttgaaataaagatgcatagaaggttgcaaagatggtgtatgtaacagtactgtgtacttgttaccccttcttcctgacactaacattttacaaaactgtcatgtaatatcacaactgaaatattgacactaattcaatcaaaataggacattttcattagcacaacaatctctcatgttggttgcccttttacagccacttttccttacgccttccttaacttctggcaaccactaaccttttcttcattcctataattttgtcaattcaaggttgttctgtaagtgaaatcatacaatatgtatgcttttgagattggcttttttccactcagcacagttctttggagatgtatccaggttgtggtacatatgaatagtttattttttattgctgagtagtagtc

SEQ ID NO: 115864 - DNA, 6077 bp, Homo sapiens
cttgaagctgttaaaatgcattaaaactaatttctgagttataatatttaggcaacttctgctgtttttaatactcccagctagattatttttatctttttattttgaagaattctaaacaaattgtgtgtgtgtgtgtctgtgtgtatacacacatatacatatatatacacatagatatatacatacatatacatatacatataaataccatcatggtctctcattttggggtctcatcagtcagccccagcagcttgccccagccaatcctgcccatccatttcctctgcccaaattctagaatattataatttcatctgaatttacattatatatatctttacacttgatcttagccaaaaggccaagaagcgatacatcatatatatctttaaaacataatcacaatatcatcacatctagaaataatttattactccttagtattttgaaataaccattcagtatttatcatctttgatgtccattttattatgctttgtttgaatttgttgatatgtcttaagtctctcttgatctacaggttccccttccctccctccctctctgtttagctttctgctatttatttatttatttatttatttatttatttatttatttattttgacagagctcgctcttttgccaggctggagtgcagtggcgtgatctcggctgactgcaacctctgcctcctgggttcaagcaattctccagcctcagcctccagagtaactgggattacaagcatgcaccaccatgcccagctaatttttgtatttttagtagagatggagtttcaccattttggccaggatgatcttgatctcttgacctcatgatccacccgcttcagcctccaaaagtgctggaactacaggcgtgagccactgcaccgggcccgctttctgtgtttttattggcaagactaagtggtttgttttatagtttcctttagtctggattttgccgattatattgccatactgtattatgttttacttctttatattatttaaattggcatttggatctagaggcttgatcagatccaggttcaagttttttttggtcttgttttattttgtcagggctgcctctctcatgacacacatggtgtctggttgtcactctttatggcatgttggcagacattgatggtttgtcttagatagttttactagttcacccagacttaaactgcataaggaggtgctagatcttatatttccatacagcttatagcaataagaatatttagcttgataatagctttcaaatcacatgtactttttaaactaacttattcttcctcatttataacagaaactgtagattttgagcaatctgaattggtccccacctcagtgatttcttgccctgaaattatgagttgtgtttctcctgtttcattttgcaggtctttcctctttcaggtagccagagcatggagtgtgatttgaagctaattaactaaaaaggtgtaatttttcttcggtgttcatcatttcattaacctgttgatatctgagaagcggtttggttcctaagtaatacctgaggctactttgataatctctaataattttgtacattggagttgtcattataatttttttttctttttcccttagaacattcctgatgtagatgaagaaggctacagtattaaaccagaaacaaatcagaatgatatcctttcatcatctagtattcttaaggattatgttggcatataagtaggcagttataagaaaatcatgtattaaagcctcttccaattttttattaattataaaatatggttccttgtttgtcatttgacatgttttttgttgttgttgttttttgttttttttgggttttttttgagacagagtctcgctctcttgcccgggcaggagtgcagtggcacaatctcagctcactgcagcctctgcctcccgggtttcagcgattcttctgcctcagtcccccaagtagcttggattacaggcatgcgcaccatgcctggctaatttttgtatttttagtagagacagggtttcattatgttggccagccaggctggtgaagaactcctgacctcaagtgaaccacctgcgttggcctcccaaagtgctgggattacaggtgtgagctaacccgactggccttgacatatttttattaataaaagttagtagtcttatttctgttaaggtctgtttttctctttggtttttttgagatgaagtctcactctgtcacgcaggctggagtgcagtggtgcgatctcggctcactgcagcctcctactcctgggtgaaagtgattctcatgcctcagcctcccgattgtctgggaccacaggtgcatgccaccatgccgagctaattttttgtatttttagtagagacaaagtttcaccgtgttagccaggatggtcttgatctcctgacctcgtgatccacctgccttagcctcccaaagtcctgggattacaggcgtgagccgtcgcacccggcccaaagtctgtgtaactcttaaaggtttcattccttttttaaaataaatgtgtgaaaaactggttatacgtctaaggtaatttaaaaacaattctttaactgaaactcacataccaaagagaaccatttctactcatctagtgattctgactccgaagatgaagaaccaaagaagtatcggatagaaattaagcctatgcatccaaataactcacatcacacaatggcttctttggatgaattaaaagtatctatagggaatataacactctccccagcaatatctgtaagtacaaacacgtttgtactctttatataaaagtctttatttttcttacctacctgtgtctggtcaaacattacttagcaattgttaagcatgttgactgaggaaatacttagtttataatttttatacagggaaataaacttgtgaatttggcttaattttgcttttgaaagtagaaagtgaaaatgtcaaaaatttactatttctgccatttgttgcatttcataaacagtgctgtgtgtctctggcagaattctttgaattggcagtattaatttttgcctcatctaattttgaagtgtttcttctatgttttgtgagccttatgtaggagggaattttataaaaatgaatttaaagattaaattatatatttgcattttttttagtctgtcactgtaacatttattttcccatacttttcatacaaggaaaggcacagataagagttcttagtggtaatagttaattcctcaattctaaaataccgtatttaataggatttgagggagaaataaaacattatcccagtaaattttttcctcattgatgtcaattttaaacttaaaaatgttacactatgtgaaaaaagcaattcttaggataagttaagtatatctatatgtgatcatcatgattgacattaagtctgttcttcttgataatgaagaataaaggttctcaccgtttcatattgttgtctaattacatattttatgtagttacatgtatttgtttggaaaaaaaggtggttttctcccagtcatgtacttcagaatttagtttcagaactattttcttcctaccaaaaatatttctgaaatgaggttttattgtaccattactatttaacgttaagattaatgttgaagtacagagttgcttaaaagttggtgaatatagggccgggcatggtggctcacgcctgtaatcccagcactttgggaggccgaggcgggtggatcacaaggtcaggagatggagaccatcctggctaacacagtgaaaccccgtctcttgaaaaaatacaaaaaattagccggtcgtggtggcatgcgcctttggtcctagctactcaggaggctgaggcaggagaattgcttgaaaaccatgaggcggaggttgaagtgagccgagattgcaccactgcactccagcctgggtgacagagcgagacttcgtctcaaaaaaaaaaaaaaaaggtggtgaatatatacgaagtatgaggttgtaaaccattaaaaatgtgtgttatgtaagagcataactaatataaaatatgtatgttaaatatataaaacaaaagcctagaggaatatatgggtagtgagattgtgaatagttttaaattttctcttttgtactcttctcttttcagtttgtttttaaaaaacaatgaacatgtattaatttcatactatgaaaataataatcagaacaattttatagttaatattggataagaaaagattatatctgaatatattttgctgcctcatttgcttaactttttcccacctgacagtgtatgtgttttaaggtgtatatagtttagatatgattgaatagggaatgataaattattacagcacaaaaatacagtattcagaattctaacctaattttctttttcttccatgtactactagagacacagtccagtaagtacaagattttatatttttgcccattgacttttaaaatcattgtaattttggaagattgactttcaaaatatttgtattaaatttttagattagcaagttttagtgttttgttgtagatgttgctttaatattttaaaaacattaggtgttaaaactacatgtattattttttgctgtaaaacaaaaactactgttttttctctatatcttttatgtaaatacactttacaattgagcagatatactaaaaacaacataaaattaggttcccagtattaacattttaccaaatatttaattatcaaattcatttgttttatggtacctattttgcatctctgttttaggtacagatgaatcggaatttgtctagtaagtttgacatttgaattgtttattttatgtctattaaaatttataaggcaatttgttagtcttttacctttagctgtagaaataaatgatcttttctcatcatgagccctactgcgtggctagaaggataattattttaaatagaaaacagcgtatctatattatttcctgtagagctgagagacatgctttaaacttcaatacatggctacaacatttttcagaaatcaccaaagccaaaaagtaacttctgattcagaatgttaaacggtttcactggcattctctgtcttattaaccagaaagcgtttataagatgagtaatattgaattttacctatttttaagttgtgtcacaattacaaattctattataatttaattatactaaaaattatactaaaaacttttctaaggtgctaataccttttgcagaatcatgcattaaaaataacaagggttgtgggaaaaacagttgaagcagcccactcaaaagctatgtaattttgttaacagaagacttaacagaaactttaacatcagttttattaaaaattctaacagagtttaagagacctagtaaatgaataataaataccaaaataaaagtaaggattttatctttaaagaaatgttgattgtagcttaatgatagggggtgtgaggaaaatgaggataaatgcagggtgctgagttgtggagatgagagcaaaatgcagaaatattgaagaatagcacaataaacactgaggcaaaacaaccaaccaaactgagccaagtgaagaatgtagagtgaatggttatcatgtactgtgatactcctccatagtttgtggaagttactcatattgatgtactttgcattcatcaggtattgcttggtgatgcaaagaaaacatgaaggtgcagcaaaaattgcttatgcaccaacatgagtttttcattaatgatgctattcccctgtttaccacttgcttgtgaaatgaggcacattacaaatccaaaaggtagcaaaacaaactatcttataaagagacttgctccaggttgctgtaagattcttaatttttcaaaatatgacatcctcaagagttaataactactttttgtcaatacaataatcactaataatattcttagaacttgaaaaatgcattcatgattcatcagttaaaattcttaactagaatttatgtatttaaacatttttctaatttttaaagttgcaaccca

SEQ ID NO: 115865 - DNA, 3102 bp, Homo sapiens
tttcagttattttaatgtacacaatagaaaacttgttaaaatattgtttgtatttacattatcaattccaaaatttttaattgttatagtgttgagatatgtgtatagagtttctgtttttcattaaaatattttatttctcagattatgaagttttcatattttaattttttaattagatgaggagttaacaaaatcaaagccatctgctccacccaatgagtaagtttccatgtttaattttgttaaaaaatagactttattttttagagcagtgtttgatttatggcaaaattgaatggaaagcacagagatttccctttatgctccctgccccttcatatgcccagtctctctcacagtcaaattctctcaccagagtggtacatttgttagaatcagtgaacctgcattgacacatcataatcacctaaagtccacagtttacattagggttcattcttggtgttggacaaatgtgtaaggacatgtattcgtcattatagtatcatacagagtatttttgctgccctgaaaatcttctgtgctccaccttctcatcccttcttccacacacttacattttaagtatccttttgtctttttttctagagttttattagctctatagttttaattccagtaaagttctgttaatcatcctgttttctgagctgtcaaatgcaatgttggagtttttagaagtttaaaattatttctcgcttggtaatatgtccttttacaataaaaaaaatctatttaaccacagttggccttggtagcctcactacttctaaataaatgatgaaaccctaaattcatacatatctgtatttcagctggttattctcatgggaattttctcatttcttccttcagttttgactgtgacgttataaaataatatacttcgtaagcttcaaaaaaagaagtgtgtcaagttggaaagggagagagaggctagaaggcatgttgccagctcttcttaaaaaaaaaaatgttaagccaatgtttcatgggtctctttttacttctgtgtctatcagttaagaatactctctttgagttaatggttttttgcttgtctgttttgagacagggtcttactctgtctctcaggctggagtgcagtggcgtgatcatggctctctgcagcctcaacgtcccaggctcaaatgatcctcccgcccctgtctcccagctaatttttttcaaaattttttttttttggtagatactgggtcttgctatatttcccaggctggtctcgaactcctggactcagactcctgagcctctcaaagtactgtgattacaggcatgagccatcaagcctggccagagttaatgtaaaatacaagtaaaagtaggcttagttaaataggtagtttacaattatttgatacttttgaggtactaattgagcatagtggtggtatttattggatgtatcatttttttaaagataagttgttgagtgttttaaaactgtttttaggagtcatacagttgcaatgctaggctttatcatacgaggtatagtgtgctttcatgtaggtgcatgttgagatgctggatatgtactcttatgtaattacagcactttcattatagagggcctgtttttttgtgtgtgtaagatttcctaaaattttttaaaataatggcagtttgatgcattaaaatatgtaagccacctttctgtacttaagggcttaaaaaaatcactttaccctttttcttcatctttgaaaataagtatggccttataaaattttaacccaattttataccacttaaattttcttttcaggattgggtgctatgtgtgaaccagcagatgtgagcctgttttagaatcaagtagctgtatgtctttgggcagttcatttagacgtgtgctgctcttttttatttgtaaagctgaaattattattcccattatgatagcccccaaggtggttgaatctaacaaggcatgatgaatgggaattaatcttccccattctcctctgctaacttcacatgttatcttaggttacgcttctaacaaatattggctgttaaatctgttaattaatttctacacatatactactgatagagtatccaacttttaaattaaaaaaaattattttttttacggacggggtcttgctctgttacccaggctggagtacagtggtgcaatcatagctcactgcagcacagaactcctgggctcaagtgatcttccttagcctcctggatagctaggactacaggcatgcaccaccaagccaggctaatttaaaaaaatttttttgtgtatattgggtcttgctatgttgcctaggcttgatcttgaactcctagtctcaagtgatcctcctgcctgagcctccagaagtgttgggattacaggtgtgagccatggtgcctggccctaactttttaattatgtatattgagctgttagaattctatgaaataaaaataagtgactagaaattttatactaataaaatattctcgttaaaatttttgcttttaaaaatattatggtagaaaaggaaccagtgatttacttgcttgggaccccctatttggaccatctcttgattcatcttcttcatcttcactaacttcatcatcatcaggtaaatatatatatgtatatatgtatttttttaaataaagaatactttagttgctttttctcattcactttttgtgcattgtacttaatgatcaaaatttctaaaaatttgtcctctgtattgccaaataaaagtgattttattctggttttgttctcttagatactctatgacttaaacaataaaaattggtaaaatactaagtggttttttaaattggcatgttatttctaggcatttcatatcattatccaaataataattcttagtgtttatagataattcaaatacaaaatatatatcaatgtaaccagttctttcttgttggaagtttaagttgcatctaattttctagtattatgaacatccatagaaataacaaattttgtgcatatgtctcataatatgcttgtagtaatttatcaatttaaaatttatggcttacaagatgatgtccatgata

SEQ ID NO: 115866 - DNA, 1050 bp, Homo sapiens
cttcacaggtcaatttatatttcttgaaacactgcttctaatagaaatttgtagcactgatctccaccccaccaccagcaaaaaataaaacacaggacactgaagaaagtaaacaattgcagttatctccttcagaagcttctagaagcagtgcctaattgacctatgcagatataatatagattcatttataaacagtggtgttaataagtattgttactagcttttctcgaaaagcaaattttgaactgaacttaatacttctaccaggcttggtttgagtcaatctaaatgccatttggacagaccacttgatcagtaataaatgcctctgctgtgtaaactctctcacaagtttgaaataacataggctagtgctagtttcattgatgatgaacatatctttaaagtagatatgtaatacacagggaagtgttatgggcttcagattttggtgcacatttcttccagggtacagcttcaagtgtgagtgcagcatgaaagaactggtactgactggaaaaagacagtggcctcagaatctaagcttgatttactagcttttttgttttccttaagcaacctgaacagcgtttgcatcttttatctcttattatggtatgctttctaagtgattccctacgtcccatgcatgtacaactttcaatccgtgtgactacctttttctttaggtctcttcctactacctctatgcaccttcctttcatgcctccttgattcctccattgatgattaaaggcctttagctttgcagtttatttccccgtgtgtatacttaggcccacttatatatttttaattttgtacatctctaaactttgaaaacatgctgaatatgtttcttcccacccattatatttttcagtctctgaattatagcctgtattttagtgtgagccaaagggctttgaaaatcatttaagttaatttattaatgattattaaacatgattttaaagagggtttaaacctatttacttccattttttttactccttctttgattatgctaatacatttgtgactttt

SEQ ID NO: 115867 - DNA, 1129 bp, Homo sapiens
gtcctcacagtatagaaaaattttcccagctagtgcttcctttactcttccttgttaccacagtgatcatacctgtgagacacgacattgtccaggaggaaagagatttcctgagaaagttggcacattataaaaataccattcagtatccattgtctcacaataaagaagcggttttcatataattctacttaaagtcaaatgttaaggaaataaatggtggcttgttcttagaccttaaaagtatactgcaaggaggattatggaaggcatctagctcagcatttaaaattttacacataaggaaactggagtccacatcatccagttgacttataaaagtacatgcatgggtgggaaaagcattggtttttaaaagtcatcagatagagaaaatctatagactctatgcagtgaggctctcccagtctatttgcctttgatctggtttgttttgcttcatcttctacactaattgccagtttaattaccagaattaaatttctaagtccagtttaatcttttttcccttgatacacatttccagtggtttctcagtctgtgtggttgactgttttagctgaatgtacaagagtctttataaagctgcctcaacaacctacattaccagactaactgtccatctttctccccttttcaacctaggttccagccacttgaaacttttcagggttccttaaacacatcatggtcttttacatgtccatgtcttcttcctgtgctgtatctcaaatgcccctcagttttctatgtcacaaattgacttctttctttaagacctagctaaacatcaccacctaggcaaaaccctctttgatcattccttcacttatcttccttatacccagatactttgcttatatttttgttagttcatatatcaccttgtatgtactttttttgtgtgtgttacctttactgggctattccttcgtcagtctcatatcctcagtactttgcatgatgcctgttgggtggtacacagttatgaaatcttcagtgaatatattgaaaagcttcggcaccaagtattgaaatggtgatatctttcttttccgaatgaacagacttagtggaagtaaaataaaagactaggtacaagctgcca

SEQ ID NO: 115868 - DNA, 1051 bp, Homo sapiens
cttcatttttattttttgtttgtgtggttttaattttttcccacagaatctatattttagtcctaaaaaacctaactgggacctactagaaagcaggcaggtggtctgggtaaccttattttcgctttaggttttttttttttttttccagttatctttagattattcaggaggttttgtgtttgtgatggaaactttaatttctattgaattggtacatattagtttatggtttgagacattgctggcaataggacaaccaaaagcaggtgacagtgataatacaggcaaggcaggttgtatgtgaattttatacaacaaagatttttaaaatctacctaaaaagttctctttctttgccatgatttttcaacgctgtgtggatttaagtttctgattctccttgtttcttgaaaatattttctttttctgcattattttatttaaatacaatagaagatgataatttgattgggacacacactgaaattgaaaagcactgtgagacgtcaccaggtattgtatcagaagcaaatgtatgtgttgactaatggtccttaagtgtatctaaaatatttcgttatccaacttttccttttccagaattgtatgatgtctcagaaatcaagaattatgctaagattaactatttcagttttgtgctaattccatcaaattgctgtacaggatccattatatcaaatccccaacttgctgaataggatccattatatcaaatccccaactataaaaacacgatatttttgcattttcttctctgctttcctcaactcagctttaagaaatgtcaataaatcttaattctaaagctatccaaatcaggtaagaagtcatccaaaaagaattaaaaggaatatgtcagttaaaaaaaaaacctctaatacctaaattagtagggcaaaggctgtcatatacgaaaaccatacagatgaagttagaagcatggagatgataggagatagtagggagtgggtgtctgtgttttatttctgagcggaaaggaattctacataaatatccattgattgtt

SEQ ID NO: 115869 - DNA, 1034 bp, Homo sapiens
gcagtaaggcacgcagtggtaagaagagtgcgtttgtgaagaaaaacaaaggcaatgcactattttgaggggatacttcacttaggttacatttaaaacaataaacagaaacctgaacacttgcataaatttgtttacattttaattttgctctgtagacactgatctttctctgatttgactctaaaaggtgtcttatctgagtgaactttggccagggttttttttttttaaataatgttattagtcaagtatttattagtcaaatattgaggcaaagtaatgtgggaatacaatacaagcatcagacaaagaggaggttaaagagaattataataataatgagtagtgtatgaaacattactacttggatagaaaaacttaaatacaaaaatcctaaattggccttaaataatgccctgaagtatatgattgatagaacctggaggaatttggtatttgaatgtttttgaagccaatatttttgaaattttagctgtttagtcaagggcttttttattctgacattccttaaccattctgtctttccatttaaaagaaatgtctgtgtgacatgtcttcctggtttttttttgtcctttgtattaatgctccagtttgttttatactatatttcttagcccccagatttatcatgggacatcactgaaaccagtggtagggtcgtttgtgacagcctaacaatgtgaatctaactatcttgatatttaatttatgtctttctgaaggatttaacaagttaattgtgtatattctaggtgtgtcacggggtcccagccctgtcagccttggaaatcaggataccttacctgtggcagttgcccttacagaatctgttaatgcctactttaaaggagcagatcccaccaagttagtttttaaaatatatgcatgtatgtgtatgtatgtgtgttgggtggaggaggtggtggggcttggtggtaaattttaagaattacattttgattctgtgtagattacagttttctgttgtttatttacctgcttttttg

SEQ ID NO: 115870 - DNA, 1220 bp, Homo sapiens
tgatgattgcattcaatgtacattcattcatcaaatacttgagcacctattatttctaagactctgttacatgtgcactgaggatactttagtaaacaaaagagttctctcctgagcttgcattatagtgagggaaaactaaatatcaaagaaacagctgtatgtattggatattgatacacgctatgaagaaaaataaaccagggttagaggctagagaataacattagatagagggctactattttagatagaatgatcagggtaaacttttttgaggttaatttaagcaggtagttgaaagacatggaggagcaagccatgcagatatctgaggaaagtattccaggaagagggaaccagtgagtgtaagataccaaggtaaaagcatatttggtatattcaagaaacagcaagcaaaaccatgtcactgagtaggagtaaacaggagagtacttgaagatgagtccggagaggtatgagaccaggttaggcattgtaggccatgataaagaatttggaatttattttgagtaacatggaaagccagtggaggctttgagcagaggaatgatgaaattacatgtgttttcagaggagcgctggttgctgtatggagaataaactgggggcagagggtgcggtgggcagtcagaattgatgcagagagaaagttagaaaattaattacagaagtccaggtgagagataatggtggcttgtataagggtattagcagagcaggtgatgagtagtaatgagattctgaatatattttgagaacagaattgtcaagatttgttggaggcaaaatgctaagtttgaagtttaagacatcttagtggaaatgttgaattgatacttggatacatgattctggagttcaaggggtaagtctaggctagagataaaatacttggtagtgtaattagtttgtagataatactcaaaattagtggccttaaggaatagatggaaaagagatctgaaaactaagtcttgattccctccagtgtttagaaaacaggaagatgagaatgatttaacaaaggaatttgagagagcaagcagcaagagaggtgaggagagaaccaatagacccgtgtctagaaactaagtgaataaatcatttcttgaaggcaggtgtgaacctgtatctgatgctgcttgacaggtcaagaaaaattgaccattgacaataattggtgacattcacaagaa

SEQ ID NO: 115871 - DNA, 1830 bp, Homo sapiens
gcaagggcctccttgctaccatcaccatcaccaggcccagtgctttttggggtttgggagggaaaaatagccacaactaggtatagcgttatgaggaaagcaatatccttccagggagggaatggttatcacaaaaaagtgaaggaatattatcagtgtgcttgcatttgtgtttagagtttaattccaggaaaagatgatgctagatgagtatactatttcatgtatataatttttaaaaattaaattgaaaaaataatctatagttatgataaaggatatagatatacacacatataggtgcgtgtgtgtgtgcgcacgtgcacgcgtgtgcctttttaaaccaaatactttaaatagagattagagcattttatttaaacacttttcaaaatccctgttttaggtgtattgtgaagatcactggtgatatgacaatgtcatttccaagtggaattattaaagtcttcaccagcaatccaactccagctgtgttgtgcttcagggtgaaaaatatcagcagactagagcagattcttccaaatgcacagcttgtgttcaggtttgtgtactttttgttttgaaggttgaaatttcgttttaagattttctttcctgctgtgcacagtggctcacgcctgtaatcccagcagtttgggaggctgaggcaggtggattgcttgagcccagttgttcaaaaccagcctgagcaatgtggcaaaaccccatctctaccaaaaaaacaaaaaacaaaaaacaagaacaaaaattagctgggcatgatggtgcgttcctgtagtcccagctactcaggaggctgaggtgggagaatcgcttgagcctaggaggcagaggttgcagtgagccaagatcgtgtcactgcactccagccttggtgacagagctagaccctgtctcaaaaaaaaatgttttcccccttcttctttgaaataataatattcaatttgaaaaccataccaaaattattcttactaaacacctttctgctgtctttttattttgttttcagtggtgctaatagttattttaagattcttttctctctctccatcttatctttcaagcaagcttctcctgtgttccattcttcatcccctgatctaattttccttcatcccacctcttggtttatttctactagtttttcctgtgtcaccaaattactacacagaggcaaaacataaagataagtcaataaaataacaaatatattttttatatatgtagtgatccatcacaatgtgattccaacacaaaagatttttggatgaacatgcaagctgttacagtctacctcaagaagctgtcagagcaaaatccagctgcttcttattataatgtagatgtattaaagtatcaggtgagtgtcacgacattgcaaaaattctaaattaaaatattaaaaaatggaatctagcatataaatgaataagtatgtcatagccaagtgagttttttcccagaaattcaaggatgttttgaaattagaaaatctgtttataagccagtggagattttgaccagtttggtaaaattcaccatttattcatgattaaaatactgagtaaatttaaatgcataaatttgtccttaagctgaaaagactagcagtatcagtcttaacaatgaaactcccaaagtaatcaattaaagttaggaatggcaaagatgcccattagtagatcctgttagtatataagagttttctggatgtgttagccagtacagtcaggtaagagaacaaaataagcattaataaatactgggaaagaggaatcaaaattattattgcttacaggtgatatattc

SEQ ID NO: 115872 - DNA, 1067 bp, Homo sapiens
taattgctgggagtaggacagggagacagtaaagatcagtaatattctatgggctggactttgttgctctggtctataatcccagtactttgagaggctgaggcgagaagattgcttgagcccaggagttcaagaccagtctgggcaataaaaagaaaccccatctctacaaaaaatgtaaaattctctgggtgtgatggcacaagcctgtagtcctagctagtacagaggctgaggagggaggattgctcgagcccaggaggttgaggctgcagtgagccatgagcatgccactacactccagcctgggcaacagagtgagaccctgcctcaaaataataatcataatattctatgttagaaaatgagtggtatggaaaaaagaaaaagtatagactaaggtaaggaagattgaaaatacagttttcagtgtaaatttaaacagagcagtcagagtaggtctccttaaaaaggagccattggacaaggagcttaagaatttgaaggaattataacatttactgtgagtcatgtgattaaacatttgaagttggaagcattctaattccaacttgtggtactacgtggtgaccttttttctcgtgttctaaatctgaattcttataatgtatgaagaatctttgaattctgtgttgaatgttggaagattcgcaaactttacacgcataattaagaattccttcataaaatgctgatttctgggccctgtccctaagctgttgaatcagattttctgcagttggagctaagggaatgtgtgttataaacaagcaccacagcaattttgatgtaagtagtagtaggtccccacattgagaatgatccttactcctttgagataggtctgcttcactctgccaacagatagtcccctcattagatatttttgattttgtggacttacatgttcaagtgtccatgtcattaacatgacttcttaacttttcaggccaaaaacaattgtttgttcttttctctttaaaggtatcatcaaatggtattcagtccactcctctgaatcttgcaacatactggaaatgtagtgc

SEQ ID NO: 115873 - DNA, 1032 bp, Homo sapiens
gattacaggcacgtgccaccacacccaactaatttttgtttgtttgtttttttttttagtagaaacagggtttcactatgttacccaggatggtctcgatctcctgacctcgtgatctgcccacctcggcctcccaaagtgctgggattacaggcgtgagccactgcgcctggccatgggtgcaccgttcctggaagcactgcaataccttttttaagggaaagtttatgtaaagtttcctcctggaatttcatgccctcagttctagaaatgaccactaggtggaagttaatacctttagaatggaccagctgagattcagaacacatttgttcatctagattgagtatgtgttctctataagaaaaaatttattttgccataactttataaatattatgtaaatacttcttatatttacatgctaacattaagaaactatacctagtaaatttaaagaaatagaactctatgttccatgtaggtaacctgataactaattgaaactgatttaacacagtttagttcattctgttaacgggattctcctgacctcccagaaatcatgtagacgcttccaggctttaaaaagccccttgccgtcccggcacagtggctcacgcttgtaatcccagcactttggtaggccgaggtgggtggatcacttgaagtcaggagttcaagaccagcctggccaacatggtgaaaccccatctgttttaaaaatacaaaaattagctgggcgtcatggtgcacgcctgtaattccagctattcaggggacttaagcatgagaatcacttgaacccaaggaggcggaggttgcagtgagctgagatggtgcccctgctctccagcctgggtgacagagtgagactctgtctcaaaaaaaaaaaaaaaaaaaagcccccttgccttctgcagttctctaaaagaacctttttcctgtccatttccccctattaaagctaactatcagcagcattcaattttctgatgattattttaaggagaagcaagttatgcttctctc

SEQ ID NO: 115874 - DNA, 1011 bp, Homo sapiens
tctagtctcatctgccactcccctctacctgtatcctgttctcctgctaatctgatatagatgctatttcgttaaatgcatcatgctctgtctctgtatctttggtaacttctgcctaaaatacacaccatcatccccaccaccatttataattttcagctgagataggtgcttttgtgcctgtagctcctcagagctcctttacagcatttataatattcattataattattggtttactgttcctgccattccattagactgaagtatactgaataaatggtgatgatactagaaacaaaacacctcagaaatacctacttggcattatgttagaccagtaaaactttaaaaagaaaagtgaatagaaaatagcaatgttatacaactcttcccaaccgtagttacctttccatctttacttcttctactactcagtagtcatttcttttttaactttatgccacctatatccctcctagggtttttctctgggctgtcctcagttacttccttcttctcttttgactcgcctcaacatgcatatagcataggagtccagtagttaacatctctgaagattagtattgagtcaaagaaaagcatgggttatttacttaatgaaaattgatattcactaaaaaatatgagatttggaaacaggataatagtttgtttactgtgcacatctaatgaatgtagcacaggactgatgtagtttagcttacttgctcatttgattctattttgtttgaaatgtattttaccctgtgtaagtgctttattcttttctttgtaggttctgggtccctccgagcaaaatttgatctttcagaaggacctagtaaacccacgacacttgcagtacaattcctcagcgagggaagtaccctttcaggagtagatttcgaacttgtgggcactggctataggctttccttaataaagaagcggtttgctactggtaagttaggagatttcaaactttttaatgtacatgggaaacatttg

SEQ ID NO: 115875 - DNA, 2937 bp, Homo sapiens
agtggaaaatgtccttagagtgcatttgaaattgtaattgcaaaggtctgcttggcgtttttcaggacgatacctggcggattgttgatggacctgggaaagtgatgtggcttcagggattacaaacctgccattctgcattatctgttctttccaaacactattttaacttgtatgatgtctttcaaacttagacatatttgagagctgactacaaacattaaatcgcacttttaaagtgagtcattgaaataaatagtactgaaatgattctctatgttgtaaatgatcaactacaatattcaggaagcacatttattcagattctcagtaaaaatgaagtttttgtaggattaatttttaaattatttccagtgtctatgttgaaaaaaagggttatagtgtaatatcaggcctaaagtttcagaagagcaagcacaaagtaatttagctttccatacatttttagagtcagagataactttgaaatttcataagtttgatattcagtggatacaaatagaacatgaattctaagttttgggtaatgttaactcagaacacttaatcaaattgagctatgtgccataaggtaatcagaccagagtccaagttgtatgcaaaaaatctataatttgattctcataaacatattaataaagtataagtgatgttttatatgatttttaaaaaaaattctcaagtgcaatgtgttttaaaataagcttgcaaatgacagcagagacatttacttctgcagttagttaactttataggagttgtgatttttttgatgaattaatgctgtagatttaatttatttttatatggaattgcataatgtgtgccttttaaaacaataacaaaaaccagagatgtgcctatacaatttgtgttcattaatgtgcctcactttttttctcagtctgaatcttctgttcagaatcttacagtgatcaagcatttttataagatatttgcaatttttgtaaatatttttggcctgcaactgggaaggggattcagagtcataaagcctaacttaagaatcctggctcacttctttggtgatacactgtagccactagaaagagaaataaacccaatggcatgtgtttacaggaagaaagattaccttcagatacttgacattaacctcatcaaaagtgtgtgaattttaaaacaaattctaaaaaaactatagtgctaaattggtaactggtattttaactctcaatttagcattttccttgatactttatcattgaaaatttatgcatttatttactgattgtgttgtgaacatgagttttatggtattttgtgagggatgcattttttaaaagattaattttggaaacagaaggagaagcactgccatttgtttttatttcaacaattggaaaaattaccaatttgtacattttaattattcaatttctactttgtaaaaatagggaaattatttgaagtgatatatttggttaaacatttctaaaaataaactaccaatactaaatagtaagaaacctaactttagtagcaaatcttgattaattgaagaaataaaatatttcggataaggtttcataatttacaaatgggaatttcatttataataataaatatgagtgtcctttatttgcctagtagaagtgataaattgtgttatatatgataatttatataaaaccactaattgttccgttaagcttcacagaaaataaaacctctattactagacatttatgtaacatcttgctgtactaaatacagcagaaaatctactctttagcaatatataacacagtatatgcttttttatatattcaatgttagcccaagtctgaatttacatttgactaaagcagcacataagataatttgctaaaatgctaatctttactaaatagtgagctaaattagaatttctaactcttatattgtgctcttttaaatgccaattacagtcccttactggaattctaactgtaatttgctttgcaatcaaactgcttttagggcagccaatattttattattggaattcagacactgttcttaccgtgtttgtttttaatcaaatattacctaaaaatgtacaaattagtgaaatggttaaacttctgcactttcttagttaccacagtcttcataccaagtattgggtacaggttacaattttgaagccatatgagtttatattgattttttttttccatttaaaaatccactaatggtgtaaaagagaccagtagattttcaatgggaaatgtacctagcaagctggttcttgcttatatatagtgataaactttgtagctgcctctttaaccaagaatttgtaaacacaactctaataaatgtgagttttaaaggattgttatttactactttggattgtaattagaacaatgcacatctgtcttccaagattttgtaaatatttttgatttttttcattaaatgtaaattttacataaaagttgtgctcttaataaacatgtaatatataatttatcaattggtttatgtgtctttgtacttgatagtaatagctatatcataatgttaggacaaggcaagctggccaagtaattggtttttaactttgtactactgtttgaacaggcgtacagatcgaactgttatttattggttatatagaaagcttcatttggagtatatcccaaagtgtcaaaattgtttaacaagggattatttttaatatattttaagatatatttaaattgatgttaaatttttgcagactttcttcctaaccagttgctcaggaacacagtctcagacagttcaaaaatcataatgttccaaagaattagttaagacaatcaagcctcccaaaatggtaaatttaggaaggagcaaaagaaggaaattagaaaagaaagaatttatcctaactattgaaaattt

SEQ ID NO: 115876 - DNA, 1064 bp, Homo sapiens
tatagatatataatatatatgtatctatgtatctaatggttcaatttctgtgaaaagccctgactaatacagatggctttagtgtgacttctctaggcttctgatttttctaatctgaaatattaaacagtgggatctctttccatggtcaaagggtattgtctatgattctggagaggaaagaatttgaccagagttcgtgaatgatttaatgattagaaaatacatcctatcaagactaaggaattaatattatttgtatttatattatttagtctggaggggaaaaaggaatgaagagtacctttataatgttttttaaatataagaaaatttgttgaccagctattctcaatttcacctgaaaatagaggaaaagtaaggaatgaatttcaaagcactatggggaatgtaaggccgacttttctgccactatagagagtggttctcaaattttaatgtgcataaaacccccaggagcttctttaagatgcaggttcctggcctctaaacttagcagttctgacttggtggatctgggatggagcctatgaatctatattttaattctttttttccaagccaaactgtatccagctttattaaagatactttccataaacaatcatggcatttcaggcaggatatgggcagacaattgttaacagtatacaacaactttcaaactcccttcttcaatggactaccaaaatcagaaagccactataaaatctaacaaagtcttcatctgatgctctgaacagggaaagtttagagtgagggttgacatttcacatttagcatgttgtttaacaacttttcacaagccgaccctgactttcaggaagttaaatgaaaatggtagaatttatctgaagatccataatctagaaacggaaccactgctgttttgacaggtgccatctcagtggcatcactggaaagtccagattgcctgacacactggtaaccaatgactgggggtcagcccaacagatgtctgggcttaagggagttaagtctatgctgaaggatggaaagggagaagaggacataaaaatgga

SEQ ID NO: 115877 - DNA, 1050 bp, Homo sapiens
tttcctcgaatgttttattgctttattattttatttccactaggaattgtggagttataaatattattagtggtttaccacttttgcacacatgtatcctattatttttggagatttatatgtggagaaagagactggcctctttcattgcacccattcatctacctgctcacatagatgggctcctgtctatttaaagaattcagaagagaccacacagattctaagaaacttgagcagaagaactacattgtgagtagctgacaaaatggttttattatagaaaaatctctagtaatgatattaaatttttgttcttcttttgcttgaaaacagtttattttaaaaaagcaacgtatgatacattactttgctctacaatatccttacataaattcttagaaaaattatgaatattttcatttaacaagtcaataaaatatatgaaaaattaataacaaagaaaaaccacttcttataaaatgctataaaaagtgtcaaaaattgggcatttattttgagattcttggatctgtataacattatagccataaagtagcataagggttgaaaaaaatacaaataaacttcaccttaaaatacttatattgtaggctgggtgtgttggctcatgcctgtgatcccagtgctttgggaggctgaggcaggaggattgcttgaggtcaggagtttgagaccaccctgggcaacacagcaagacctccatctcttaaaaaaaaaaaaaaaaaaaatgatcaaggggaaccaaagacccagatttaatcatctattcattctttcttttatcgtgagcacctactgtgtgccaggcatagtgtgatgtggatacaaaaatattagacatctggttggaggtggcgagatatgtatactcaccgaaatacaacaattcttgatgtgttgtcatagaaatatgaactgattgacaggattgacagagaaaaataactatctgggagggatagagaaagcttcccagaggaggtaatattttagatgacctttgaagaaggaacagaaattaaactt

SEQ ID NO: 115878 - DNA, 1051 bp, Homo sapiens
tcccctcgttcctacttttttctcctgttctttcatgaatttaaaagtttgctgcgtgttgaaaatataaaagattacttaatagtaaaaaagaaaattttgattttctttttacgttctgttttggtttggtttttgtgcttttctatttagagatggaggtcttgctatgttgcccaggctggtctcaaactcctgggatcaagccatcctcccatctgggcctcccaaagtgctggtagtacaggcatgagccacgatacctggccaaaattttgatttttgactccagctgcttctgctggttttatgagtagtcaggaaattctgattcttctaataaaataattatatactagacttttcaaaaatatgggatttttttgtttcaaaaaaagttattacattgcaatcttagctcaaggatgccaaaagagtaacttgtgctaatgtgggagccatttccagtatgctcccaatgtctatggcaaatgtgggtaattggctcccacgctttcctgctgggcttcaaggagcctaagaatcatttactcagcactcaagattgtatctgtcaatagagaaggcaagaaaggtgaaccctgtttgccctccttggtttctagtttatagcctaatcaaagtccatgaattgttttcatctctcagctggatttgagtcagcttcagcaaaagccaaaatatccactttatataatgcttatttctttctttcttttttcttctttttttttttttttagtctcatcctgttgcccaggctggagtgcagagcactcggctcactgcaacctccacctcccgggttcaagcgattctcatgcctcagtgtcctgagtagctgggattacaggtgcccaccaccacacccagctaatttttgtattttttattacatgtttcaccatgttggccaggctggtctcaaactcctgacctcaagcgatctgcctgggattgcaggcatgagccaccatacctggccaactcaatattcttaataggtggtagggctatttccctttttcac

SEQ ID NO: 115879 - DNA, 2258 bp, Homo sapiens
ggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcaggtaccgcgaggcttgcggagagtggccgggccgggcaggccctggctaggccgaggccaggccagggccaggggtggggggtgctggccaggcgtggggtagagcctttcatccgggcctgccaagagcggggagctgtgggggagtggtggggaggcgggtgctctttgggctccctggaaacccaaatttggagctttgcggggtggatttgggatccaggtttcggcctgtgtaggacgtttattttcctgctggtatcttgggaaataacgagcatggaatgctagagtgagctaaacctatccttgctgaggatttcctctttttctagatgaaagaaacaatcatgaaccaggaaaaactcgccaaactgcaggcacaagtgcgcattggtgggaaagtaagttttaatagttcgggtttgtgggttttttttttaaggtttaggtattttaaaaaacatattccttttgcgcttcttatattatcggtgacaaactttgcctatcgagggaaattcacggagctagcaaatctcgaggagcgggggagacgagggttggagacacatcagtgagacgagctaaaaacatcgcctttgtgtaaacatgtttgtgttttcagtgttacagagtgtaagtagaacacaaaagtgtttcctaatttaattagtaaggaaaatgtgtcatttcagttagatcgttgtgcacatcatacccttgacttgttttggcctgagttttctaaagtcagtgcttgtttgtctctcttgtaaattgagacctttctgtactgctttctgaactaaatattctttagggtagttgcatatttcaagggtatttgaagatacgggtacattttggagtttaagagcagtgactattagatttgaaaatataacccaagtaggtatctttcctgttctgactttgtattactgtaaaaatgagggaattaaagtgactgatttttaaatgatcagtttttgattaattgtttttttcctggtggatactgattcacatcaaggggattcttttttgaagctgatttttagattgtcctgtaattaataagaagtccactgtagacagaggtctacctagtttgtattgttagcacattcttagtatttaacaaggtgtggtagcttgttgaaacagagcatgtctttacttggtaaaacttgtaaagcttccatggtacatgtttattaccttttagtttttcccaactttaagcgtttaacttagagttagctgtgagatagccagaagttgcacttagacttaaataataatatacagctttgttaaattactgaactttgccagcggtgaatttatcctgatttttttttactttttatttttgttaacgttagccatcttcaggatccacacccacacatttaacaacattagatgtttcttgtcctctttaatcaattgttatcagactgtggccttcaagtgccagcaaaactcaaattttttgtgtctcagtgtttggatgctcttatattggtgtttttaaccactcttactttcagtacagtttcagaaggagtaatttgaataatgtgcttatgtgcagtctttttgttgttactctcatcattaggctttaactttgggagacatcattttagggtaaaggaaatcttgagatttgctaggatatttaaagctgataacaagattaaattttgtgtcctaacatcttaatactcgtttagctaataatacaagaagtatttctgtagtcacaatatggaaacatttctacactgtttaagaaacgtacttattatgggatgtgaaattaggtgagttaattttgctttagagaaaactgcaggtgttaggtgctcttaggtaaatgttacaaaagccctttattttcatatctaatcacagcattaataataattatttaagtgaaaattgaactctacatatgtgaagtgtatgaaacctctagaaagtatgctgggtttgtctttacaatcttagaaattcctttgagtttcttagagaagatttctttggaaaccagatacatacatgaccatttcaaagtgatttt

SEQ ID NO: 115880 - DNA, 1077 bp, Homo sapiens
aactgattttaagcaactgtccttgctcaagtttgcagtaattgatgtagcgtgccatgattgttacacttgattttgtggaatgttttctacttacttgatttggatcagatactttattaactagaaatgatgaaaatgttaatttggtgctttgccaataactacttgtaagtttggaattgaaaaaaaaattagtgtaaattatgaaattacttcagtttcatctatatagttcgtattaccagtaatcttttaaaaatggcttgccagtattctggcatttttaattacagtgtgatagggattttattcggggcagaaaatagtgtagctgaatatacatctgaggatgtggcagtgttatgctgttttctgtgcttaaaattttgaagaataggaatgcaggaggaagtcagaggcttatatatggctctttagttacccatgtttttctaggtattgacttaatctgcctcaattttcatttttattatcacattgagttgcaggttctaaactgtcagggctttcagagctgaaataggcttttgaagtatcccactgatgcctgtatgggcctagtacataactctcctgtgtacgttcatattcttgtgtgataaaggagagtggatgcttaccactcacagactctttaatttttttactttaacttttttcatttcagtaagtggttgttgagcatcacccttatgccacacacagagtagttgagaaaatggcatcttcatttgtctcccaaaatctcaccatgatttggtatgtgggttttacctgcactctaagagttccctactgcccttatactacctcagggcctatggtggcccagagggattgaaaggatgggtatggaattttgtttgttggctgttcctagtattttaacccatttgtagacattagaatatcatgttattgatagtatcatagataaaatcccaaatgtcccttatcatggaaataagttgtaacaacacttggcatttcatctgttctttttttttttttttttttttttttggtgaatatttattaaaaacctagacaaat

SEQ ID NO: 115881 - DNA, 1406 bp, Homo sapiens
tccctactttgaaactcatgaatttacaagaaggtgtggagttgttcaggtatcttgggatatatatatgcattctaaaatctgtagcagcataactcctttgggaatcatgagacatttttgtctcttacctgttattggataaatttacgttcttctaaaatatttattgggcaggagaatcactggactcataaatattcccactttgcatagacaggtatccttaggaatccaggaaaattttaacattgtgtgtcattgtattctttggttctgctcccccactattgaccaatgtatgagatgggaagaggggggcatttttttcacttttttttttttttgcattcttgttcttggggctatgacacagtatttatcatcattggcaaatgaatgtctttccttcatccccttttaatatctgataattatttgtagatttggcttttttaagaatttctactcttttccttttcctagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacggtgtagtgtaacaaaggtggtataaagttctcaggtttgaaaactttgctctccaacagtccttagtgcttccatgatttatatggtgggtgtaaatatgagaatagagtattccttagtggataaacagacatttctccctgatattctctattgtaagcatatgttaagtgccttttatgaattacctcggtgttatctcctttattcctcaatttgtgaagaactaatagctccattttgtagatgtaacctgaggtttagaacttctaaaaagtaaaagtaatctccagatcccttctttgtaggatattttataaggtgacttggaaaaggtagtgtttagaataggagtggctcctgggtcattgtcttttccttaagtgtcaacactaataaatgaatagggttatgtttttatttaataaaaaatatacagtaaaattgagcatatacagttaaaagaatttataatgtctgccactat

SEQ ID NO: 115882 - DNA, 2208 bp, Homo sapiens
aaaccccgtctctacagaaaatacaaaaattagccaggcaggtgggcgcctgtaatccgagctactcaggatgctaaggcaggagaatcgcttgaaccccaggggcagaggttgcaatgagccgagactgcgcctctgcattccagcctgggtgacagagcaaggctctgtcaaaaaaaaaaaagaagaaaagaaaatgaattcactattgtactctttctacagtgtctttatgcgtgagctttatctttaattgtgtatgagtttcagctgctctaaaggatgctgtttgtttgaagtgtcttccctccaatccactaaagtaaattctaagtaccccatgcactctgtactttgtcagactatcctaaaacattctccaaactgaaaaatctctccagctatttgtacatgagccaataacagacaaacatatctgcattttcatttcatttatgtagtttttctattttggtatagaaagtggggctgatccaacaattgaaactgactctggatataattctatggatctagctgtagccctaggctatagaagtggtaagtatgttagaactcctgtgtctcatcttagtaaagctctgtaaatagtataagccagtactccaaaccatctttatcactgtaatcctaaaacatgttatcccaactcctgacatatacttttaactttgggaaaagtccacaaattcctataaagtctagaaatgagtttgttactatacttttcaccaacccaaataattggttactggaggataagtgcatacctgtttataagatttatttcatattttgatagcaaactatttatagggcaaccttaggataaccttgtattctggactctccttgagtttcaaaaataaagaaacaaagacacaacgtccagtaacttggacagttactcagtgacagactaagtttcaagttttttaaagtattgcattgtattattgccctcaggctatgtatgtatcctgcttagaaataactttattttaggaaaatattggggataagttaaatttgatagttttaaaagaaattttatagtcactgtgctgtaatcttgattacctatctgttctagttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaataaaaaagtgcacagtgtgattgtttacaaaatgatattataaataaataaaatacttcttctgtcagtttgcatactacttttttaagtatataagattattaaagatttctttcagatttttaatttcacccttctgtcctgccgtaacacttcattagatcaaacaatatatgtaattaaaataaactgaatctaagtcaatcaacaaagacattgtcatttctagaagtatatttagaatatttttctcttttaaggaagtttttcagtaggaaaagacctctgtgaagagaagtcaattcttcaatataagtgagatattctgtaatggcacaaagggagcactatgaatccatgtttcacagaagccatgaagaaagagccatgggttagatgttgattggaccactgagtgtaggacttgacttacatcacttcacctggaaaataggatgttttgtcagttatggtacttggttgtaagccacataaacttggtctagctaatataaacagaatggaagggaaagctgaagaagcatgcagtcccaaggaatgaaaggcagctaaggatctcagtcaggaaaccatggccaggcatttcagatgctgttaatatgatgtttagctttaaacccct

SEQ ID NO: 115883 - DNA, 1651 bp, Homo sapiens
tctgagggctatcatataatctcacttttattatgatcctcccaactgtacgttgatgtaagcaaggaattctgtatattgaagaaattaagtgtcttgcccagggtcacatggctggaaagtgacagagccaggattcaaactgtggtctcctgattctgagaccagtgttctcttgactgccttgtacccgacattatgtcatgtctggtagtttatactttaagtaatatgctatctgaacccggctatgtacattgaggcatattttaatacactcagactacaaattacaacaacatgcaataaataggacaccaacataaagtcagcacaaagtgaactttactgagtattataatcagctctttggaatgccagtttttcatagtgatattaagatatggttgttaaattagatcacaaaaattgcttttcttttaaatagaaaatgttatcaatcacacggatgaagaaggatttactcctctgatgtgggctgcagcacacgggcaaatagctgtggtagagttcctacttcagaatgtaaggaaaatgcctcagaaaatgtatatgtatagttacttaagttaagtctttagtagagtttttatatatccagccagctagatataatggtagaggctaccaaaaaaagtttaatgcttttcatattcttgtggaacttggatctagttgggaaggcaagactaatcatacatgcaacagtgagaaataatttaacgcccagacccctctacatcccacgggaacagaagtactgtcagctttgaaggagaaggcttcatggaggagctgtgacttgactccagagtgaaaggataattaggattgatacaggacggaggaaggaaggcatccaggcaatctcaataaaagcatccatgagtaaaagtttccattatttctttattaagcccagaacattaccaggcctagtgttgaactataattattgttgacaggaataacaatattcttgtttaaactaattgagaagtcttttatctctacttcccataccagggtgctgatccccaacttttaggaaaaggtcgagaaagtgcactgtcgttggcctgtagtaaaggctacacagatattgtcaaaatgctgcttgattgtggagttgatgtaaatgaatatgattgggtaagtttgtaatactaaatttaaaatgactctagcaagttttagaatttatttggtttgggagagatgcagtaagttttattaaagaagaaatagactgagcatcgtggtgtacacctgtagtcccagccacttgggaggctgaagcgggaggatagcttgagcccagaagtttgaggctgcagtgagctgtgattgcaccactgtactccagcctgggtgacagagtgagaccctgtttctaaaaaataaataaaagaataaataaagaagaataattaattagctacatagaagaaaaagttaatatcatagactcaattattagttctgatttaagtatccttcacaaaatattaaaattactttaaatgattatatgtctaattctagtaaaacttcttacagcagcattaaattacttgagtcttgctcaccgtgaaaaactctgaatcaccttttcattttgcagaatgga

SEQ ID NO: 115884 - DNA, 1008 bp, Homo sapiens
gtttggattcatacccaggtttctctacctctgaacattatattctttctattatgtgtaggtgctttcaagagcattgttacaatacttgattgaaaatgattattttgtgtgtttttacctaagctgatagaatacttttaattttctaattttttctttcagatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaaggttgaaagttatggtataaatatctgcatttgtttttgtttttgtatatttgggttattttcccaatcatgagattttgagtttgggaagacagtttagaagtcattttttaatatgattttctggaatctcatagaaaccaaaattaaaataatttcagattatataatatctaatttaaaggaagtacatgttgatttttttaaaaacttcttgtttaatatttgtttacaaattccctaatgaagttccctattattccttttaaaatcatagggccaggcacagtggctcatgcctgtaatcccagcactttgggaggccgaggtggacagatcacttgaggtcaggagttcaagaccagcctggccaacatgatgagacctcgtctctactaaaaatacaaaaattagccgggtatggtggcgtccacctgtaatcccagctact

SEQ ID NO: 115885 - DNA, 1932 bp, Homo sapiens
gagtgcaaggtctcgcgaccaccgacgacagcagacagcgagtcgggccttcccatctgaggccagcttcagtacaggcctccaagcccgggcttgttttggccgcgacgtcacttccgatttcttctttcgccttctggctaaaaaacgttccgcagcaatgcagctgaaactttcgggttttcttttttttgtccctctctccttttttttaatatttttgtttttgccgcctttacgctccgaggcccatcctgccggagtactacacagacagggtcatttcagttgacggttctgggtcaccagagcagaggaagccccaatttcgccctccggtcacacctcctactccagatcgccccgcccacctgacccgcctctgcgccgccgggctgcgtgagtctcatgagcgtgctctggtacgtcatcttcgcgcgacgttcggttcgctgtgtgtgtcgccggctccttgagggtccatgtgatttttacgccagtgctgctgaactgtgcagggtagggagctggcacagtccgattaattgtccttgggtcgaggtgtctcgtcggaccctttggggctcagtggaggtaggtgaaggcggctcccattgagggaagcccacactcacacccggccttcctgtgttaatctggcatgctcttctggggcttcccaggctatataggagagtggccaaattctttaaccggctcaagttcccctcaattaagcttcgacctaggttcttctctgcgattacaccctttcctgtccaccgttgttagttcccggagtaatcagcaactctccaaggcaatggacacatttccatctttgcctttgcttacgaggctccctcaggtgaagtgaacctaatggagttttaaaatatttgggagataaaatcagcagatcttgttaactatttggatgttaggagtgaggaagaaaaggacacgtcaaggctgagtctaggttaatatctggtgccagtcaccagccaaaatggagtatattggagtaagcaaaggcacagaccatgtctttatttcattcaccattatagccccagtgcctagagcagtgtcctgcacattggtaggtactttaatgaacagaagagtgttcccaaagaccagtgaaatacaatcattggtcattgtatttcattaaagcaccttttaaatatatgttacacctatttatcgtggtgttactaatgtaaagttttcaggctttttggaatagatgatgagcagcacctctggaatcatttacctgataacattgaatctcttttgcaattgagtcgttctggaaaaatgttttggcttgattgcatgttatttaaaagttttatcctattctgccactttagtgttgaatttaatttcaggactgctttattacagttttctttcctactgtttaaaccttttaaagtaaatttaattttaagcttctacattagaatattagctttgtgtttcttacttcttggcatttttaggctttcaggaaatcaaatccgtaactataattgttatagattaaatgtcatcttaaacttggtttcaggaaacttgtatttgcagtttcaccttaatatttcctgttgccaaaaaatggacactcaaagccagcatgatcctttttggtttggctactgtaaggctgtgctagatttattcctaagtgttgtaaaatggttggctaggtgtgagaacctttgtgtacagctgaatagatggtgcgatatgatagccttcactttaattattcctgcttcctatagattgccttttctgggttagaattaaatggcttattggtctctaatctatatacttccacacagactttttaaagaaagcagagtgaaaatcaactatgtgtacaagcttataatatgtatataaaatatt

SEQ ID NO: 115886 - DNA, 3741 bp, Homo sapiens
caatcaatgccaaatgaattaaattttaaaatttgaatctcatatgtgtaaagatgtttattgaagtattgcttgtaatagtagaaatcttgaaaaacccatgtctattagtagtggactggtatagtaaattacagtgtgcccttataatggatggtaagtctattgctcctatgaaagctaatatgtgttactaagtgaaaagaagcaagatgtggaacagcctacatggtatgattatctttttgttattttaaaagtacaagtacgtggttattgtatgctggtgtagacatgataactttttttttctggtagaaatcacagtaaactcaatagctgaagagacagagtggggtgtggctttctaaccatatgtttatttcagtggcaacaagaatagtctgggtgatgagatatgtaccttttttgctttctttgtaattttatgttaaatacaacttaagaaatgttactaagaacaaagagaaacggtctgtaagaaattatgtaatgcataaataggtcttaccagtggtaactctgttaacacactattattttttattaagacccctgttcagattaaggaatttggtgcagtttcaaaagtagacttttctcctcagcctccatataattatgctgtcacagcttcctcaagagtaagtataatattaaatttctttatttttcttttgtatagtttactactgatcttgagccatctggtgaaatactgtttttcatcttgtagattcacatttatggccgatactcccaagaacctataaaaaccttttctcgatttaaagacacagcatactgtgctacttttcgacaagatggtagattgcttgtggctggcagtgaagatggtggagttcaactttttgatataagtgggagggctcccctcaggcagtttgaaggccatacaaagtaagagacagttggtttctgtgtgttctggttttattttgttgtaagctctttttttctctggactttggttaaaaagatagagatcagttttatggagattatttgcctataggtactatatttcctgattgttctaagagtgcttaacttgggttccgtggtccagtttcatggggcttatgaattccctagaattgtatgtgatattttaggaaatacacgtttatctagggagctactctgtagcttttggttaactttagtggggtctgtggcccagctgagattatgaattactgacctgaagacaaccttacagctggtaatgacagctctataggcctgtactgtcttagaggctcttatgttgaagtcaagtaggaaggtggattttcttcttgaatttatagtgttttgccccttaataaattaagtggccatcacaattttatattataactttgttttcaggattgccaatgtccgtgctgaaatttgttaaaatttaacagaaatttatgtaacatgattctatttagtggtaaatctctttagagttttttaaagaactttttgaaattttaaaaattaaagtgcctttgcttccatattcagcagctaagtggaattgtttatatactagaaaatataattttaaggctatcctttaattttttttaactttacaatataggagtatttacacttcttaattggtttgggggcaaacacttgtaagttttctctttctttcatgatttccccctatgaagactccctgaaactcagctgctttttttttaatctgagaaaaaggagcattttatgttagaaggtatcagaaaaataattttcttgctttttaatatactgaccttcaatctttcagagcagttcatacagtagattttacagctgacaaatatcacgtggtctctggggctgatgattatacagttaaattatgggatattccaaactccaaagaaattttgacatttaaagaacactctgattatgtgaggtgtggatgtgctagcaaacttaatccggatctctttataacaggttggtgaactctattccctcctgaagcaaataatctcacggggatgtactttaatgttgctatgggactcttttgggatggaggggtttaaattttttttataaaggaatatgtttctgattaattcttcagtttttaaattaatttttatgtatgtatgtttgcatttattttcagacagggtctcactctgttgcccaggctggagtgcagtgatgtgaccatagctcactgcatctgctacctcctgggctcaagtgatcctcccacataagcctcccaagtagctgggactacaggtgcccaccaccacgtccagctactttgtgtatttttttgtagagacggttttgccatgttgcccaggctggtctcgaactcctgggctcaagtgatccacctacctcaatttcctcccggaggactgggattacaagtgtgagccaccatgcctggcttccaattgttttttattttcttattcttcttttgttgattgttcatgtcttccaaatgtgtttggaaaaatcaggctgtcttgaaaacataatagactctcagaactgtaatgtatagtaccctgcctcaagcagccaagaaacaaagagtgcagtttagcctttgtgggtgcctttacaaagatttccagatgattcagtagtgacagtagtccaaagaaagaaatattttaagatcagagcaagttagattctgtatagtattatgtagtgcttcttcagacacgatcagtagtagatggtttggaggtcctgtgtcttcatgaatatacatatatgtctttttaaaactccatctaagctttttttccttttaaaatttatatctggatacacacagtttttgttgttttaaacagtcaaactaaaaattcaaaaattgacattttaggatcatatgatcatactgtgaagatgtttgatgcacgaacgagtgagagtgttctctccgttgagcatgggcagccagtggagagtgtcctacttttcccctctggaggtcttctggtgtcagcaggtacttcttaaaaatagctttcaccaatattgttggttttgaatcacgtttgtttaaaatcagttgctctttgtaatttatcagtgtgcatttgaattgcatatctaagtctttgttcaaacagttgataggtaggactggcaagcagttatcatttattgtgtacctaatgtgagccaggcactgtgctgttacatatgaactctaatgccctagatgatgctacaaggtagttagctttttccctactttacagcaatgaaataaaagttttaacttatttttcaaggcaaagtggtaagtggcagatctgaaatcacagaactcgagagctctgtgtatttagccctgtgccatcttatttatttagccctgtgccatcttatttaaccccagaaatttagccctgtgccatcttatttaaccccagaaatttagctcttatgtatttagccctgtgccatcttatttaaccccagaaatttagctcatactccttttactcctacctaagagatctgcagcagcttttgaaaatcagttatttgagatctagtaggcttgtctctttttctgtgactctcttgattgaaatgccactacccagcaaatagctgctagtactagagaaaggagataatgtggcctcaaaaggggccttggtacatttttcaacaagttgggactgagat

SEQ ID NO: 115887 - DNA, 1056 bp, Homo sapiens
agactggtctcgaacttctggcctcgtgtggtctgcccaccacgccctcccaaagtgctgggattacaggtgtgagccactgtgcctggcctgaaaagttttttaaaaattagataaattaattttttttttttttttgagatgacatctcgctctgttgcccaggctggagtgcagtggtgggatctcagctcactgcaacctctgcttcccgggttcaagcgattctgcctcagcttcctgagtggctgggattataggcgcttgccaccttgcccggctaatttttgtatttttagtagagacagagtttcgccgtgatggccaggctggtctggaacttctgacttcaggtgatccactcaccttggcctcccaaagtgctgggattacaggcatgagccaccacgcctgacctaaaagttagatagcacattttatttagcctaatatctaatgtaaaaataaaatatatattacatataaaatataatttcagtatgtaatctatgtcaaaattattaagatactagaaataaattaagcatctaaacatgtgcactatgatacaataatcatattttaggttggtacagtggcttacacctgtaatcccagtgctttgggaggctgaggtgggaggatcacttgaggccaggagtttgagaccagcctagggaatatagtgagaccccatctctacaaaaaattaaaaaaattagctggccacagtggtacacacctttaatcatagctactagggaggctgaggcaggagaagcacttaagccggagtttgaggttgcagtgagctgtgatagtaccactgtactctatcctgggttacagtgataccctgtctctaaaaaaaaaaagataatattttataaaaattactgtctcagtttttaaattaaaattagataaaataaaaaatttagtttctcattttcactagccacatttcaagtggtcagtagccatgtgcagctagaagtatggcacagttctagaatttacatgatttattattaattttttttttttttgagacag

SEQ ID NO: 115888 - DNA, 1026 bp, Homo sapiens
ttctttgttactgctctttctgaaatgtatactgtcaagttttatgagaagccacatttgggcaggaaggcatttgactatattatatagaaatctgatttgggagaggaaaagcttattaaaaatatttttggggggcaagatcataaaagtcttgctactgtgtaatctttgatgccgttaactatgtattatacaaactttgccagtgatattttacaagtataagttctgtcaatgtagttgtatcctaaggaaaaaatgatttcgctttaacgtcttgcaccaatcatcgttaggcagactatgtgtatttgaatggaactgttggtgaatgtatggacaagcagcaaacacatggtaaatgtgttttgaagtaaaagtactataaattacgagttaagaatagactaacttatttttctaattgttattagcatgaagatgagacaatagttgtaggaatgaccaatggaatactgagtgttaaacatcggaaatctgaagcaaagaaggaatcacttcccagaagaagaaggcctgcatatcgaacctttattaaaggaaaaaattacatgaagcaacgggtatttgtgcatttctcatatttgtttaaagggtgaaatttgttagagtagccagcttcatccctgcacattactggaaagcgtagttcacatggcactttattttgcttttctctacatcagaattatttctagattgctagattggggacattattgatgagtaatggggaacaaggactactttatgtaatactctgcatcataacataatgttataatgctttactgcattcaaaataatgtctttcacatactacctgatttgatctaaatcccaagaagtagtagaaccaatcatgtccctgtttggcacctgagaagactgagcgacaaataatttgtgattgattcaggatttcattactggtatccagagttgttgagactagatctcattatctctgattgttgtttgatttctctttctactgtacca

SEQ ID NO: 115889 - DNA, 2651 bp, Homo sapiens
aaatatcttgcttttatcaaatctcaatatggattttcatggagaaaacaacaagtcagtgcagtttaaaaagtagtaaaatgtttatagtggtgtgactttgaattgatgggactagggttattataaaaaatttttttcatagacatctataatgacgatgacaatttttcaaatgggaaaatgaaaataagtcaggaactccaccctatactttctgtaattattattttttgaaattaatttactcagagggattgttatactttctataaatcattaattaattataaaataagtacagatttttcagtgttcttatgtttaatatttttatacttttaaaaacttttgcttttcacttaatgtatggaaagatattgctagttaatgtgttttctttctctctttttagatatatatctgcctgtaattggtcagtcccctgtagttgataaaaagtttttactacttcaaggacttgtagaaaaagagattgattaccaaagagaattgttagaaaccttggggatgatggatatgctttttgccaccatgagaaggaaggaaggcacttctgtgttggaacacacatctgatggatttccagagaataagaagatagaatcatagtgtctgctaaataagacatataagaactctgaagttggaatagatttgactgtattaaatgttggcgagagactctctttgatacattaaaaaaactgtttgcagaagcagttctgtggaagagactggaataattatggccggaaaacaagtacccgttttaagtaagacatggttttccatgtaatattttgaattatagcatcttcacctagaagatctcaattgtcttagtcacagagtaggtttatctgggatggatattaattttaatacaggagtgttctgtatcaacatttgggttggtattcagatgggaattcaaatatgaatcctctctggagagggtccaactgggaatcctgctaaaggagcaaagccttgtattacctctggaagacaacaaaaacaattggcaacaacaaaaagcctctttcttgactttaatcagtgcctttgggatttctaggcccttgcttagcttgcttcctgtctccttgatatctacacttgtcttagatcacatgccctgcttcagctggtaatgggactgcatcggttccaagtgtggcaagtaagttttcggctctgaagaactgacactagctagatttgtattcagagtgtgagagcaagctctacagatagaccttattggactacttttttttttttcttcatgcagcctttctaccaagttttcaccttgtttcaggtcagaggaatgatagaatttgtcatttttcttacaacagcctttcagactattcttcatatgtttcaagctaatcttgtagctaagctacctaatcctctgaaaactgttttctctgatttgtatttagattcctccccccattattcacaatcatattgtatttcggaaccccaatgcagagcagtttgctttgaaaaatagttgtttttaaaagtttaatgtaaataattattttttagaagttttttttttttttttaaagacagggtctcgctttatcgcccaggctggagtacagtgatgcaatctcagtccactgcaacctctgccctcccgggtttaagcagttctcctgcctcagcctcctgagtagctgggattacaggtgtgccccaccacgcctggctaatttttgtagttttagtagagacggggtttcaccttaccgggctggtctaaaactcctgacctcaagtgatctacctgcctctgcctcccgaagtgcttggattacaggtgtgagccactgtgtccagcctgtaactattatttttttataaagagagattcttattttcttggctttttgatgtatctgttcctgatagataatcattggctagtaactcctagtacactggtttcacagttgctacctctcctgcttttctctaattattacgccaactcaagtagttaaaaatcagtaagaaaaatgtcttgagctagaagaacccatagaggaagattttgtaatgcgaatctcctctcataattttagttctgtaaattcagggtttttttttgtttttttgttttttttaagccgaaaaaatgcttaatatgttccagtaagggtattaagtaaaaattaaataaacgtattaagtttaacatattaaattaatttaacatttagactaacattaacatttaaattaatatgttaagtgaatatacttaatatattctagtacaggtatgcttggaaatagggcgtttccttttcatgaattgatttcgtacagcacagtggcttataaggaaccagcagtgtttttccctgagtaattatgaacttagtcaagatcagaagctgggttttggggttgagaagagttcatttatttaaataaagtttctatttaaaaacctttttaaaaagttaacatcataaatattctgataatttgcatagtagtaaaaattagaagttgaaattctacctaaagctgtagttgccgtcaattgtgtaacatgtgacaaaggttttcccatatgtcatttcatttgattctca

SEQ ID NO: 115890 - DNA, 1056 bp, Homo sapiens
ccatcaatacttaaattcaggagtacttttttgtttgtttgttttgttttgtttttagagacaaggtctctttctgttgtccaggctggagtgtagtggtgtgatcatagctcactgcagcttctgtctcctaggctgaagctatcctcccacctcagcctcctgagaagctggggctacagggatgagccaccatgcccagctaattttttattttgattttttgagataagaggtctcaccatgttgcccaggcctgaggcaatctcctggtttcaagcaatcttcccacctcagcctccttaatgactgggattaaaggcatgagccactgcgcccagcaggaatggttattatattcattgagataaactgtagtatttgctgtttgaagtatttaaacataattggcatattacaatatgtgacactggccttaagattctaatttaaaatgcttaacagacttttagacttatgagtttcagttgaaaggtattttaaaatgttactaagtctgcaaaagtactgaaatgtttcagagaacttggaaagtcaccgtatgtttaatttattatgtttatgagatttaagcacttgggaaggtttatgctaatggggtcaagcatttgcaatgctgcttaaaagaatcatttttttaaatgtataaatgctattaagttgtttaaaggaatttgaattgtaaatgggattgttaaaacaaatttagtctgttcaactcaatgagggcatttcattttctaggaacaaaataccctcttagacattaaaaagccgcatgcctgttccctcagctatagttaactggaccatggtggtacaactgactcaacccttctctaagcagggatttgtaattgggatttataatgaaattcctgatctgggaaaatgggaggctgggaatgctatgtctaggtcatcagcggagaaagttggtttgtagagaatgaacaagaatgaaacctaagtgcaaagaaaataaagattatcctgctttaatagttcagactagaggagagagaaaccatctta

SEQ ID NO: 115891 - DNA, 1017 bp, Homo sapiens
gtgtttggtcccaagaatgttggttgctgctgggctcattgtgggtgttgaaggtataatctgatgtctagaggtagtgggggaaactctatcctattcagccttttctaatttctggatgttggtatagcttccatgaatacttggtggagcatgctccccttggtcccagccttctgcagggagggccggaggacagggcccaagttgtctggatggactcttccccagctcagggaagcagcttcttattgaggtagtaagtgacttggtggctttgttctggggtcacccagcaggggccttcttccggatccctgcagattccctgtggcttttgggtcctgtggaaggaaatcctgtcctccagacactgcccttctctcttggtggccctccatcccccagtgggctacctatgactggcctcatgcccatcaactcgaaatattagtctatgagggcatcttggggacctttgcctgggcaccctcactttgctgatgaggagattagtctccaagagggagattgactggcttgactaagttaactcagctggtttgacactctggattttaaaatgctctattagaagtcataagaataattttttttgactcagaaaatttgttagtggcagatcccacaataagcctggggttttccgaccttcactggtaacgaccttccccactgctctgccacatctccatttcctcattgaccaagtactcaaaggcaccattttatcctttcctgtcctgcaactgcctttgagctttctgacatgaatggggctccttcatggaccttaaattaaagggtctctcttttcttttatctcactagaggatgctgctggtaactatgtctaggcaagccctgaccttctgaagctcatttgctcacaagaagccagacctattaattgatggtcatttgctccattcagttcttcccagctcaaaataatagaaattttcattagctcaggtgtcagagggtggtaggtaa

SEQ ID NO: 115892 - DNA, 1048 bp, Homo sapiens
cgtcgtgaatatgtaacaatagcttttccgaaggaagggagggaaagataattaatattcttgaacatccatgacatagcagacactgtgctagctgtttcatcaaccttttatttaattcccattacttacccagtgtgctaagtatgatttcctctctctaaaactcagagaaattataaatgctgtgtccaaagctgcacagctatttaccagatgtcctgggactaccagagtgtaaggactcaataaatgtttgtgctatggatgaatggaatgtgaatgaaatggcctgcagcccaggcaagttttcacattaccatttgtctctcatctcaccatgtgtttcaaaacataaaacgctttgtttatcttttaggaagacccacttttctttgaatgggacatgaaaataatgggtgtggatattcttactcctatttattgttgaacatttggttcctgatttaaacttcaaagtacgactcctatgagagtttaatctccagaaaatccctgatgagaaacaggcagatagatatctattttatgataaatccttattcattcagaatttcagaggcaatgaagatgaaaaaggcaaatgcatacatatctctctctatccatatatattaacaaataaggctaaccatgttttaaagtagccattttttgtgatctgttttaatgaacagattagtatagtactgtagttttttatgttttaatttagaccgtcatcttgaggccttaaaataatttaatatcttaattagccaaagcattccctttcaagaacattagcttgctagccatcctttcttatgtagtatgaagatatattttagtccatattctaatttaataaagttttacattattttcaaagtgtctctgaaagagattaatgtaattgtggttcagtaattattcctgtccctgttctaggttagtctcctctcttatcttctccatagaaaatgggtatcactgttttccatttgaaggaaaagaatttttttttttcctttgtgatggagtcttg

SEQ ID NO: 115893 - DNA, 1041 bp, Homo sapiens
tttcagcaatttcctaatattgctaggtactttaatttcatctaccttttacattattgttgtcacacattgtagttctacagatattttaaactccgtgacattataatattttgtaaaacattttcttatatattacacaaaatatgtaattttataattttgtaaaattgtttgtatatttgatttaattatatttattcacatatttacctactcgctattcctcattctttcctgcatttccatgtttctgtttgagattattttatttcttcttgagtaacttccttcagtatttctttcggtgctggtctgttggcactgaattctctcagtattagtcttaaacattttaatttcagtttcattttaaaagatatttttgttagatatggaattttctttcatccctttacagatattacccaattgtcttttggcttccattacttctctgagtggttctcctctctggtattttgttacatttatgtcctcattgtttccatgactttttatttgccagcccttgttattcctggttgttttcagccggactgttggcctgctgtggtctattttatcctatctggagatggacacctactataaaggctgtttctcaaaaaatgtgttataagtcttttaagttattttagttaaccttcttttaaaaaattggcattctgatatttccccctggatttaaccaatttgtatttacgtgaatgggacaatacatttgaataatcttgatatttcaaattatataaaagtcagacgcttttaaacatgcttcaaatcagatcaggggttcttcagttttttgattcacatgttctttgtgtactcttctcagaatctgtaactgatagacagactccccaaataaatgccccaaactgttgcatacattttccggaggattagggtacatttcccctcaccgtatctatctgtagatttcaggatgggaactacattaagaacataaaggaaagattgagttaaatgaaaagctgtagataagtcactaaa

SEQ ID NO: 115894 - DNA, 1048 bp, Homo sapiens
atacgtgttttaaatgtttccaggtctaataaatccattcatggatgggattagaagtagagtgtaagctaaattctggtgatatgatgatagagcttccatattctaaattaacaacagtgaccttattgctcaggttcagagaccattcatctcagtggcttgttattggcatggggagttgttttctggaaacttctggagtccttgccagtaatgagtgtcaagagtttggagaggtcccccaagacttagagtaaaactgttctttaaggatctctttttgtcactccatctgatggagataacatttccttcattggaaatatactatatttttgtaaagcaaacattcattaacaaaattaggtcatgttaaaagaggaaaggggcatagagctagttctgtgaattgaggaatctgggaacaatctggtgggatgtgacatgctgaggtatgctgtaacccaagaacattaatatttccccttgaggtttctttactgttactattacaggaccttataagccatccagaatattgcgatactaaccatgaagcctgaatgtaatttacaaatgtacaaatgttctcagccaagatataacagaaaataagtgtatattcaagtcttgaatatacatgactctccaaaaaacacataatttgaatcaacacaacatttaggttggaaatgtcgttcctttgtgtgtgagtgtgttcagaaatacaacatgatcaaatttgtgcatgttttaatttgcataagaaagaatttacaacagtggtaccatgtgttatgaatatctcacttatttatgacatccaaacctcaccatgttccctggagatcatatctgttttccacagtaatcacctaataaaccactggctgccagctaatttgttctactacaggtagccccattaaagtgagaggcatcttttcagattaaaaggagaatgaaatgttgaggtaaagtactatgtttaaaattcagtactgtttcattctttatgtaaacctttaaagtatgtagtatatgt

SEQ ID NO: 115895 - DNA, 1060 bp, Homo sapiens
gaggttggagctgagggctatgctggtgttcttgaccttcagtgatgtgtaaggaaaagccagacctcttatataatgaattacgctcttttaaaacatattgaaatctgtggtatttgaggaaatagacatgtgggatttcctcaggtgggtacgagtcacgtccttacaatctgctattttgaagaacttgcggtagtgagcagccttcctttggaatcaagggcatttatttatttaatgataattttttccccttcaggatttcctgtgagagctcctgggcttgtttccatcttagtccacacagataataccagagtatggacagtcgggttattagacactctgctctgtggagagctgatttttaagaggcctaatctaaaaacctatctctgtgcagaaggctcctgggcaactcatttacacttgtcagctagtagttgttgttcttcttaacaaaagctcccatcagcagatcctgataattatttcttttgcagagattaagaattcagtgtccagcagatcagcagctgaaaaggaagatataaaggtaatgaatgactccctgcttctttctttgcacgtctttccataaagtagaaatgaagatttagtggtaataaaaatgtttaaaaaacactaaaaaaaggatgtgccccaagtcactttcagaataatgtgaaattctgttttctttttctttcttttttttttttttttgagatggagcctcgctctgtcacccaggctggagtacagtggcacgatcttggctcactgcaacttctgcctcctgggttcaaatgattctcctgcctcaccctcctgagtagctgggactataggcgcccaccaccacgtctggctaatttttgtatttctagtagagatggggttttgccatgttggccaaggtggtctcgaactcgtgacctcaggtgatctgcccgcctcggtctccccaagtgctgggattacaggcatgagccaccgtgcccagccccattttctttatcaaattcttaatccctattctttataaccaaaccta

SEQ ID NO: 115896 - DNA, 1483 bp, Homo sapiens
ttcagaggaaccaggtgttcctccacccttggcaaggtagaggtatttcctccctctgacctgggaattctcatctgattacaatattctgtttcacaactccctgaggaccccttcctaaatctcctcccaggtactctctatttcttcaaggctaatttggaccccagccctatctcttgagttacttagaggtgaatagagcataatgaagctaatggggtgtttgaagatacaggctgagctatcagcagaggctgagtttgggcacctggatgtctgtgaagacctctggggctgacaagtgagaggcagatgagcacgaaccactccagttggtttcctctggttctgtgaagctgaggcatctcacacacctggaaggcacacatgggcaggacagtcttagaagttgcaaggggtgaggtgttgctgatggtagtgactgagggctcaagctgatgtgaaatcaggaaaagctaaatcaatgctcagagtgagattaatggagaaggtgggtaacccacggggtcaccgtgagcctacacgtgcatggggctccctggaggctgagggagtgtggttggtatgctgtgccaacacacgacagagcagttacaaccattcggaaatcatgctgtgtagagcagagcaaggaggaagcacccttggtgttggttgatggtgttgctagtagcttggccacatgccagaggtggtttccaggatcttgctgcatgtggccctactgaaattggaacagaaatttagacccacactaagcaatatacacgtccttaatatttttgctatttaaggtaagagtaatgatttacttacagaagaggggaagaggaaggcaaaaagagagcaaacatctctgtatagatggctgttgtgggccactgatgtcagggccattgctgttactcacgcacacaggatgtctcagctacaaattgcatcatgctcctgggaatgttagctttgaagaatgtttgctaagatgaattgctgggggagggaggtaggctactaaaagtattaaacactgagacgatcttaatttcaggttttaaaaactcactctagtttcaaacttgtaaacttgtgagcaagaagcatgtgctacggaaattgtagtagtctgacctcgtctgagtgttttgtcagtaacatcattaagtctgtgaaggatttgagaaagataaatgagcacaactttagtccagtgatttatgaaaaggaccatgatgagtgtttgttgtgctagcattttctttttggttcatttaaactttttgaattaataaagtcccctgagtttttgcaaaggaaattataacagattttcaaagaacctgagagagaaggggacagcaagctgtgagcaatagtcagatggtcagacacagtctggaataggaaatgggctctccctggaggccacttcaacactcttttgttatttgttatctgttat

SEQ ID NO: 115897 - DNA, 1849 bp, Homo sapiens
aaatgttgtgccaaggagaaggggagtgaacatcttgcaggaacaagtggacagcctgtgggaaatggagtagatggggagtctcagctgtaaaactggaatcccaattgcaaacaaagatgcataaaccatcactgaatcagcaaagctgcgaatggcttgattagacactatcttgcaaactctacttttaagaggttgaatctgaaaaaataaagctatgtggctttggttagaaattaagatatccagttaaatgttaagttcctccttgaggactgtgaaaccataatgccagtgtctcagggggaattacagaagctcctggaacatgatgctcctgttctttcatcgaataatatgtcaaagtgtgagtgaggttgtgggtgacagaccagatgtggtgacactcatactgaagctgattttcctgcaataatatatcactcatggtctgcattagattaaagaggacatgaaatttatttggccaaagctgaatatcttatgactatttggatggaaaaaatgaagggttggtgaaactgacatgtcaaaacaagaactgtgtgagcatgttttgactttccctatgagggaaggtgatagggagatagagacactccctataggtgataggggacatgaggatagcactggctggcatcctcctttctgcttggagagtctcagtactttgaagctctaggcatgaagcgctgcctcatctactcttccaggtctggctggtagagagtgggcttggcgcaagtgcaagagaagatattaagcatagtatcttgcaaagtaagcctcttggaaaaaaattatgttagtcttctataattatagaaataataaatgttcacaatagaaaaattgggaattttagaaagagtagaaaaagaaatccctataatatccccacccaaaggcagttactattaaatttgggtatatttcctaccagcattttttctcatgcatgcatttcttttttacgtagctgtgatcatgaaaacaagataattcgtgtcctgtgttattcatttgacatattccataagtaagctccattatagaaagtaacttaaaatgatgttgtatgtttgtttttgtttgtttatgttttaataaagcatgtggattacttctataagacgaaagggaaaatgtagatcctatgcacaagtatttatttccctccaaaccccctttttataatatgtattgttgattttatagagtgacctgatcagtacatgtaggggctcaaatcacagctattctttaatacttcgggttacttcattgctattattgtttgttactaatatgtaagatgaggaaaagacaaccttttggtgggtgttgggactgggagggagggcattgaggacagatgaaccaaagctggatatggaaggaaacccaacttcataccaaaaaaaacaaaacaaaacagaaaaaagaaagaaaaaacccgtctagaggccagttgggaaaagaaggaagcagaaacaaacaataggatatgaggttcagatttctttaccaagaagacacagatctttcatgactgtagacaagaccgagagagaaacaaagcctccccaccccgaaagtcccctgaaaggaaaaacattgggaaaagggaactggtaggaaatgactggaagaaccaaagaaacagtcctcctaaacagaatgttaggtggtacgtaatacaggttttcaggatctccatttgtgggcatactgggagagtgcaggcctacatgtgctagtggtgagctggggggaaatggtgcagtcaataagtgctagtttggcaaacaaccagataata

SEQ ID NO: 115898 - DNA, 1043 bp, Homo sapiens
gggggatatatcattgaattctgctgtctgcaattacaatcagccagtaacagtcacctgttgaatatgaatgagatgtaaatagcatcttgaattaatttaaatgcaattatattgataaactacagaaaaaaaacccacttcaattactatagaaaacaaggaggataaatgatccacattcagaagaaacgtgttggtgagcaaggaggtaagctggcctaaaaataaaaagggctgtgcaaacactatttttgacttcactttctagttgtatgttaactgttcatggctagtcagtagaaatcattttattctttagaaaacactgataaatggtaaagcaaatgagtacattggaaagtctcttcttttgatatctgagttattttcacatatgtcagttgggtgtctcacatgtattggttaggtcgttcaatactgtttcagaataattttgacatcaagaatcacttgatatgtaactggtcaacaaggactgcatttggaagaataagattaggatgaatctgtctggaatctcagctaatagaaatactttttatgcagtttttttcatctctctctttgtctatattgccctgaagttcttctgacctgtcactggtagtcacgggaggaacagcctattccagtaacttgctgatgtggggtttatctacctcctagttgagtgactctaaaacttcaataggcatgagaattgcttggcataggggtggtgcttgttgtaaattattgcagattcctgggccaccctcagagagattgattcaacacatctgggatgggaatctcataatctgcatttaaaatgaacagttttccctcaggccccttcctccattctgatgcctctgagaaattctgcccccgattctgctttctctacatttgtagtcttctgaacgctttgtcacatttctgaccaacttaataaaacaagttagggagcccctatagattgtattacttttgttctgtttgtaatttaataagaaacatgtctttctctttcccat

SEQ ID NO: 115899 - DNA, 1120 bp, Homo sapiens
taggcagccccaggacaggccatactagcggcccagcagttaatgattggagtgggccagaatccattactgttccacttcaagggctccaggaatgcctgattttctgtttttttgttttgttttgtttttgttttttttaaataggagattcaatcaagaaatgtattgcttattaatcaacgattgaaaaatacaggaattaggctttacccaaggttctcataattgtcattcaatctttaaaatgcatactttagtataaatcattaggccccaggaaatgttgaaatgtttattcctttatgccttttatccacttgtgcaacttccctcgttctctccttccccagctcatatcatatgctgcctttccagtgacacatagtgtgaacatttgttttctttttgctggtgcaaaaccaggctacaattgccaaagaaggcaatgcataccagaaagcttgacaaccttggagagcttagatagcaccatattttctctaatcataatgaaaataactaatatttatatggtaccctattaatcataactactctttactaagctatagtacatgctttacatctatgatatctgagtcccaaaataactctgcagtacagatattgtctctgttttataggtgaagaaactgaggctgagttttacagttattcccaaagtcataccaggaaacacagggaacagtaaccatggtagaataaagaaggagaagggatgaaagaatgacatatgaataatgtggtttttgcacatgttgtcttgtagaagacctgtatgttagatgtgattgtcatcttcatttattagttggggtctccaaggctcagagaggagaaatgagttgccacaaattagagctaataaatggcagagccaggccaagaaccaggacactcgagagtgtccttcctggtatgtttcaccacctcttagtagcggtaagggatggtaaacttcaatgggtagctaccttgggttcaaaaggtgccattgtgcctccccatcttagcttctccctctcctctgtgtatctttactaggaggagaagtgacagggagagactctggaggagcaagatggtagggttgttt

SEQ ID NO: 115900 - DNA, 1035 bp, Homo sapiens
tggatagattggagtgaaaaccgttagctggaagaaaccagcctgtagtaggaggaaatactgcaaacatgtaaagagaagtagatgagtgagagggtcctgcctgtgttctgggcccttgttgttgcccaggttcctgcctctcaaggcttggatgcttaattcttttagttttgtgagccaccctcacatgccttccatacatctccctccctccctcttttatttttgttttagcaaagtcaggtaaatatttctcccacttttaactattaatctccaacttgctgtttaagatgcagcttgagtgtactttttaccaggaggcattctctgaattcccttggggttcagcattgtatctcctgtgtcactctgccttgcgtacgtttttaggaaaggccctctcgttactgtatcacagctgttattaaacctctataccctaagacactgaattccttgaaggcggccagcccattatcacatctccagcacttggatcccagaaagtaggcagtgaatattgaaagtgcctcgtggcacaaatttacccacactacacccagatagtctttatctacaattgatctgatcatcttcatggggtcccactctataggcagtggggcaggggaggggaaaggatatattttagcctaatatagaaaacttggtctgatacaataatgtaaatagtcatttttggtgactgatgggtatctttacgtaaaatattcagtgtctcaaatttcttccctctcctactcttccttgtcaagctgttgttgaatgtgatttcctggtgacagtggaggttaatggggggtggaggtggagggatggaaagtcccaatccttcaatctacactgcacctcctgggtcctcctaggttctgctgtggcttgactggcctaggctcttccctgaggtatgagtgctttattactgggtgttctggcatctgtgataaaggtcagcagctgggattgtggtgctagtcaggacctggtgattctccttctggcttcacc

SEQ ID NO: 115901 - DNA, 1034 bp, Homo sapiens
aggtgatgaagtctacgctaactgtatggtgattgatcaggtaaggcccaactgacattacaggatgatttctacctctctccaaaacctgggtttgtaagaaatagattcagcattgttgtgttcctttgacaattttagcctaagagcagcaaagaggatgctgttgtggggtctcattgtatgagcatttaagcatttaacttaggtgcttacttcagaacacaagacaccttactcaacccagaggcactgtcagggaggggtcttgagatactgccaaatgggaagagtgtgagagctcttcttcggggcccaagtaggaaatgacaactgtgcaaccaatgtctcctctacagcttttcaaaaaacagtatgtatatgacctgattatgcaatatttgtattcaaatccagcaaatgtaatgagcaggtgcttggtcccagcaccataggaaactgtcacataaattacttgcttaatcgatacaacgcatctattaacatgtagtaagattgtagagctttcatattaatacagaatggtatcatattataaagaagctggaatcctttggaactttccacccagtccctgatagagacttttgagttaaatctcacagaagcagatggtttgaatgtgctggcatcttcttgtcttttgttcttttctctagctcagtgatcttcaaattttagtatttataaaaattatagatctgaagatttctacacactaatatatggaggatttaagggattttcaagggtagttttgatgacacaaagtctgccttataaactgactttaaaacttaatccctatataagatccaccctatctactcactgagcagtaagacatttaacccttttatgttgttagtatgcatgtattttaccctatttatagatatattctgtgatctaaactttttttttttccatctagagctcaatttcagcccttcagtagcacatctctgcattttccttttgtgttacaaagcactgttatatcaaatgcagca

SEQ ID NO: 115902 - DNA, 1046 bp, Homo sapiens
aggttgtagtgaaccaagattgtgtcactgcactccagcctaggcaacaagaacaaaactgtctcaaaaaaaaaaaaaaaaaaaaaaaagaaagaaagaaagaaaatgaaagaaagaaatggcttttgctaggtaggaatgttcattcggggtaacataaaattttgtttaaaaagagatttggagggaggagaaaaaggctaattaaatactagttggaaattaaatgaatacctattgcaccccccccgccccagtgaaagaatctggattcagagaagtagaaaccaatgacgctctgtgtccttccttgcttctttacttacttgctggctttgtgctttagttctagccttgatgccttggacgccgacagtgaaggggaagggcattctgagccatcccacatctgttacactccagggtctcagagctcctcaagaactgggattcctagtggggatgaattggactcttttgagactaacactgaaccggattttaatatctccagggctgaatcccttcctctatcaagtaatctacagtcgaaggtattcttattgctattaatttggtatattgcaagtgtggagaatatgttgtctgcatttacccatctgtatctgaaagacatattatattttattcatacatatgaactatttttttgagacccatgtgatatctgattgagtctgtctttttaatctttcccactctgttttaatttttataatctttactcaaaatggctgatttacattttcattaattcaccatgagtacataccatctttctttcacatacttggaaaattttatcattttacaatgatttctcccatcatctcttaagcaaagggagaaaaaccgatagtattaaatgagtttaagtgatcaaacttgttttgctcacgtaaataattgtatggccctgatgatgaggtaaatgatgttaataaggtagaagtgatatttattgagcatttctggctgcttgaactaatccggaatatcacagattttgtcaacttttccatagg

SEQ ID NO: 115903 - DNA, 1056 bp, Homo sapiens
gctgcatctgaagacaaaaagcaaggatgccaaagataaagagaagctgaatcgacatcagtttgccccaggaacattctctggggttctgcagtgtttggtttgtgataaaacactcctggggaaagagtcactgcagtgttctagtaagttctcaggtctatgtgcgctgtctttgttttcatctcctgacagtaaccttgggaagaggctcattgctcaatacatttacataaaccttttcagtgccacacatatgactgaaccgtttaccaagcaaggactgatactggttagagtcagtgtgttttgtccataactgatagcctgtctgaaccccagatttgtatgcctgtctccactgggatgtctaaagagcgtctcagatgttacatctccccattctgtgctcacctaaaagctgatgctctcggcctttaatggcaacttgatcattccaaccagatgttcatgccaaaacttttggagtacatctttatacctcccattttctcacatcccacatccaatccatcaacaatcctcttggctctattttcagaaaacatataaaaccaggcacttgtcacccctaccactgatatcattctggtctaaagccaccatttctacagcattccaactgacttccttgtgcttttacccctaaagtctgttctcaaagcattagccagagtgagctggtaaaggcatatatcactgcgttcaaaaaaatctcccaatggcttcctatacctcaagtatagactgaagtccttaagtgcttacaatgacagcaagttcccatgtgatctgtcctccccctcccttactccctctgctccagtcacactggcatctttgctgtttttcgaacatggcagtcatgctcctgccttagggccttctctggctgttccttctgattgcaacactctttcctcagatacccacacggatcactcagacaacagcttctcaggcagcctttcctgatctcccagtgcctggctcatccttgccctcctcctggcattttttcccattataatattt

SEQ ID NO: 115904 - DNA, 1086 bp, Homo sapiens
aacacatagtattgtgtaagtattcaaaattcttgggtaattttcttcttgttaaagcctgagttgctaattttccacaaaattatatttctataaaattacccttgcttataaataagtttcttggctattatgttgatgttacattatctgttacacataaatttatatatcataccttcattgcagatttaaccttaatcaacataaaattatccttttaacttcattagatgccttttgcatttagttttactttgtctaaacttaatactcctcctgctttccatttgtttgtatttctttcaactatttttgtgttttcgatttgaggtgcatgtctttaatttagctagaagtaatctgtaatgtagctgaaggatgttgttttataacagggtttttaacattttacatttaattttactgctaccaacatatcttttataggtccttgctcttttccttgatgtctagtttagctatttagaccatgtgttgtttgcttttgtcttctccagggatttggcaagatactctcttttaatgtcaactaatagtagctttaaggctgtggaaggctaataatttaatatctttttatttcccttatgtttactctcccccggcccagcctctgttaatacactgaattaattattattcttttcctaagattattatgtttaatctttcaagtataattttctatttcaaaaaaaagttgacacttttattcagctctatctctacctacagttttttagatgtggttctttgtttagcttgttttactgctcacttttgtttctttaaaaaaaaaaaaaactacagtgaatccttcttgaactcctaattttgattctgtcctcaaaaggctaaaataggagtgatctgttgatctgaaacttcatgtaccaagggacctatttttttttttcacacaagaaaaacaacttagttaaataaattcttggaccaaagtcttttcccttcattgctttgccaacattgctgcaacagatgtgagcatttattattaaagtggaaaagtctagggccaacctgaccctattcctttgttga

SEQ ID NO: 115905 - DNA, 1019 bp, Homo sapiens
ggactgagaaaggaaccttatttacagaaaagacaatggaagctgagaaagttgttaagtcacttgctggaggccacagtcactaagtggcatggtcaggactgagacctgcatctgccccactcatcaacctgggttttctcttggaggtcttactgcttgctaattagcaacatctttttcgtggactttcacattagtggttgtattcatgttagtgataatcttctatggtaaatactatttcatagaaatactcactaaccaagaccaacaaatttgtgcgtatttggaggagaagctgcatatctatgctgaacttggagaactgagcggatttgaggacgtccatctagagccccacctccttattaaacctgacccaggcgagcctccccaggcagcctcattactggcagcagcactgaaagaaggtaaactgctgtgagaagggtttgggtcgacacgttcagaaaatgtttattgaacacctgctaagtgccatgcactgtggtcttggtgctgaggatacagcagaacaagacaaggtccttactcggctggaacttatatttctagaaatagccaaatataaagaaagaaatatgtcaggttgtatcaagtgctatgaagaaaaataagcaggataagggagagagagggtgatggagttgggatcgctctgttttagatagggtggccagggaaggcctctttgatataatgatatgtaagtggacatgaaggaagaaagctaagtggtatcttgagggagagtcttccaggcgtagggaatggccggcacaaaggtcctggtgcatggaagtgccaggctcgcctgaggagcaggcagggggacagcacaggctgagggaagggagggtggggtgagcagtgcaggcgatgagtccagggttcactaggtctcaggttgcatggcgggagagaaggacttggaatttcatcctgagtgggatgggaagcattagagaattttgagtggaggagggacttgactt

SEQ ID NO: 115906 - DNA, 1056 bp, Homo sapiens
cccttgattaattaagatatatagatgcagtatagctttttaattctatacttcttttttttttcttttttaaacatcagcaccactaattatcttcctctctcaagttctgctttatctaatcctgagtttctagtttcagaatgcgcacgtatgtttttcattttgacacagcccagattcatcaggggagttgtactgccctgggtgatttccttttaaaagaagaacctcattatgccattgaggagtctctgtctaaaaatacgtgcagggatctgctgagggatctgctgctctcagcctcgccccagggacagctggagaggctcccctctgcagctgcccgagcccgcggtcgtgccttccctcccttcaggccaggcagtgaaggtctccttgtctgtatccacatctctcatgactggggagagtttcaaagggacacccgtggcatttgccagaaccattgagaggctctttagaggggtctgatgtcgggattcaggtagaggaagtaccgaagctggctggtggggtcctgtaccccaaggcctcttcagttctgggtcagactggaacatggtgctatgagagtttgattctctttataaagttgttcaaggcacaaggctagttctaaatgaaggtctacaactgtgactgaatgggtcggttctgcaaatgacttggagaactgggctcttcttcatcaggcttatgtcagcctgaggttataagccaagcagacagctctattttcagtcttcagtatacatgatgagtatcttctacttctaggaaagttctgttcactggagaccctctggcccaccctgaaattggatacagggacagggacctgatctgtgttttattcttctgccttgtcatcagcttctttcccatttgattttcctaatttctatgagggagtgagaaacagagtggtgaattctttagtgatgcctttggccactctttaagagttaggaatagcacccaatagtagaaccatttttcaaatgacagagaaacctataaaatgtccctcat

SEQ ID NO: 115907 - DNA, 1013 bp, Homo sapiens
aaaaactctcctgtgtatatgtgtgtctgtgctctctgacttctggtctttctgccctgcaaacctttgcttctcacccactatgtctggcagctctggcacccgggggcccttttgcaaccagatggcgccaaagtaattgaaacaccttttactttggaatattcttgcttctttcaccttccttgaccctcctctccttgcagagttgatttcctgtcaccacccacatttcacctactttttttgtggttaatttttaattaatctgaccagtttttgcttggggcacagcgattcccaaagggaatcctcttttttgacttactgctatagacatagatattaactctctctttaagaattaaatacataaaacttcctattaatgtctactgaaagtgagatgtcagaaatagggaaggaataaaatatgattctgggaggtggctagttggcctcttcctgcttgtcagggctccagagtttagctttatctaaaattgaattaggtacattaataggtgccaatatgtgtcaatgtgaaaaaatggcaaatgtcagatcttctcacatatacaacatattttacatattatatactttttgtgtatattacataagactgagaaatcaagtcaaggacttttaaaatccagagaaaagacagctgtgactgagtgttcttttttaaacttcagaggccaaaatgagcataggaatgtaatattttactccttctgattgtaagctttctaatgtattgcttcttaaaatgttcctgcttttcatcacttttaagtgtgaagtttgtggtgtccaactgtgttaatagaaaagagagagtgaattggacagtaataatttaatcttgaacgcaaagttgggtggctcctacccctaaagtctccctcttccactccaattcagctacaggtagataattgaggttaagtgtctgggttcttctttggattaagctatctgcaaaattttttgcttaataaggcatt

SEQ ID NO: 115908 - DNA, 1021 bp, Homo sapiens
gtggcagaacaactccattaaaaacgcgaaatttcctgtcttgtgtcaaacctagtggcttttgggcataagtaaccgcgggtagcacagtccaactcatttctatggttctaatttttatagactataaaaactctgtgccatatggtcttactacagaagcagtggagtgtggatgggccacgacagagccagaagagcagcgagaacgccaaccatccctctagggcgggggttcttagagcctgttctctcccatagggtttggcacagatctaatgtctttaagcttcatctccattttcagcctctgtcttttctctatcagaggggctgcttacgagtgaaatctttaattggcagtccaagggaagcggaggtctggctagctcatcctggcatcatcagcctaaactaattgaatttaacaagttcaaaattacccgaggacatgaccatggctggctgctttttatggcttaaaattagatgagacagtaggcccttgaggacagggcatctgatggtctcccatagcgtaaggtgtgaagtttacagtgggtgatcgatatttatttattgaatggcgtgccatcgagttcaactgggagtcattcacttgttgagtgtccgtgctatgtcaagcatcattcttataatatggagcacatggacaaagtctcgctactcactggtttgcatcctagggagagaaggccgacaataaatgaataaacaagtgttcaattatggaggctgcaaaccatcactatccacgtgtgcccttaatgtgtgctgtggaagagacaaagaacaaggcatagaccctctccctaaagaacagacggtctcctgtggctggttcgtggcctctgctgctagtacttctactatggcagtcactggtctggtgatctctgactgtggtgggatctagagcagcccagctacgcgcgccactatggccaccgtctgagtctggtttcttttcccaactgctgtatatgttgatatcgtgaat

SEQ ID NO: 115909 - DNA, 1055 bp, Homo sapiens
agcattagattcttataggagcgtgaaccctattgtgaactgtgcatgcaatctagggatctaggttgccccctccttatgagaatctaatgcttgatgatctgaggtggtacgctttcatcctgaaaccattctcaccacatcccagcccatccattaaaaaaaaaaaaaaaactgtcttccacaaaacaggtccctgatgtcaaaaaggttggagaccactaccttagaccatgcaaagaaagaggctcagtgtgtccgatggcttaatttactcattaaaatgtatctcgaaaggatatacatgcaatgtttggattgttgaaaaatttgtagaaaaatttgagaatacaagtaaatgaaagaaaatgatttctgattctacaaagagaattaaaattatcatgttggtgtataaggctccagattttagaattgttctctgtgcactcttctgtaacatgtaactttctctgtcatcaactattattctattgcatactttttaatgattatatattaaattcaactctgtggggtttattcaatcccttattgtttacacttttgtattattaacaacactgtagaggacatccttgtgtactcatctctttgaatacatctgactatttccttagggtaaatgagaagaattattttgtttaggttttcaatagactttgccaaaataatcaaatcaaccaccattctctctttttcttccatttgaagatggattagggtatctgattattttatttgtacttctttgattactactgagacaaaacatttttccctcactggtttattattcattcatgcttcatatcttgttgaatttaaaagaaaataaaatgaagcctaagttttcagcagaaaatataaaggcatgctgcattcgatgttttgttatttagacttcgactctatcaagacttctttctcttatgaccttttattcttgctctaggaccaacatctgaattgttaaagccttggattacatttgagtatatgacagtgctcatcttatttatttttctatgcat

SEQ ID NO: 115910 - DNA, 1001 bp, Homo sapiens
ttgatgttcttagcaatcaatgtatcatgtaagacaactaatctttcttttaaatgtcagctgggaagggatacagtttgagcaccagccattaacttgggggatgaaaacattgagcatcctggctagtgttgccggatgaaaacactcacaaggtcatgtgtcttcttttcaaccctgaatgcagccctgtgtagattcaaggttcggaaaagctggatcacctgaatgacctaatttttgcaacacattaggttaaaccaacatgggaaatatcaaagtctacagtgaattattttaatctgagctggtccaaggccatgggctttgaaagatttctgttcatggcacagtcgtcttttttgaagctgaatgtcttatatgtgactgaagtttttacataaacaattttgaatcaggtggaatgaaatttgatccctatatcaggaaaatagagttagaaatgaggcatagacagggctaaaaggaaaagacacagatattctagcaaagtaaagttaagagagtgaattgggaatttccctaaacttgaaaagcaagtgctgttctctgtcctaaatataaatgtaaactttaagtgtgaagattattcatttagctttaaatgaatatttaaatttagatgaatatccgatcttcagattccagctctatgcaagggaaaagaatggccttatcccaaatgttagatagacatgaagaatacctcacagaagcacttaattactgtagctgtaactcttacgtgagagttattgtctgtggtagttttgacatataaagtatgggatttttgtttgtcttaccatactggtccctaaagatttattagaattaagtggtgatgtatagtctacaattttctttagccagatcaacagagtcctgagtggcttattgtgtgctaattatttcatatttaaagatcatagtaattaatacctattctggatgataatcattgttttatttataacaac

SEQ ID NO: 115911 - DNA, 1050 bp, Homo sapiens
acttctttaatatattatcttacaactttactacaatagagagcagattgcagaattctttttctaagcacatgttgctttgctgtgttggttcattaatctgctatttacagtgcttcatgtggttttgtcagcatggttttacatactggctttggtataattccgaaactcagtttgagttaaaccacattcagcttttgtttaaaagaagcatgtctcttactttttgtgtatctcccatctttttctattgacttgtgcttcaaagtaaaactttttaaaccatttggcagcatacttgcagtagatagaaaatgtactaaggaaataaacagtgattatatacaaaaccagtctatccacatgtaaggaattagagccaaaggaaatgctgagaaatgtacttacgcttaagaaattgtatgtccagagtaggccaaggacgctcaggacattgacaggagagaagaaagtcaactgtggcttaaatctctcaggaacatcctggtttatataagtagggattacatcagaaatgctgtgtgtactgttcaccactggagttttgcagctagtcaaaaaaccttatttatgtttacttcatgataagcaatttctacaggggagaaaagaaagtcagagaataggcggtgataagaaagtggattgagaataggatatatacacttaaaagagtggtcaaggctagataaaattattcaaaccctccagagctttcacagcttttatcattgacagtaacacaacatcagccactggtgatggccttagctaggctccgtgggcgcttgccacacatgatcttgggggacagtgactgcggggggccggacaggaagaagcaggctccagggtgtgctgggtggtaacagctgatgtgccagaaccaaggaccaggcagtgttgttgtcccctcttctgtgttttgctgctgaatctgggtgagtggccatcagtgaccactactgaggatctccatagttcactgtaatctggctaacataatttgcctataatgttgtgggc

SEQ ID NO: 115912 - DNA, 1058 bp, Homo sapiens
tcaggggtcgcctgccaacaaagtgaaagtgtttcctaaacgttgttagaaagccaatagtttaaaatataaaataattagctgtaaattgggaaatttttcactcagattggaaatacattagaataaaaagggtaactatctttccatatcaatctcagaggaggtgtttgtcagtggatcaccagaattgttttggggatgaagctctgatagcacagcgttttgcttcttccttttgttcctctgtctactggaacaagttacgtaagtcaaccacatttttagaaccagatataaacacccaaatgtcagatactctgacaacatgactgaacatcacctccatttgggatggaaagcttcctatctacagaccatccaacacttgttggttacattatgcaaatatacccccaggaagacttctaattgtactttggtttctggagtgggctctcctactagaaagaaaatgtcaaaagcagcctacaggaatattctagtgtaaactatttgtcattttaagtctaaagattctgttctagtttatcaccttaatctctttttgagtttggttatcctgaatcaatttgtacttgttagttctggagaaactgataaaagtcatggttcagcatcgccagaaagcatctcttgttagcacttataatttgaattatatggggtaataatttatgtaatgtctgtcccactagagaggaagcttcatgtgggtagagcattacatatttctctcttgttaactgctctatcaccagcagcaagtagtgtttgatatatgatgaagatttgataaacatttatgaaatgaatggaggagtccaggtccacactcattagcagaaatgaaagcaaccatgagctgaagccacacagttgactcttttactgaggcactgaaagaagttgaggtatcagagaaatggggtgtgtgatggtggttatcacaggcaggatagatgagtgtctccggctagctaactggatcaagtgtttgttttaaactttttgtaatatggtgcatgttagatagc

SEQ ID NO: 115913 - DNA, 1044 bp, Homo sapiens
cctgaatactgtgaatatcaatttctcaaaccagaataggtatgtaagttctttgacatctcataattttgtagttgataaagaggaaaaaacaatcatttgtagaccttagaagtacccccagcacttcgggaggccgaggccagcagctcatttgaggtcaggctttcgagagcctgaccaacatggtaaaaccccgtctctactaaaaatacaaaaattagccaggcatggtggcaggtgcctttaatcccagctacgtgggaggctgaggcaggagaatggcttgaacccgggaggtggaggttgcagtgagctgagatcgcgccactgcactccagcctgggtgacatagtcctactctttctcaaaaaacaacaacagcaaaaaaattaaaaattaaaaagaattggttgccaatttttaagaagtctggtaataacataattattaagaagcaggtagaactaattagcttgggtgtgttaggtttaattgcttgccttcttctctggctcaaagaaaaacattgcatcttgtatgcttaagaattttaacagctgtttttccctctactgaaccagtaagaagtaaatgcagcattaaaattcctaggttgatttcctgccttactcagctggcagagaaatgaatttgatttttcttctctcagcaaaatgagaggcataactcttttagtgtgggtagggttgtgaggcaggccgctccccagaaagttggcttttttgccaaggtacttagaagtccctggtctctagagccttaagaggaattcagagtcatgagaatactaccccattcttgaggttgatgacctgtatgtcatttaattcagcgcgctcagaaaaagttctgacttctttttatttatttatttatttattttgagacggagtctcgctctgtcacccatgctggagtgtagcggtgtgatctcagctcactgcaagatccgcctcccaggttcatgccattctcctgcctcagcctcctgagaaaagttcctacttcttaacagagact

SEQ ID NO: 115914 - DNA, 1032 bp, Homo sapiens
aaaatagctactatttattgattcataaccctgtaggagccactgtgccaaatgcttttgtagacaactcatttgtcatccgtacattattattatcctcaatgtacaaaagaaaattcacaagctcaaacagtttagacaacctgctcaaggccacatataagtggcagagcaggaattcaaagccacatctccatgctgcgaatcctatgctatcaatcactccacaatatggttcttaccccttcagtgagtgctatggtctgagtgtttgtgtccccctcaacctcatacgttgaaacctaattacccatgcaatagcattaagcgtattaagaggtggagcttttaggaggtgacatggtcatgagagtgcagcctcatgaatgagattagtgcctttgtgtaaagctcaagggagcttgtttgtctcttctaccatgtgaagagatagcaagaagataggaacaggccctcaccagacattcaatctgctgatgccttgatcttggacttcccagcctctagaactgtaagcaacaaatgcctgttgtttacaagccacccactttatgatattttgttatagcagcccaaacagactaagagactggaaattcctgaaggcagaggcagaatcctgcctttctttgcatcctcctcacatcacaactcaatgtcctgcatatggtgaatactcaattattgtgttatttggttgaatggttgagtctttttctttccaggcccacattctaggcatgaatcatccatcattcctgtgtggcatatcctgtcatctacatcataggaagagatctaagattttgttgaaccaacactatgtaccctctccccactatattacaagagctatttgggccacaaaagaaataaattacatagccctttggcttaaggaacttcttttccatatctgagggataaaatataaacaactgaaataaattgtgatgaatcaaaatgccccaaaacacctacctagaaagcaaaggcctgaaccgaatcttc

SEQ ID NO: 115915 - DNA, 1016 bp, Homo sapiens
cttacttttgtaatcaaaataaactaaatattttttaaaaatactctttaaagtagagaaaatattaagaggcaattaggagattatctcagttggaagtgtttttctctaggcatagcatgtacaattgaaatggatcttgtggattctatcaccaatggataagtagacacacataatgctaacattgtatgtttgctgtgtgtcaaacactttactcagtatttcatttaatggttataatgattccagaggtaggcattattttcttccccatttatagatgaggaaactaaggcgcagatgtaggaagtacatggtcccatgctggtatatgaagagccaggttttggacctactaagtttaattctaaggagacacccttaatcattatattatagtctcttaccacatttgtatgtgtttgcatatgttcttagctaattctttaaaataattgtgcttatatctatacatatatttgtttagtgaagaatatgcataggctcttgaacaagttataaagtgaggacaagaatagaggtcagtagggcatctctctgagaactgtgataatatataccagaggtggctacacaactacctgattcggaatcctcatctctttttctttcctctgtacttttccataccaataaatagtctcccacccttggcacaggggagcactgggcttctgagtgcattcagaaaacaagcaacacttacacctgtttagcctcatgtttcctaacagctttagaagtacaatatggccctaggtctttgtttcagtacagtaggtggagggggcttcttgccagccagaaagcgttaaaagttcatggcagctgcctagaaaccactgcaatgtttcccataagagatgaataagctagtttagactcccatgtatttccaggaatgtaggagtgttcgatctattgttctttccattctattgtttcagagctctaattaaataatgccacatataagattccccaacgcccta

SEQ ID NO: 115916 - DNA, 1048 bp, Homo sapiens
gaaatttcttgagaagaaaggattgaccacaattatcatgagatatacttgtggtaataatctatcacatgtaggatgcatcctatgggctgcctcagattctcctggcttcacctgtcccctgggccagcagctgagaggaaggattctatgtagaacctcatggttccccctgtgttgtcttcagctcttccctcacttctgatctcataaaaggccacttcttatggtacagggtctgcttcccccagaggtctgctgccaaaaggggccaggtgaccaacccagaactacaagaggattaacttccatggggttcattttggtaaatgggaatgaggagacaagagggaatcggcaggctttctctccatttgtccctctgatgcattgttctgaggtatggttttccatacaagcttgtccagagacatcctgcacctatcaaacaactggctttgtcactttgtgccttattgtgacacagtggccaaagccatcactcacacatccttgcattggcttcttgtttccattctttacttcccttcctctctgatatggtcacactttgtgtccccacccaaatcttttcttgaattgtaatccccaggtattgagggagggacctggtgggaggtggttggatcataggagcagtttcccccatgctgttcttgtgatagggagtgagttctcataacagctgatggttttataaggggctcttctccctttgctcactctctctcctgttgccacgtaagacagccctgcttcctcttccaccatgattgtaagtttcctgaggcctccccagccacacagaactgtgagtcagttaaatctcttttgagtcaattaaacctcttttctttgtcaattacccagtctcaggcagttctttatagcagtgtgaaaaaagactaacacactcttactcttgctttcctgtgataatacttcctacaaagcactcaacttttgcttaggcttgtccctctccttcccccagggaatccctgttaaaatatatcctgaaatttcc

SEQ ID NO: 115917 - DNA, 1036 bp, Homo sapiens
attccttaaagtaaaaggttgagatcattgtcatcggcaccagcatcgccaatctgtgtgagatgtttatgcttttttagttcagttaatcccttggaaagtgtgaccaaatgctttttatactgtgcttccatctggttttaaaatgcctacatcttttgaaggaagacactccagcagtggggctataccaaaacctcaaccttgttcaaaggcatatcagtatcattctctaaagtttttgataaattatcatcatcaaaattgatttttaacaccatgtttacatggagctctgtgctatataatagtcaaattagcagggagttatatttctaaaaacttaagacttgagatagcactcactaggatggacattagagaaatatgcactaccagccaaaccatgtttagtcaaatataaacaaagcaagcatctacagaaaacattaatatcatgaacagggaaaagggtcatacatgatgtggtataaggagcagtggtggctattgcaagcttaaatggaacaacggttataacatacacaaaacacacaccacacacaccacacacacacacacaacacacactttcctggttttggcactacatggagatcttccttatgggtgggttaaaaggctgctcatgttttctacacctttgcccaccaggttggatctcaggaatgcatttctccctttttgttttaaagttcaatcagaaagaacctctttccaaccaatgagtatttaaagaactcctcccacgagcttgcaaatggtaccgggacagaggatgctgatttttgcaaagataatcatcataagccttcgagttagagaaacagagagctaccttatcccagagtgacagacaatattttgcagaagatattagaggaaagcaggatcttccatagaaatcaattcataaagacatcatcttcgaaacctgcatttgggcaaattataagccaaaaagtaaaatttaataatgaatacattgaagcaagcagcagacacctaaacatgg

SEQ ID NO: 115918 - DNA, 1051 bp, Homo sapiens
gctgtctgtcctgccctgctttagttgttatattattgatcactacctgacatgcatccagttgaaatttgttcatttgattgttgtcagcatttttattatgtgagcagggattttattttcttcttcttttttttttttttttgagacaggtctcactgtgtaccccaggctggagtgctgtggtgtaaccatagctcactgcaggcttgaactctttgcttcagcctcctgagtcattgggactacaggtggatgccaccatgcctgcataattcttaaactttttgtagagatgtgggtctcactgtgtggcccaggctggtcttgaactcctggcctcaagccatcctcctgccttggcctcccaaagtactgtgattacaagtgtgagccactgcacctggcctatgaacagggacttttgttcactacagtatccccagtgcctaagacaactctgagcatatagctggagctcactaaatattgaatggatgaatgaattcctggttctaatgccctgtatcctcagctggaacttgccccataaggctttaggtggtgatggggatgccaataaaaagaaactattgagatggtcaaggctttttagagaagaagtgaacgtaggagaagtattatttaaaaactaaaggaaaagaaaataagcagaaagtgatcctggatagcactcacccattcattcactgaaccgaagccaggccagatctgttctctgcagttgctgaaatctggttcttgtcacaaactgacctagacatctattttgatacacatattatatgtctcttggcatgcagagtactcatatcatttactagatttattgaaatgatggaaagtggtgtgaaatgcctcctgccatatgggaaaagaggtgaaaatgctgacatttggcttttagccaatttcacaaaagtttagagtttcagactttttttctcctcctgggtgtggtgactctgtcttatcaaacttctattctctgagtagccataaagacacgtctgtgcatctggtggtattt

SEQ ID NO: 115919 - DNA, 1014 bp, Homo sapiens
gtcaccaatattggtttgctgaagatagagtttaatagagaagagtagggaaggatgggtcattttggaaaagttggctgggagcctaaggagtgggtctttgtgcagcgttggcatctgtctgagatagcataggtttggtcaagtaattcctttggcatctctttctttagatctagtaccactggggaaagaaatatggaaaggagatccaggccatgctgtgaaatgaagttctcttcacttttttggctactaactgaaaactacatccaggtaccatttagctgtacttgcacagctgactcaggcctccaactcacacattcctgtccagtgcacagtttcccaacctatcattcccatttcaaggataagtgatctacatacttggctgaagttattttcaccaagcttacaaatagtgcccacccttttacccagaaaccacaatcaaaccaaagcaaaccagaaggatcgaaaggcaaacatactggtggaaaaagtagtgatgccctccttaaatagcctttttgaacctcttcagtttataaatagcaactaatttaactccataaaaataaactggctctgggtcagatcatttgggtctgtttgtgagaagatgaattatgtaacagatccagccaaatattgtagcctaaatattggccctattcgaactgttgagctgaatttttcagaacaaaattcataacattcctcccctcccagttctattactgcctcaaacatgccttttttttcctgtttcttaagcttcagatgggagcccccagagcgacctaaccctcgttgacatattcagtttcctgatttatgggaatcatgaaagattattgtactttgtctgaacgaaggtcctcactgtgaaaacctctcaaagaccacaaacgtggacacttacctgccgcagccaggcctcatggcctttgaaaggagccattcagcgtgcaggctacagcctgggcatacattgaattctgtgggctt

SEQ ID NO: 115920 - DNA, 1111 bp, Homo sapiens
atcatgatattccaagctgttgaactttcttcaaggggtggaagtttctacgttggcttacaaatgtgcattatttgccaaattgcctaggaatacaggcctttgtacaaaggaaaaacacattctttttagaatcattgagaataacaggcttgtatgtgtctggtgatattttcagtgatcattctgcagaaatttcgcaaataaatatatttcttgatttatagaacagataccacctagcaggcttggaaaaagaacaaatgctggtaaagcagatgatattttccagttgacttttatgataatcagggctctgttgctatggaaaaaatccatcagtatgctgagttgaaaacacttgggaagaaggctgatggttatttccaatcccatagagtgcaacactcacccattccacaaatacttactgaaagactactatgtgccacacggtgttctaggagcaagggatggcagtgaacaaagcagacacaaatctctactctcgagagtacattctggaaggacaagacaggcaataaaaaaacagctaaaatgtagactacgtcaaatggcaataaatgctatggaaaaaatgaaagcagagaaggcagatagggagagccaaggtggaagtgggaatggacagggaaggctttgctgagatgacgatattcaaatgaggacctgaaggaagggagggagtatgctatgaggctactggggatgatctttcaggaagaggtgcagcaagtgcagaggccctgtggcaggagcctggcatgcagagaaacagtataaagcccagtgtggctgtgctgtggtgaacaagcaggagagtaggaggaagaggtcagaggcagcaggacaccaggttgtacaggcctcataggacctgccatcatcggtttgtaggacttcttctctgcagctggcccttctcttagcacatatatccatagctcaccatcctagaggcttagctcctcttctgagccattgttgtcttctctggccaccaccattgctgaagccctcgctggcaaccagagcactcattatctcctaggtcttcctgtactgctacaatggttgatttatgtgtcag

SEQ ID NO: 115921 - DNA, 1004 bp, Homo sapiens
ctgagaatgtgtttttctttagacatccacatgaatccctgattcagttctttcaggtctttgctcagatattagtggggattccatggccacctttgtaactataaattgtagttacttgtgccctgccctcagaactctttattcctcttccccatgttatttttatacatatcacttcttcccaatgtgccacacattttacactgaagtaccatacataccacacatttattgtatgtttcccaacactgcaatctgagcatttttgtgtgtatcctctgtgcccagaacagcacttggttcaaactagacattgctaattttttttttcctgaatgaatggatgaagctcttttgtcaacagcctttctttgcttttccacttccattacgggtattcatctggtagttctatgagcaccaaaacttcaagagaatccagcacagagagtagtcatagagaatagttacacattttgtctttagttgcaagacacaattgtatgaagtctgatttcctttaggcatggctttctttcagcttctaccttatagactggtgatcatttaagcaatagcaggaaagaaaaacatctgaggtctcagtggtctgaaagaattagaatattggattcaacagcgatctagtccatgatgagtaaaagcaacatttctgcatgcacaaggcatgactacccctattagaagtgagttagtaaaaagaaggtatcacaaaccctcgggaactcggtttcagaatgcttttgtagacttgactcatatagactttgaaaaacctcacaatgccctgtcattagcatgtagtgcctgtcttaagatatgtatgtgcctttcctccctagataagactatttataaataatactagaattgattaatatcaaaagacctgcccaaataatggaaaggaatgctacagagagaagccaaaagccatagacactacagctcacattcttttctgacagcattatgctttc

SEQ ID NO: 115922 - DNA, 1040 bp, Homo sapiens
cattcgattattagattttgaacattttattttcctgctagaccagcatgaacattcatggtcaaaagtaactgtataaatactgagatgcccataatgaccctagcaagaagtcttaagtggctagtttgttaagacccatagtgattttgtaatgaaactttctcttttcaaggtcctatagtatggtcaaggtaaataccctgagataattaactcattaacttatttccattttgtgcttaaaatatgaataatgtcaattttagagaaccacacttttatagttagagcttttgtttgaaataaagtagctttcatcttcagtgagttagactttcatgtgagttagaaatatgaaaattattatatttatagatttttttgacataacactctcaatcatttttatcagtttgggtataggggaaataaacatcctaaaataaccctggacaaatattcttcagtaaatctcttttgaagcctgaactactgtgtggtttccaggtcctggcagagtcctttttcctctggagactgctcttgctttgcctctctgcctggcaaactcctggtgatctcccagaactcagagtatgtcttatattctcaggatagatttctcacccctacccctttccttaggtttgatcttgttcttagacattctcacaacaccctgcacttgatgacactgattacaattgtaatcaaagctgaggacagggaccatggctgctttcgcccaccactgaatcctcagtgcctagaccagagccttgccgaagtttaaatgatttaacttcaatgattgagttgaatgattaagtgatcaattgacagctgaatgaatgaatgcatagataacaacatgtaagagatgattataagaaatgtcagggtttaaaccagctctcattgaaaacatgtctatctaatttgctgcacataaacattataacaaacattattttgtttccttttttaacgtgtatggtctataatgtctaacttttagtttgtaattctgacatagt

SEQ ID NO: 115923 - DNA, 1142 bp, Homo sapiens
ttcctagacttcaagcatccaccctgacagtgctggttctgctctgagccttcttttcctcactcgcatgaagatgcctgtctggttgacagcatgtctgggcaaatacttcttatccattaactaagcattaacagacttgccccgtgtggtcctcagactggggtactgattactctgatgagagatgtatggctgccaacaacaggggtctggaaaaagaggccacattgtttattttatgcccaggtccagagtggtccagagcgcctgtacaaggcacagtacagttctataaagtcagtgtcatctcctttagttaagatggggtggaggcagctcacaggtgaaattcctccctttggcatcctctggagaaagcccatgctctctctgacactcactggaatgtgggccccagggcagagatggatttttctgctccagcctccactctgagcactcatgctaaagctgctggtggcaggctgaggctgtttcatggattacttggaatgttgcataaggaaaatcttcagagatgagctggaattctgaggtatcagtgtgatctcagttttgtgcaaacattgtcctccccatagtttctaaactatccatcctccctctccaagtctcttcgtgatggctctgctgctgctgccaccctagtgtctcaatggattgagtggctgtgtggcatttgcccaactctgttctgctggctattgaccatcaccatggggtgagcttgaggaggagccccaggcttctgtggccacattgtgacagccctatgctgggtttacagaaaccaggcagggacagatgaaggagcccactgagtgaggacccagagctcaggactatgtggctgtggctgctgcttcctcagaactcagaattctgtggggtttcagctctggcaatgatgtcagcaagagggtgggcccagcaaccacgacaggatgttaagcagaaacatactaaagtctttccatggtatgacttactaagtgggaaaaatggtgggaaacatgtacagtgtgtgctttatatctgaataaacatgctgtcactaaccgatcaaaaggaaatttattttcctcacagaacaattttgtatttgaaaggaacatcac

SEQ ID NO: 115924 - DNA, 1007 bp, Homo sapiens
ctttgacagctgcaaaccaaccacagatccttgctctaagaaaaaaaaattctccaatggcaggtccattggtaaaagtgggtgacaaaggaaattctaatgtgcagcaggcgagtgtgaatgtgtatgtgtgtatgaatgtgtgtgtgtgtgtgtgtgagagagagagagagagagtgcaaatctcacaggcatcacttgacagagtctgtgtttgtgtaactcattagttgcttatggagtcattagggctggggaaccagttctacctcattgtagaactgtgtacctgccacaaattgccttcacccagcgtactttctcttcatatacttgtcctcttgggttgaaacccaggctttgtactggctaaaaaagacatggagggagcccaggacatagattagatggtcttgtccaaatctggcactgccaggagaggcagcggaaatgacaaatggcataaatcatgaatggagtcaggttttctggaggtaaatcctgaaactgctgctttccagccatgtgaccttggacaagctacttaatatttgtgaacctcattctctttatttgtaaaatgcgaatggcaatactagtacccacctcatggggttgatgtgagggctgaatttgttagcacaagtcttgttcacagtaggctccatataagcacttgctatttgttatttatggcacaatggggatggccttttattctaaccatttccagagttactaccctgatctgagccattgctatctctcacctgggttattacacagaatttcctaactgatctcccttctccctaccctactgaagccagagcatgtcacttctctgttcggaatcatctgctgactccccaagtcactcagagtgaaaaaacaaagtcagtatattggcctaaaaatccaatccagcaacctgcaaccttctgtctctgacgccgtctcctgatcccccttcccttcctcaatctacctgccccactggccccctt

SEQ ID NO: 115925 - DNA, 1027 bp, Homo sapiens
tcattaatatatgaggagcttttataaatcagaaaaatatatatatatatcctaatagaaaaatgatcctagaacggggacaggcatttcacaaaagaagaaaatcaaaaggtcaatgaacataaaaaaaaaatgctcttgtagtaacaaagagcatgtgaaatattgataatgtattagttttggagaacacattggcaaaaattataaaaattgcaataaccaataatggcaagggaatgaggaaatcaatgcttttatgccctattaagtggtatcttaatgggtacgggctttctcaagagcaattttgccatacatgtgaaagactttaacatctgtattctctttgaatcagaaattgtgattttaaattatggtaaaaagtgagcaactatgcaaaatgaattcatcacctatattctttatagcttcattaaaatgtggaaaaattacaagtagtctaatatctcacagtagaagattggttaaaaaattttgatatagctataggatgagatacatgcaggctttataaattctaatgagatggaaaatgttcacaacatgcagttaaatgagaacagcaagtatcaagaccatctgcatatctgggcctgtaagtgtgtgtgtatatgtgtatgtgtatctgaaatgatgactgaaaatgttcacagtggtcctcattggaggtaggattatgggtgattccctcctccatttaacacttttaaaattttcatagtgagtatgtattacttttataatttggaaagaaaaaaaaagtcaatgtatatattttaaaatgatctccagaataaagtcaaatcctctaaatgtggcaaatacagaccctttataatctgtttctgtctacctttcaattttcacctcccttgagtacccactaccagctcaatgtttctatagcaacaatgaatttcttggccttttctgaactggatcctgtgttttcataaatctatgtctttacacatgttgttccttctggcctggatctctagag

SEQ ID NO: 115926 - DNA, 1037 bp, Homo sapiens
agctcgtgggggcagacgtcccccttgctgttctcatgataatgagttcttgccgaccatgtgaggatgtgcttgcttctccttcaccttctgccacaattgtaagtttctccctagaagcagaagcctatacagcccacagaaccatgagccaattaaacctcttttctttataaattacccagtctcaggtatctctttatagcaacatgagaatagatgaatacaccaggtaagatttgtcctctgctgcacatctatagccactgttcctgattgctggcaatggtctagcagttagaacagacccttgggcctaggagaactttgttattcattgctgttctatcaaactgggccatttgctgttgtggtcccaggtcagagaagtgccagcagtgcctttgcttaagcctttgagaatgttctgccatccctcttctgcattttgaagaaacagcttcaaggcacctatttttaaaaggacagataaattgttatataatggagaacacttttcagaccattcaagtcttggggcctgttttggctgagacatgagacaaaactgtcctctttgtgggaactagttctcttgtccctcttgccttttaaagtcattaacagcacgctaagcaatttggaatgtccaaccactgactcagctaggtttcattgctttgtttactttgctttacatcttcagcctcttcatattggcattatgtaaaaggcttcttcctaaaaatatagacatttcagttggatttgagcaacccagaaaaagttgttttcttaatttgggaaagatccatttgtcagtgtttttgcctatctgtagatgtacatgttactatacattgggtgatacacacacacagttcattggagttggggttcatcattccacaagcatagattgagtttagaaactacaggaagccttggaaagtattcaccacttttaaggttttgataccttggttcagttcctaagtgttgggaagtttcaaagggtaggacaaactgggtggggg

SEQ ID NO: 115927 - DNA, 1030 bp, Homo sapiens
aataaagagaaagaaatttctcaccaataataaaaatattattattttaatgcacccataaaagctgcattattgatcactgttttctagtgagtattttacatttcattaatatttacagtggcattaatcatggtctggatgtgagatttgagtgacagcactttcattgaggttcccactcatttttaagtttgcagtctgttgctcatctcagatgtctccaaaatgtctaaatcaatgtgatctactggacaaaaaatgtgagttgggaacttgagagttttgagtttctattggtgtcactagtgacttccaatggaaccttaaaattcttgcctttcattatctataactttgaaataggactaatacttgttttctaaataatggatttgatctataccttccctcctagcacaagtattgtggtcatctaatatgtttaggacatttttttccctttatttcatcagaggcagtgttgtgctagagaaagcacagagagttgggggttggattttaaatctagagtcatttactagtttgtgacatggatcaaaacacataacctttttgagtttcaattttctcatctgtaaaatagggataacaatgatcttccagaaaggagatgagaattaagtgaaataatctaagtaagatgcccagcatattaggcattcaggaaagtttttctcccttattatattatgtaaaatgttataattaacagtttctgaaggcttggagaaaaaaaagtcctccctttttatggagatttttcaagaatcttttcaagaaggattactgtttccttggtttatgcatagtgaataatttttttccttttttcttgtatttcttctatttgcccttttattcacttttcaccagagatatgcaggattgcccattaagttttaggaatatttttaaaaaactgatgcgaggggataggtggaggtggggtatctcttgatgctgtaataacaatagggaatttagctcttttatgaaataaatgtga

SEQ ID NO: 115928 - DNA, 1056 bp, Homo sapiens
agttaccagttaggcactccctaacgtagaaggtgactgcagcctctggagactagggcaaggagagggtgagttcaaaataaaatgccagcgtggctaaaggatgttttagctaaggaactgttggttttggggaacagaaaccctttcaaggaagctcaagtcaatagggagtttataaggatgcaaagagatcccatagaaacacacaggaaagatagcaaagtcttctggtaactggaaagtctctggaaaagtccatctcttgtccattttcccacatgctcacttcatctttctttacccgaagactttcttcttgactctaactacaggaggttttcatagccccctgtgaatagccattctagtcccagggtcttcatgatcttctatctcccctcccgagaggtaactgacccaatttctgggtcttaattccatgtccctgggagactaaatctgactggccttgctcggatcaagcatctacctttggtctgatattgtgccccagattaaggacaggagctgggaaaatttagagtggggaggataaatttctgaggtgtctgtgggtttgaaatctctttaaagagacacggatgggaagaaaatttcaagtatagctagaaagatgcaaggccagtacgcactctggaccaacttcagtatgaatcaaagtcatgcctgcattccaacccaatatggccaaactttcattaaccccagctggcccaggagtctacttttcaggtaagtttctgtattgagtgatgaaccactgagaacagactgaaaaggacaaagtctttggaatgactctatcagtagtctattgtcaaatggtcaccacatcaagggcctttgccttcaaagaaggcaatttattcttctgcataattcatagatcttccacttggaaatgttctgaattacagtttcttattcaaattaggtttaagaaaacagtttttatttctgagacacttgcctctcaaagcatatttcttgaggtttagcaactattctcttagtttttcagggactggtaac

SEQ ID NO: 115929 - DNA, 1042 bp, Homo sapiens
acctaaaagattaaaattcctaaacaattagttttgttaaatggggaataaatcattgattatcttccacctgggttgacatgatttcaagtgtttaaagtatttctgaacatgatgcatgctcacaagtgattttcattgccatctcgtcttggttggttttcagaagttgaacttggaacattcctctttccatctgatccactcttctttcttgtgttcccccccccccgcccgccaacgcctccttctaatgaaacatctgaacagactgtggaccagttaagtctttgggggaaataaactcttaaccattaagaggagggttgggtgcgaatcatctggcaggatggaagggcacagactttgaggctggacttgggaatcttggcactgccacttgctggcttgtgatcttgagtaagttgcctttttggcgtgttagtctctttatctgaaaaacaggcataatttcatgagtttgtttgataaggctgccataacagaatactacagactgcgtagcttaaacaacaggaatttattctttcatggttttgggggctagaagtccaaggccaaaatgttggtggggttgtttgcttctgtggtttctctccctgacttgtagatggctgtcttctctgcgtcttcacatggttttctctttgtgtttctgcatgctaatctcctcctctcataaagacatcagttatgttggattaggcccagtgtaataacctaattttaaataagtacttctttaaagaccctatatccaaatgtagtcacattctgaggtactgaaggttagagcttcaatgtattaatttgttggggggtgggggagacacacttcagcccatagcactcatctttcctaaaggggtgctctgaaatactgcagataaagtgcctggtacataataaagatgttaaaatattagctctccttccttttctcaattttcattccttgtccctggcatagaagggaatgtatttcctttaccttcaatgtaattgttcctcctttcctttg

SEQ ID NO: 115930 - DNA, 1022 bp, Homo sapiens
agtctagcagtttctatgaaatgtctttgtccccaactggcagaatctagaaaaacctcgtggggttggaatgacccaatttgctgactccaaagccaggctttggtcatcatgcaggcaattctgtcttcatgcggttgcatgcaggtgaggctggagcagacagcatgttctggaacaccttaatgatgtcaggacgcttttcattgctcatctatcacgtaacagctcagatttgcaatgtgctacctgcgttctccctttagcacagacaatgcgttctttcaacagtgtgcggctccatgggaaaggctctgctgaaagtgaagtggtggggtccacagctgcccctctgggaaggagtggtatgggggcaggtggggaccagatgcctggccacagccgagctggggatgagcacatggaacaaccgcttctggttacacttactcgtttctctgtgctgaaaggtgtcatataaatgctaagaacagagagagatggggcctatttatttgcattttgtctaatgtgagcagatgcagatagaaaagaggcttagccacagccgttcacctgccccgctaggccttccatcttcagttcatttcaatgcctcccgcgtcagttccgctccagtgctgcagcagacatggcatggggtgcaaaaggggcacatgccctctgtcttcagtgggtttgcaaaacttgtgaaagagacaggtttaaccacaggaaccatctgaggacaatacaacccagcatatggctcagtggtaagtcatggggaacaattgaaatgctggaggaggttgtggaagagaggaccacgcgtggatgggcaggaaggcttcttaggggaaatgaactggacttgccctgtgaagctggccagcaggtaggtgggcaaagatggtgagcatcgattgtctacgccctttgccagaccctcacatctgctattctactgacatactcccctcctctctttcagtggttgggtctcccttatcaattaggac

SEQ ID NO: 115931 - DNA, 1733 bp, Homo sapiens
ttatatcacaccttcttcttttgtcttcatcctttcccccacttcctgtgctttccttttgtctcctctcattcttaggcaatgggtttaaggtcaaagacacaggcctgggctcagattcttgccctatcactgaccagctgtgcagttataggtgaggttctcaagatctcttggcttctgccttcttattcctagaaatcagaaaatataagtctctttaaaatgcatctgttttgagatctaaatgaaagcctgaaaagccttttatcacagtgaaaagtgctcaataaatgtcagccatgctcatttaaatggcctaactctggtagtgacatttggggccaaaggatagctcttgatggctgggtctgaaagcccgtttcaggatgaggtagtgtcagctctgttaaggtaacaggattgggcctgagctgttagaaacttggcctcaataagactctagctgaggtatcttttctttctcaagaatctcaagggcttaggccagcacagcctgtgcactcatgcttttaaaaaaaccaaaaacccaaaaccaaacagaaaaatgcagcaacaatagctgcttgggcccacatgtcactctattatctcccaccgttggcctgtgccagtacaatcaattgttccacggtcccatttggtaacttggaaactgtttgcgctgaggatctatgataagcactttggctggaactaacgtccctttggaggtgaggagggagaaaaggaaagcaagatgacctggctggggacaggcaattctctaaatgctggcctaaagggactgagttcttgaaagcaggtgactagaaagagaatattgttctacttccttcttttttctttattctctgggctcacatttctaagatctttaattttcaaaacttaaacaagaaagtgtattaatcttaaatgtctcccattaatcatcaagtccagcccagcgacgagagatagatgactcacttccacaggtgatttcttggtaatggtgggtcaaggtttgcccctccatttcccctactgtctcactaatggagaaagcgtccccttaggaagtacctgtcttggagcaatttgtcaagggaaaattgcaggtgggaatagccactgacaagaaaatatttctcttagggaaacaaggtgagtagcatagcatggtgattataagcataggccctacctttgagagttgttgtaggattaaattacagaattaaataaagcacataattcagtgtgtgacatagtaagtaggtctgcgataaatagtgaatatttactacacccctttacatgccagacactgtactgaggacttttgccatcatttgagccacatcatatttcattgactgagctattatttccctctggtttacagacggggaaaccaagatgctacgtgacttgctcaagatcacacaggtagtaagagacagaaccaggatttgtacccatgtaatctgactctgaagtgcatgttccaatcactacacatgctgctctcggtgaacagtgactcttactatgaaacaggaggcaaaatgagcttgctgccatgaggatagagcccaggatgttgtcctgtgtgttgtagagtgatgtatcctcttctacctcaacgaccactaggttcctgtaggcaaattaggagtgattgagccatgaggaataaatccagccactccactgcttttgctgac

SEQ ID NO: 115932 - DNA, 1096 bp, Homo sapiens
ccctccggcgtggatcctttgttggtggctgctgcctgccctgtgctctcgggtcttggtctggagggtgagccctgccctttcttatgtgtctccagtgaagccttctgctcatgctgaaaacagcaaaggtggctggctcagcctatcccttcactctcaatgtctggacaattaatatgtcatttcctaatcagtgtatgttgatgcgttatttattctagcatgatgattgtggccaaagatcacctctggcattggctctctattgttttgtacatattatttctcagcacaggcttgagaacaatgggctcattgattccacctgactcttgggaaggatggactttgccagactaaggctctctgaatgccagcctggaagttcatgaatccccttttaggagtaagctgagcctttgcggttgggagtggtgaggaagggaatgtgcctctattttccttgctatttattgctctgcattaaaaaaaaaatctctttgcttctctgaccagaaagatggtgtttcattgaggtagagcccatagtaattaggccagcaatcagcttgtccacaccaaagtgcatcacttgcattctctgtgcacactctctctgcctgctccaccccgccacatccctcctctgcctccctgtttacgcgtttggttcagaatgcagaaacaatgaaggtgtttagggatcctagcctcacggggtagcaattggtacagagaggctgtgacacagagtgacctggaattccaagtggaagattgaggtacgaggacagctgagattgtgctgtggtcctttcttagctgtattcttgtcctgtgagggtccagtggtccagtctttaactgaactgttgtcctgggatgtgaagattactattgggtggcattgaaaggccccttatagagggtctttgatatttcttggccactgccagacttgaaacgttagttttggggatgtgtctccttagcagtcactaccgaggggatacaatcaacccagtgctctcttttggtggccagatggcaacaaaactggtgtatcagatatgtaatcctcctctccctcagc

SEQ ID NO: 115933 - DNA, 1021 bp, Homo sapiens
agaccagagcagggcttagcccactcatagcttcaggccaggtggtccccaacatgctgagtggaggcgggagaggttgggcgcctggcaggtgacagtgcttcctcacgcctcacaactgctaagacaaaaggaaggcactctgggtggggacagtagctgctgccaacccagaagtagttcagtggtataagggaagtggcctcctgccatcagggccttggatggcaccgtgctgtccaagtccaagccatttcacaaaatggccaagtttgagaaagagcaggttcctgtgagtgtaaaagtggatccagatgaacattctcttccaaagtcttcgtggagcttccccagtgggaatttggtgtcttctccctgtgtcactgcagacacgtttccctaagtttagtcttgtcacacgatagtgcctgcttttaaagttgcccatatgtgaaccgcacgctcactctctccctcctcatggtgttaaaatgtgggcgtgtgaaacactcctccccggttgaaatccttgtcgtgttagaactatgtgtccattctgtcccccgagggaaatggaggtctctggattttggctaaagccccaaagcagaatgcggtgggcagtaagtgtctgcatattataaagaaatcagcccctccagagggaggccaaacaggccctttgcccttcaccctgcccactatcccatgaagtccacattagcaggagacacagactcatagcaaggggaatcactgactggtgagctgagggcttttggggacggggctgtggcatttgccctccccttcccatgttgcccccttcaggcaggtgaaggagggctgaggagaaccctcatcagaactgccctcgggtgtggcccctgccgtgccctcttcctgggagagaggccctctctggaattcttcagcacactcctccccatgaagcaggagccagagcctgtgggattaaggggacgtgtcctcctggagaccatgcctccgcctccccatc

SEQ ID NO: 115934 - DNA, 2810 bp, Homo sapiens
agtaaagagaaatgcctgtaaaagttttaggccttgattcatggcagaattgggaggcaggttcccatcgtgccacccatccctggcagtaaagctacccaggctaatcttttgactgtttgtaccctctaggtttccttgaaagataaacaattctatcatccttttcctcagtcagccccctccagcactattggcacttctgcagttagaaataagctgctttgcatcacaaatgggccagatcttcagagctgggccagcagctcctttttcttgtgtgggaaagatcagagtaaggaaaaaagcccagagcccagaaacatcaagctggaaccgttgaaaggttttcttcctgccagactttgtccagacaggcggataatgcaacatccttgggaatttgtcctggaatggtctgagtcttgtgggagaggaatgaggtgcttgtccaggactgtgctcttttatccacagctgattgctgtcactttggtgccttggcctgtcctcatgcacccggttccctcctgtatcccaggaatgcaggacagggtgaacacacagtgctaggggaggcccagctgtaggcctctctgctcactcaaggagcacagcctgggtgtgtccacgcatgtgggactggtctttgggaccaaccacttagatcatccaattttagggtggcattaacagggtatctggaaagaggctgagattgcccacagcatgcctgtgagagtgagggcagaggaggtgggaccaggatggcattcactgcaccaatctcctgctgcacgagtgtgatagagaaaaatgaacagacagcctgttgggctttgagcaggctggccaagagggaatggacatattttagctgaagggtacactgtctttccctgtagacagggcaagagaatagagaagcaatgttaggtggcaattgtaataataattacatggtcttcatgatacatgtcttcaactcattttcatatgcaccttgctggagcctgcagataaataccacacagcaaagtactcttatctcttatcctcatatcacaagaattcagagtgtcatgtgacttgtctaaaatttatattgctagtaaattgcagagctgagtcctgtcttggcccataccttgaagtgtcctgcttaagtgtcatgatattgcacactctggagtttcagccagctgctttggtgaaacccacattggatgtcatcaatggagtcatacaaatgggtaaaataaataggcaacttagtgaatttgaattcagtgtgggttgggatggtcattgcaggagggtactagaggggcagaagtgggagtggcaggtgttcttctcagtggcatttgccaggtatagattagggccacaatgtgtccactgtggtcagtcggcaatcctcaggaatggggtccagctaggatgggaagagctgccatggtctaggggaggaagcctgaattttcaaaggctagggctagggtttcaatgagaaactgaaaagatgatgggaaaccaaggcccacatgagaagacggtgaaaaatctaagccctcctcatgggggcagagtgtgaacattaggatcagatgcttttgtggcatctaggggctgagtctgtcttatttcccagtagaccctcttctctagtagctatgacagattgtactttccaaagatggctgcagtaatatctcccatctcacatgcttattttacactgtaactttaacactcctctcatggagaggtggaatctatgttccttccctttgcatcttgacatgtttgtgactgtggaagaagtcatgctatatgtcttctaagactgggtcaaaaatggtaccatggtttctaccttactcactggaatgttcatgccaaagccctgagatgccatgtatgcagctcgacttctctgagattgccatgctgggaggaagcccaactagtccatatggaacagccacatggagaagccctgagactgcatgaagagagatatctggccagtccccagtttgtcagcttccccactgtttcagctcccaccaccaactgacttcaactgcatgacagacccccaagccacagccacccagtagcttcccaaattcctgatccaaacaaaatatgaaagataataaaatgattgctgtggtttgaagccactatcactaggctggtagttaccaagatttgttattcatcaataactggaaccatgcagaacccagttcttatggcccacttggtgctgggatcactgggaacaggtatgaacacctgggctgcattgggatgaataaacccaaggtcagaccctagtgcttgcttatgtttggagaaagccccatccagcagggcatcttgtgagtatgtaaaaattcaagaaggtccagttggctaacattgagaaggttccaaatgagagtgcaaggtatcccaacaggaggtggaatgtattagtattcagatatccaggctcattcagcccatgcatcaggctggtatgcagggacagagaccaggtgtgatagtgattctcatgaggtgtggttaagtattaagtgaggcaaatctgagcacgcagcctagttctagcacatagaagcttctcaacaaatactgagctattctgattatattattttagactttttcttcttcaagaggttgttgttgccattattgttactatttggcctaccagtgtaggcagagccatggttctagagagtcgacattaataaaccataaacaaagaccacagtgttcctattcaaagc

SEQ ID NO: 115935 - DNA, 7038 bp, Homo sapiens
ttctttgacactttgaactgagggagttggtggaaatttagaagcccggcacacactgctgttggatatcttagagtcttttttcttgcttatgtagcttcaatatgagggctacatccactaggatgtagagcatgattctagaccccgacaacttcctgctcgttgctttcagttcacagatgcaatagaaaatgtgagtggggtggggttagtgggagaggatgcggtggagaacaggtgattggtgttttactctggtaccttagaaataagcacttgcacaatagaacttactgttcagcactgacctaggcctttgagacagggcagacaggggaaggaccagaggccatctcactttctttgccatgtgtgggtttccctgcttcaggagaacacctgtagcttggccactcactgtttctctgaatccaccttctgctgtcttggagttggtgaaaatgtttctccacattttggcaatttgtattcacgctaattttgaatttcattctttaaaacatgtagtggggaatgtatgtatatttactgggaaattgagagaggttgagtcatggactgctagccaggtgtcattgtaaactggaagttcttcacactgatatttttttgtttgacagtttactcccagacactgagctttgtctggatgtgcattagtggcaccatcagcatctgatcatttcttgacacctcattcacccacttatccattgccaggtctttttgccatgggtcttgtgtccgtggtcttctttccatccccaccacttccaccgtggctcaggccttcactgtttgccatggtgtcatgtggttgctggctgcctggactggcaatcaccagccttgcctccttttccatgcttcgtattactgttaaacacactctttttactgccgtgggacagtatcatgggttcctaaaactgctcagtggctcctctttgtgattctaataagttccaggttaacatagacattctaggtacctcatgacctgtacccaacctacgttaccagtcctaacacctttactctattcctgtaccctttgctcttactcaactggcttatcctccattcacaagcatgttctacatttccctgccaccacccttctacttacgtcattccttctactgtgctgggatctgcttctcttttatttctctttgcagtaatcttaatcatcttctagaaccccattaaatgcaatcttttccgtgaggcctgaatgcaatatcttctttctctgagctctgaaactggatcatctattgaatacattctgctttgtgttggagtttgtgtgtgtgtgtgtgtgtgtgtgtgtgtgtgtgtactacctgctacctccccttctagattgtaagttttttgaagtcccccatcacattttacattggttaagctattctattttgctaagccctaatttcctgattaaactgagtgcaatagtagtgcttaacttctaagtttgcagcattgttaaatggaataaatcatctagagtgctgagcagagagcttgacatacaacaggtcctcaacatttattggtggaacaaataaatgaatgagtcttctcgttttctcttgaatcctatattattgcaaatgcaaaatgttttcctatcctaaactttgctaaatttgcagggccctcagtactagttgcattccacatttttcttgagcattgccagaaagtttaggggcaagaagggaatgatcaaatgtaactaccattagtgaaaaccacaggcactgaacagctggataatgtgaacagacaagttcagctgaatctccagaaatgcatcaatcataggatgatggcagcttttggggagagttaagagatgcttgaaaaggagccagagtgtggaagaaaaaagatgtttagagttgggttttcaaaaccaaagtcttcatcatggccaacaaactatgggaaggtggcaaatgtgtgtaaaaagaccttttcattttcttgagttctttagaaaattggagagttttgtttggtttatttatttatttatttttgagcagcttaataatagaaattgcctcagggatggcgtctgccattgcttttcaaatgcaatactgttctccctccggggattgtgctgcagaggctcctggagtgaatattgcaaaagccactaataatactccttctcaggtaacattttctggtataaaatatcttggcttaatatagtctaaaaacattgaagtgtaatgtggccaacacgataactttctgaaatacaatactattgtccttacttctgtcttggtttctgtggtgtcagaggcccaaaatgaatcaagatgacaaatccttagctaaggcaatgtagaagccaccatggtactgtacaggaattatagtctcttatttttcccgggagagaaagcatggagtaatgtaaagaacactggatgagtgtcaggattcagcttcaggaggggaaagccaatagacttgggcccagcacttaaccactgtgcgccttatctcttaattggaaggaattgggctacagggtcttaggggtccttctaaataagaagttttcaattctaaggtttcttctgtctggagaggagcatatcatgatggattggtctctggaatcaacaggcttggttttgaactaagagatcttcgaccagttgcttacccacccgtggcctcatttttcttatataaaagatggggatagtgatattacttgtatcagtttggatatgcagctgctgttgatttgttgattcagctgctccacaggaacccacgctctttttgatgacttcaccatctttaatttcatcttcatgtttgttgcctcatcttataaaaaggcaccagcctctccaggtattaagtcttcattcccatcagaaagcagggggtgggagtgggaggtgatagcaggattttttttcaagtatatgcatggggaaagggtctatgttctagggctgcttcttccttttctctgaaaaggaacaacttttcccaaactcccacatgacttcccattgtattttattggccagaacaggaccacaagactcctcacctgtgggaagttggaaaagtctttttcagcttctgtgatagtggttaagggagaatgggttggaagtcctttgaagtcagccaacaaacaggtttgccagtccgccccaggtgacgtcagaatgtcatgaggtacgtgtagtggttaatgctggttgagtgcttaactcccgggtcacggcctgacccagagccagcactggataactgttagttacccttctctaacagtctattcttccctttgcacctgattcaacctcactgcagtaattttcaactttatcatatgagaatccagaatccttgatatttggcactagaagccccttgacttctttctcttctagtaatgcactgctttcctgtgcactgctcatgatagctttagtgtcttgtccaggagtgtgcatgtcttaaactcacaaaaggaaagctgggtcacacagcaagggaggctgagattgtcctgtacaaggtgttttgcctgaacaaagccacgggccattccttatgcatggggtaccatgcttttcacgatgaccctgttctattctgaccttagcagtctggaccagaggatggtgcctgactcaaaaggcagccagtgagaggctgcagtgagatttctgtccaataagagaggtccatagagagtagtaattaatggaactaatcagtctctctgtcttagtgtcactaagtgtcattcaaatatgccagattttagagatgtgcataagctaagaggcacgtagagaggagacaagcaagtagatggcacaagaaacggaagctgtgagaaggcagaagccatgagatggatgcatttgttgaagaggccttagcatctgaacagagaatggctgacttgccattatgggaggaacagcacatgctgttgagggacaagatcagatctctggagctgctgctttgcctagggtgttgctatggccatcctgtatcctggagcatgccccagttctcccctggctgggctgccatctttcttgctcctccgggccccctctatgaaccccttattctgaaggaatgtgcaaagatctctgatcttggtaactatggagccccatttacaaaggaattcaaataatttaggcacaactgagttgtcctgttactaattagagtaagagagggtggctgatgtgcagacttcttccacctggctgcccctcatggagcagccaccctcatggtaggagaaacctactcagcaaagatgagctgcgattctattctgtgcaggcccagggcccaccagctgggcaccagggccctggccccccatttgctggccagagagtctcttcagaggggaattcaggggaggctgccttgccaccagacaatggctccgtttacataatcctcactaggctgtggctggtgtaattcagttatttgattgattttatattgtgtgatgctggaagaagtgaggaaacaacaggtttttggctgtaccctctggcctgttctgatctgtcttgttggcttcaaggatttcacgaagctttgtgctgctgccaactgtctccctgggtgttgttcacaggcagcatcctgcttcccatgtgcatatctccacagaatccgtaggaagtgggacctaacccttaagttgccggctcgtgggtggggcatgcgggcagcagaggtttgcgtggagtcttcagtggccccacatgttgcagagtttctcaaatgtttagtgctcaagctccatcttgtccctttatccccaggagaaatggctgtgtattggtttgattggaatgatctccctatgtctggcagctctaacacaagttaacacagctttaaaaaccagttttcttgatgtcttgacacagcagatttcctagtatggaattgttaagccacatttcaacttcatttccaggcatgtgtcttcctgtttgtttgtttgtttgtttgttttttgagacggagtcttgctctatctccatggaggctggagtgcagtggtgccatttcggctcactgcaacctccgtctcccgggttcaagtgattctcctgcctcagcctcccgagtagctgggactaccggattatcggcacgcgccaccgtgcctggctaatttttgtagtttcagtagagacgaggtttcaccatgttggccagaatggtcttgatttcttgatctcatgatccgctcacttcagcctcccaaagtgttgggattacaggcgtgagccacagtgcccggccctgtttgttaacttgaaggttctgccatttcttatagagcctccatctctggcatttattgttgatacgttgtttcttttactttttgtatgtttattttttattcaagtgagactcatgttgacacattttgtttttctcttttctttcagctttaaccaaacttgagtaagaactccctgacttggaaacactcaagtttcccacacatgactggatggccctggccacactgggaacggaatgggggcctcccattggaactcagggtggagggggaagctcgaccagctattgtggcccccacttccattgacaaagtaagtgttgcagacgtgggtgggtgggatacagggtgtgggggctggttagtgcctggcatctggaattaaaacctaaacacatttccctttagaaacaatattattcacgagggccaaaagcccactaacccccccaagagctgaacgctacggtgtaagttctattagtgatttttaattctggctgtgcattaaaatcacctggatgtgctttaaaaccctgcatgtgttcctccagcagaggttctgattaaactaatctaagcaagaacccaggcatgcgtactttttaagtttcccttggccatgcgcggcggctcatgtctgtaatcctagcgctttgacaggacgaggcaggtggatggcctgaggtcaggagttcgagaccggcctgggcaacatggtgaaaccctgtctctactaaaaatacaaaaattagcttggcacagtggcacacacctgtagtcccagctgcttgggaggctgaggcaggagaattgcttcaacccatgaggaagagattgcagtgagccgttatcatgccactacactccagcctgggtgacagagtgagactctgtctggaaaaaaacaaacaaaccaaaaacaaaaccagtttccctggaaatcctaatgtgcaggcagggttgagagccctgagattttatatctgggtcaggactaggctgaggccagagaggtgcctaggtacaaagtgtcaggaggtgctcgctcttggagccgtgcaagttggcccactttgcaggtcacattaggaacttcgtcagcatgggagtcagtgtcttggatggagatgggttttagttttaaacttacctattgtgaaaaaagtctttagggcacaacccatttataatttggtgatttctcccttcctttcttcctgcttcttttactgtcacactcttttaactcctctcattccaaacctctctgccttgtttttactctctcctcatttctagcactttcttctccccctgcctcctcctcctccttttcctccatcttcttttccttctctgttctctttcctctgagggcggctcttccctttctctcttcttgtgtactttggctatttttgttagccacattcccttctcattattccaggcccgttcatgtgtcctggatcgctttctgtttttctccctcccccagtccctccactccagcacgcccaccattgccccaccattggccagtctaggacaattctcccaaggctcctcccaagcccacactggctacatcagcctccaacagttgttcatggaccttgcttggcccttggtgacaccag

SEQ ID NO: 115936 - DNA, 2918 bp, Homo sapiens
aagaaacaaatttctgttttttataaattaccaagtctaaggtattttgttgtagtagcagaaatagactaagtctcattcatagacccggtgctttccagctgctcaaaattatttgctgtgcagtcctaactgggtccgcatttgatggcatctgtgggtcattacaaggtttctttccctctcaaaattctcctaacttctcttggaagccctgccctttctgtttataataaacaacttctcttttaaaaaaagatagccattatgatgattactatcaacactattataccaccaccattaccccctactctttgccaagccctgagaacacacaaaaatataaaaagactctctgccctgggagagtttctaatctgggtgcaggaatataaacactattgatcacaagtcaattcctgtcttacttctaggataaaatgcttatgcattccaataggaaatataagagcatgatgccttagcccatggtacttttgagaggccaatgaagagatattcagaaaaggcagggaccctgaaaaaatcatatcacatcaatgggtatctacaaaagcctacctttaaaatcttctctaccacctgtttccagctgatggccctgtgattgtccatagtaaaaccacacagggtgtatttgggggtggccttttttgttgtgggggtgattctgtgagtgttgctgtagctcaccctaaattactcatgtccatcctaaagcacagcggaagagatgtacatgactgtcagaccagagcttctgccaagcagaggcaggatgcaacaagacacttgaaagcagaaatcttcctgtttctgtaacatttccagctggaaaaccaatcagagccacacattccagctacacttgggaaacactgaaatatccaagtagtaatcacctaggtatgctgctaactgcagctcaaaataattctggggttgccagtgccatgtaccttgtaggcttccaattacctgtgctcacttctctcttttctccaaggaccaattattgggggaatttggcatttctcctcctctctgcttcagccattcaaagaaagattgttatacaccagaatgtctgaccattttaattaagccagtcaaaggtaggtgctgaaacagtttagcccccgaagcaaggattaaacacttaaggttgaggaacatagaggttagttagtgtcaaagagttggaagagaccctagagtaggatgaccatacatttcagtttaacctgaaagcccctgtctcggtgtaattattatcacttcttttctctcaaaagtgctcagttgggacaaaaatgatatagctactttgccttaaagattatctagtctgcctttcagtttggttcaaatttaatgtagaaattatctttctgtgaatgatggagacttgggagatgtaaaaaaataaaaaaaagcttttattttatttaaaccttaaataaacctatttatttttattaaaatctttctgttttctcttcctttcaaacacatggtcatctgtttgctattaaccaccagtaatgggggactcatactttgcaaggaatctctaattaatgagttctcagttctgcatcaaaatcttccttcctctggcttcaccctttgattctagttccttcttctgaaacaatctagagtaaatttcttctctcttccacaaaatattttccattttggtatatttgtggtgtctttttcaagaaaataatcatgtttacttcacttccttttttgaaattcgaaggaaactgatctgattttggactgagataccttattttattttttatttttttgagacaaggtctcgctgtgtcacccaggctggagggcagtggtgtgatcagagctctctgcagccttgccctcccggacttaagtgatcctcctacctcagcctcccgagtacctgggactacaggagcatgccaccatgcccagttgattttaaaaattttagttagcaaatagctcttgctatgttgcctgggctgggctggtcctgaactcctgagctcaagcaatcctcccaactcagcttcctaaagtgttgggattgcaggcatgagccatctcgcccaactggactgatatgtcttaaagacaaaagcaagaattttgctaagctctattatagaactcctaggtacatgcccaattgtttggagattgtaggtaagatcatgcaggagttaccaacaaaataacaatgccagcatcctgtagtgaaaacttctttatgacattgttttatgaatgcaggtgaatgacctagataatgtctctaaaactttacaggcaggacataagcataacatgaagaaacaaggctctctttaaagactattccaagctaatgatggaagcaagattcataggttttgtttaaaaagaaaatgtattttattattgtaaaaataacacaggatgattgttgaagatttactacacctcaaaaaaaagaaaaaaagaaaaagactaccatcagagataatattccatgtccagttgatttttaaaaattttttgatgtacgtcctttttttcttttctctatgtggatatacttgataaataatttaacaaaataagaatcatattgatatagagtttgctctacttttgtattaatattagataacaattattccactgcaccattaaataagccttaacatttgattttatggtttcaaaagactcaacaatatatattttgtacttttccaaacatctattgttagagattgaggttatttttaactactcctctaatgctgcaggctacatcctcaatccttgcctgcttcactgattatttccttaggatagactcctagaagagattctggttaaataattttatt

SEQ ID NO: 115937 - DNA, 1134 bp, Homo sapiens
attggcatccttcatgaagatggtaacatctctggtccatcaggagggaggtacattgtgctttcttcagtagacactcatatgtaggttattcttcagtttgtaactgcccacagcacctgttatgccaagttattcttaccttgcctgctggattttctggacaacccataacctttgctagaaagaagcctgcacgtgttctatttctggagcttcgctagtctgccagcagtactcaggtccccagggtacctacctatttcaagttgcttgaaggtgtgcttctgggcacctgggaagtgcgttggacccctagaatgtacctgccctggctgatacttaatatgaaagctgcctcgttactactgtccttatcagctcagtacccagggaggtgtccaggcctggacattgctcctcaaacaatagtttggtttcattccaggagcttttgttgttgccgtcttattggctgttatttggaaagcttagagatgaggctagtttaacaagtcaagagtcgctgtgaaatatctattttgctgccctgtaaaaacagaatacattctctgattttgactgtggtgaggagcttgatgctggattgatgctacaacaacttcaaagtactggctttcttgaaggtacaaagagttgaagctatcaccatttagcttttagataatctgcacattttgttcttccctgctgctcaattgccagagtttaataaggatgccttagaacacatgatctctccttgcagtttaaatcaatcacccattaattgacacacaaacctctctagaaagagctcatcttcttggtttctgggaatgtgacctggttctctgttcaggtatagggtcacctttgttctctctgtttgtttcccaagctttaggtaaaacttctaaccaggcatggtttgtcttcagctctatttaatttgtttcagaggcttctaatctactttagatctttccctttctccctccaaacttcaatttgagaatgaattcctactgcaataatattaagggtggggcctttaggaggtgattagatcatgaagactctgccctcatgaatgggattcgtgcccttatacaagggcttaagggaatctgt

SEQ ID NO: 115938 - DNA, 6839 bp, Homo sapiens
aaatggtttgtaaatttttttagcccttctcatatttattatggccaaatgtaaaattgttagtctctgggatggcctagaataaatatttatggttttccactcacataaaacaagagtagagttattccccatgtgtcttagacttatttggctctaaagagtgaaactccacctgcttcataactataactcctaacaagtttatatttctttatgtgcccatctttcctttcaatatattattctttcctaagtttctattttttctcagaaaattttgaaatccaatggaatttgcatttctgcttctttcttctagttgtatctttttaagaaaaccagcaaacaatggcttatgttaatgaggtgtcatgagaaatacaaaggaagcagagacaccagtctttgctcttctgctgtttatagtattgtatatcatggtatgcagtcacctggtgttctgcttttacaggagggtttattaagtatgaggcattgggcattcatatcatggttggccctgaaacctggaggtgttcctctgccactgctgaagagcaggtggttactgaaagagaacaaggtgaaggcccatttaaaatcgggcctcaaataaatgtgaatacctttggaattgtttgtttgtccaggcttctgatttcaagtgagttgtatttgtcaggtaacactatggcaatgggagcattaaattaagaggtaaattggacattctatccataggtgcctccctcttgacttggaggagacaggcaggtctgattttggcacatttgggaatatgggagcaaacacatgccagctccttcaggctgctaatcatagcttggatgtcgtttgcctcaggcagcaacaaggatttattaagcccccatgtggggcatggcattggattaagaactcagattctgttgaggctctggctttggaattcaatcttatacttttgcttgaggtaagaaagcattcacagtaacctcattcttctgcaatgctcagatgatgactaaagaaaaaatcattccagtgagccaacattaggtatcccatcctctggcacaaagaatcagggaagaggtatttaaatagagcaaaaccacatcagtttgaaattcaacgacctgaaaccagacagtcagagatggaatcacagaatgtgagaatcagaaggtaatttagtgatcacctaggccactggtttccaaactttagcatgcattgtgatcacctggtgggcttgtcaaaatagagactgctggaccctaatgcccaggaactataatttggtaggtctgggacctatccgagaattaagaacttaattgggttggatccaagaatttgcattgctaaccagttcccatataatagcgatgtcactggtttggctaccacatcttgagagccactgatttagatgactcctgtactttacaagtaaggaaactggaatggaaagttgaactgttcaaggtaacagtgcagaaaatgaaagggccaaggctaaatctagttcttttgagttcaggttcattgttcttatttctgttccaccattcatgacataaatttactgtgtctacaataacatatattttcttaggaataataggaaactccccaaatctttgcattcccacttggtattaatcgactttgggaagtcatgtaaccactctactgtttcagtttctgtaaagtgggaaaaatagtaatacttgtaataataggataacaatcctctctgatatgatggttgtgaggattgacatataatattatagatatataggtatatacatcaaatatttataaagttcttagaatagtgctttgcaaactgcaattattgttactaaatattagctatttctaattattttgaaaatattttatattaccaagatttcactctatctggtcaaactggttgatataagaatagtaaaggtgactaagagaaaaaaagtcagaatatggctaatcccaaaacagattatttaaaataattggattttagagtgagtgtgatcttctaaattatctactccagccctctcttcctatgcaggaaacagagaagtcacagagaaattaagtgatgtgtttaagcttttgtagctaattagccgtactggagttctagaactcagtttaatcctatgctagtcaatatttttgaatgtagcattatattttcttagtccactttcttttgctcataaaagaatatctgagactggataatttataagaaacacaattaattttttatagttccgaagatggggaagtccaaggttgaggggttatatctggtgagagccttcttgctgagaccctgcagagttccaaggtggcacagggcatcacatggtgaaggcgctgagcatgctggctcacgtctctcttcctctttctataaaaccaccagtcctactcccataataacccattaatccattaacctgaaaatccattaatgcacgaatggctctaccctcatgctccaatcaccttttaaaggggtcacctctcaatactgccacattcgggattaagttttcaacatgaattttagaggggacctttaaaccataatgaatatcttcttacagtgttatctctatttcctagtgctatgaattcagctgaattgtagagttgacaacataccgttgcttcagtatcttgtcctgcttgttctgaatgctttttcctaaatgctttattgttgttgctgttgttgttgttcctgcatagggcaaaatgagatgcctttatttctattaagtttcaaaaatactcagaaggatatgtgaagctatttcctacctgcttgttattctactgtgtttcccctgaaactttccatgtcttgagatgactcaataccatggaaagcaaattattattcaatttaaaaatcaagactcatttaaggtatctaaattccaatttggacagcaaaaggttaatagcgcatagaaaaaattccagcagcccacaaatctaagcataattatgtatgaacatgaggcttttattgctgtcaaaattaatcacttttcaacttccagctgttaaaacccttctggcagttctccaagcaattcccctacagttacttttccttcaattaatttctggtgcagttcacaggctcctgttacataagcagcaactgaaaagttgacttcttgggctttctttctctttccttcctttcttcctttgcttaaaactagaaaacgacagaatatgaagcttactacttttactctttcagcttgactcttaaaatctagaaacgagcagtgtggaattaaagtattagtatttattataaagcactttatgtgtgtgaagtgatttgtaataatttttattagccatttctttccaccgtcctctgaggtacgtgaatgttgttatgtttgcactctacagccccacccacttttctcccccagaaactttgcaggaaatggaatttacaaatcttcagcactgggtttaaccccgatggtatgcaccatttatttctgggatggtggctaccttcgccactcctgtaggcatacaggtttgttgtggtgggaattatctcagaaggagaagccgtgaggtgcctgaagctgcccagttgcctcaaagctctcgtggtggactgcacccccaacccccattctagaagcagctgccaagagactggttgagttctgaagggcagaggcctgtggtaaactatgccattgtgttgactatgaatcctcaaggagattgataaatgatcacagtgtatgattgtatgaaagtctgcatctttgcatttgcttggcacagaccgagtgcttgcacatgggtactgggtcagatgtgttgtctttccagtcttccttcctgggattccagaagaatagtccttgcatcctttctcactgctgtagagatctgaatgaaggccgacgctgcgcttcctagggacggggagttctaattcctctcacctcacctgcattatcagggcatatgctcttccacatctgagtgagttaagccagtttcatttccctggtttgtctcttccagctccctccaaagttgcctgccctcttcacacctggggtggagggcgccttccctgggcaccctccttctcctcctcatccaccctgcttcatgctgttccataattgcacgttaaaatgctgtaatgaacagatgcttctagtgtgtagtctctttgtaatttctgctatcatcctccattttcatgcaaaattaatgtatttccagatgctgattcctgagtctttctacccgatagtggcagtgcatgagatttgaaactgggcaagggggtatgaagatgtgtttggggcagaggtaaaagagtaaagaggtcttgcctattaaaaaaaatgtaagaatgcagcaaacaccttgtagtgcctgtttgttttatcatgaatatgcagttctgtgctaccctgtatttatgtggttgggaggagagactgcagatgcaggggaaatcttcattccattcttatcattcagactctaaagtggcttgtcattgaaaatttgggctttgaaaattcaaggctgtcataatttaggctatggagcaagatttcttgtccaagcaggagtcttgctggtcagtgggctggggagtgatttgtgtgaatttatctcagcacgagtcccctgaggctggtttctaggctgccttggttaaaaatagcctgttgatgaaatcacatcctagctcaaacctagcccaaggaaatggctcaaggcccgagcaccttactggaatatgaagcagagacagattcaccaagaagtcatcagattgtccctttactacaatttgcactgcagtgaaaaatctgtgtcaacctctccctcctctttcaaaaattagctggttagattctcacaggactgcgttatttgactccagtcagggtaatttggacaaatcttactgagccctgaattgatggtctagagtgaattgagtcaggattaaagtcaggattctctgagtctgacgaccagaggccaagactcttcctttgggaagctgccaagacatctaagagacaggctggagatcatgttgagagcaccaaggccaggaaggactgctgatgaagttttgtccttctgttcagtatttaacgtacttcctatttgtaagacattccttaaaaattgctacaggcacagtttttgttaattggcttatataacatgcatgaatattatttttcactgaaaatacctttttgtacattatgtgcttgtttccttaattggatactctgtgggtggtttggctagatttggtgttccctagacctgtagattctatcattcgaactccaaacatctcaccaaactctaccaagtgtaaattaaaaacaaatacgtatgcagtcaacaagttggggagaagaagttctgtttggcattagagtcactttgcaattggcaaaatacagttacagtaatttatattgctcttattccatctgctttctggcttaaaatgtcctggattgcctcaaactctgaatatgcaatattttccatttacaaaattttcctgcataatccattttatttttcagagaacttttgaaaaacaacattggttagtttcatatttctagagtcaagttttatgtgatatgatttttaatcttataaatggatgataaagcctgaagagataatccagggaaacttctagagagaaaatgtttgtcccatggactcagtgcaaattctgccaacaaatgaatagttcacagcagctggactttgtagaggcagagcccacatagtctcaagtaaattccttctgaggcctgcagctttctaccaccaccccctggttatgtttaaatacgttctgcctccatgcctctttggaacttcaaatttctttttggagccatggaggcatgagtgtttataaattatcttcttcactactcaattatgaaaggaggagtagaaatgagtgcacatgttgaagattataggaaaacacgcaagtttcagagtctgtatgattctgggacaggggaatggaggtgaggggatagtagctggtcctgggatttggcactcctgtctattcatttgccaggagttacactcacccacttctgtgtaccgtattagggagggaaggtagggatggaaatcatagagtaaacagtctcatcaattccagccacatcgcctgagttttcaagtgataaataggattgtttggaaggcattggcaggctcttttcatggcattaggtactatttagaagacaaatgatttgaagttgtcttcttagttgagaaacatttgcaaggattttctgttttgcctctttcaacatataacactattatttagtttagttgtttgtttgtttcctaaacagggtctcactctgtcacccaggctggagtgcagtggcacaatcctggctcactgcagccttgacctccctgtctcagatgatcctcccacctcaccctctggagtagctgggaccacaggcatgtgccaccatgcttggccaattttttttgtgtgtatttttttttgagccggggtttcatcatgttgcccaggcgggtctcaatctcctggggccaagcgatccactggccttggcctcctaaagtgctaggattagaggtgtgagccactgcacctggtccactagtttagcttttatcctacaaaactgtcttcagttgaattataacaatgacttacatttgaattctac

SEQ ID NO: 115939 - DNA, 1579 bp, Homo sapiens
ttggttttcctgcacattacccaggaatttccagtaaatgattagaccttccttctattaaaagatattgctaaatggagattttatacccctccacaatttcaccctaaagaatggatcaattactaaagcctattttattaaaataattatatttcaaaatagatatggctttatctttttatgattatgaaagcaattcatacttcttgtaaaaacattcctatttttcagaaagatataaagaaaacggcaaaaatgcccttatcttgttgtccaaagataacttctatttttctttgtgtgtgtgcacacattaatgcacatacattcatgtgagcatgtgtttacttatatttttataaaaatgagatcatactttcttcccagttcaacaatatatcatatctttccacgtcagtaaatgtagatgtacctcatcattttaaatgaatgcttattatttttcaaaatgaatatgctgtaattcatttaaccagtctcctactgataaaattaaggttatttttttttcttaaccattattaagagctctgtaattgactctttaatgcatatttttggccatgtgtctggctacttcctaagaataagttcctaggacagaggtgattagtcagttgtcctaagggaaaaagagccagacaagatgatttgatgcaacggcaagctgtgatatttgaggaagagaagagatactgagttgatcacagtcactgtcacttgaatctgtgcccagcccagctctgtggccacatgtttgggtcctagggagagaggaggtgctagctgcactgttttcagacccttgtgacagtgggtacgtgaaggagagggagttgctcctccagctctgatccaagccattatgtagctctgggtcaagccagagcaggggcaaccccagtgggcttgggacagtttgtgtgtacttttgtggacttcatggggactcccagaaacacaaagcaggggctggcacagacatgtgccagggaagtttgagtcattacttttgcatgattctatctatacccagcagcaggtaaggcctggagaaatttagattatactgtgattacttgtgggtataaaccaactctgtatgcttaatgctatgagaatactgaatgtacactctatttttaagcacatacacaaggcttgtcctttctgtcattttacagtctgagtaccttggggcttgttttgtctcacctattgtgtactcaaagccaaggtaaggcctcttggattctgttgacagccatttgccaactcagccatatgtcacttaagttctttcacctctttgtttaaaattgggtatgcaattggttctctcaaatgaagcctttcagcaatttataaccatatagagattatggtttttgtctttattcccacttgttagcacagtgccttcccacagttcaagggaatcaggtattgaacaataaagagcaaccaaatatccaaagtaggggagtgcagcagacactgtctattgtcatccaacactcattccccttcctgcccactctcctttctcactaaa

SEQ ID NO: 115940 - DNA, 1035 bp, Homo sapiens
agatagcaggagtagaaccataacgttcaatgggaaggaaaaggcttgaggtttggctgctgtaccagcagcagaaatctttttgctgtattccaggaaatgtttaaatgagtacctgccaccagggctacctcctcaggtaggtgcacctccagccttgtgagctctcagcttgtggaaggttgtctggcttcctgtgtgcaccttaacaacagccctgtgactccaagctacatttccatcgccctgtcccagcccctgccagtgtcagtctaattaaaatgttaccagcttttcatctttattgcttttgtgcattttaatacccgtgtggcagcctctagcccctcagctgctgccaaggtggtccaaatgatctccccaggtagtagtgattgctttccttaatcacagttgcatgggatttgaatggtctgccttggcccaacttttcccataagtcctattattttttatgccaagttttgcagacagcaacattttctagaaagtgtaattttaggttacagcagaaatgcctgtatatgtaaattacctggcacatagtaagggctcagtcattattattattagttcatgtctaccataccttgtccttgaaatgctgacaaaaaaaaaaaaaaatgagccaagaaaaccctacagtgacaattccagtacaagagcaaaggaacacaacttcatatagcaggttttgataatgaaaggcagaagttcttattctcttttgccaatatttttaatgacagtcatttgaagcaattcctcctgtgttttttgttttttcccagtttgagtagcttttttttttgacatggggatattttatctactcctatgtacttaaatctttaatgacattccatctctttctttttgactttagaaaatcagacacttattcttagaaatagccaggtggagagtaattatcttggccataattctctgatgtttacagaatatggcactcagacttgaaatctctgatggcctttgctggaagggatttca

SEQ ID NO: 115941 - DNA, 1050 bp, Homo sapiens
catcccagggtctggatcaaagctgtcagtttctgccctgtctgttcctaagtgtcataactggagcaaaactccttcatcagccagtctggccacatcacagacacgtgggttggacagcagaggctgcctggctcttttcaggttcctatggatacagtgtctcccttgacccactgaattcatctgtgtgggcagctgccacttctggactacaaatacacagtaagcaggcgtgtaggagagcaagaatagggtagaaagagcacgtaggaggaggggaagaaagaactgagagagagcctatgggtagaagtgggcaggaaggaaggtttggtctttttgttcctacagaagatgtttttgaaaagcttcttgacaatcaaacagacttttgaaaaaagttacttttgctaaatataaagtgtgaaaatcaccagtggaagattgcctccctttctgcagccagggcagagctcttgggtgtattttgatcagtaacttctagacacatccttcacaaccacaactaggcagccaagcattctgacatgtgcttaactaagaagcaaattaggcagccaatttgtaaaaatgtaatatggcgtcctttctcccttctgcttatttcattgataaacacacattcatgcacattgatgtacatagtaataataatattagtttacatggctgactctacagtttctgtagagcttttgcttagagcttcacaataaatgaagcaggcaaactgcattgattagatagtccatggtttccgagttactcagtagaggtgcagtctagactcaaaccccggactccagcttccaagaataggcacactcattcccacacccaaaccccccacccccattccatgcctggctgctggctaagccacaggctgctccacagttggagtgtaagggataaagaaagaggaaatgaatggtttaagttgggaagggcatcttgacaaagttgttagagtctaccagttttttcaaaccccacattagagtacagcaaataaatgcatgtcta

SEQ ID NO: 115942 - DNA, 1137 bp, Homo sapiens
cagtttccaagaacctatcaacagtgttaagtgaggacttactgtattgctatcttaatagtccctggtatgagcaatttatcacatagatgaaactcctttataaagaggtacttttagcaatttgacagctgaaatccttcaggtggatccaaaaggtacccatctggtattgcattctgttctttctataatggtctagagtaagtttattttaatagtttaactataaaatatattcacattcattattaatacatggtttatgcctttaaaacaattagtctaaggcctttgaacaaaatttaaaacattttaaaagcatcttttaaggaacagtttgcattgtttattcagttcaaaaaatattcattgagcacctatcaagcattgtctagggcagtaagaaggcagaagtggtcaagacaaggaccctcctctaaagagcttaaaccagagagaggaagtcaaataagaaaaaataaataaatgcatgtattgctctaagaactaaattggaacaagggcagagggatccagaagcagagaaagggcacttgatccagtttcagagaaggctttccaggggaaataacatcaatgccaatagtttgggagaacagagtgttgtaacatgtttccagcctcatgtgtacctccagggccgctggggagctctgacgaatatttaaacgcacatgtcctttcccactgctttgctttacccactctactcctttagccagaaaacctcctcttgaattttattcctatatcatcttcatcatccttcacagctcagctttaatgtggtgtcttctcagaagctttccttgaccatatttgaagaaactgaactaaagctaatctgaaaagcttgtaaatgcaagactcaagttctattacattgcccttgatcattcagaaattctaagcccctcagctaaatttagtcattaaaagatcactgtccattctttaatgttttaagaataagttgtactatttcctagttgactgttagtggagcctacagggggaaatcatggccattcctaaatttctccaaggcttgtgttattgcggcatcttggtctccagctgaagcccttggggaaagagataaagttgcccctt

SEQ ID NO: 115943 - DNA, 1081 bp, Homo sapiens
tgtcttttgacttcctccttgggagtagtcttttatgcttccaaagcacttctgcatttcctatctgtatccagtgatttagtctttagtgccatgagttcagggataaaaattaatgtgctcacatagcaacgtttccattttgattatgttgcctgatcctaaacaggtaatcagatatattcagaaatgcacaaggatttatgggtattatatcatctttttaaactttttaatcgcagtttttccacagttgtgtaaagtacaacctttccctgcttctgcctccccaagtgacttttctgactttattatagaattagaacaaggagtaaagcatgagagaacaaccataagcataaggagattgggtcaggatccaagggtctcctgaggatgggatctacaaaaagctgagctatagattctatctatccaccgatccatcactccatctacttactgcctaactctttattacacatatagtgggcatcatgctattgacaactccctggggtctacccactctacaaatttgtctgtctgatggatgccacttaatgttcttaggcttcctccagttgtatcagattccttttcctcatgctgccattgcaacctctgcgtatcctaactgatcatatcactttgtatcataattgtaattgttactcagtagctatctgtccctgtaaatcttgaaattcttaaagtcagactcctgttcttccctctcacatacctcccccacccccaggccatctgctcctttgcagcctggaaggacacaatgaatagctgccaatacctcactgccacaggggagagcctgtctgagaatgcaggcaactgtgaggaagggaaacaagaggtagagaagaagaaagacttcaggagggcaagggcagcctgatgcacttttgaatcttttgttcaatataaagatgatttccagaaaaaaaaaatcttagcatctactttaaccatctagtatctatttaaatttttaagaaataatactggaaatagtcattgaaaaacatcctggttaacaaaatatgacacctaacaactttgt

SEQ ID NO: 115944 - DNA, 1070 bp, Homo sapiens
gaggtggtgtattggtcagggctctccagggtaacggaacctataagatgttgtgttagtcggctagggctgtcataacaaaacaccatagactgagtggcttcatcgatagaaatttattttctcacagttctagaggcaggaagtcagagaccagagtgcatggtcaggttctggggaggggcctctttctggcctgtagacagccaccttctcattggtggacacagagtgagctttttctcttcctcttcttataaagtcactaatcttatcatgaggaccatggcctcctgatctaatctaaccctaattgcctcccaaaggccacatctccaaacaccatcacattgggggttagggcttcaacatataaattgtagggggacataaacattcagtccagaacagatgtgtattatgcagagaaagagatttatttgaaggaattggtttacaagactgtggaggctgattggggaagacacaacctggaggctcggaaaagagtttggtttgaattcaaagaccatctgctggaaaaaaattcaaagaccatctcctgtacctttagtacaggaagagcctgtgctaaatatgcgggctgaaggctgtgctagaggactccgtcttgctcaggtgggggtcacccttttgttcaactcaagcctctaactggtttcatgaggcctattcaacattatggagggcaatctgctttactcaaagtccatcgatttaaatgtaaatctcatccaaaaacaccctcacagaaacatccagaataatgtttgaccaaatatctggacactgtggtccagtcaggttgacacataaaattagccatcttaggtgggtttcagtcctagtttatggatgaagaaactgaggctcagaggggttaggtaacctgctgaaggaggcgaaacagctgaagtggaaacgagaccaagttctgtctgaacccacagtcgtgtgtttccatgatgagttgttctgagtctagagaaatttatttgaataggacattttgaaacaggaagagggcttagaatagtgagtgcctgtgt

SEQ ID NO: 115945 - DNA, 1049 bp, Homo sapiens
ttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcattatgtgtgtgggtcttcatttgaataagacacaatttgaggcattgtaaacgtgtgccttttctcgtttatccaaagaaggatcatttcagatattccgaacgtgttttatttcaccatttagtgatatttacaaaggtaattttgcatattaaataaaacttcctgaccattagagtatctctttaagcaagacaaaattcctcatttatgggttattcatagctgggaatataacaagtcacacaccatgcgatattaagacagcatactttatattggaatgaatttagttttttgaaatcctcacgtgggttatattttgacagaaagctgttagagaaggagctggagttcaatcctcttttcatctgctgacatctgctttagaaatca

SEQ ID NO: 115946 - DNA, 1688 bp, Homo sapiens
catctagacatataggtttggatttgaaagtgtgtatgcttaggaaagaagtgaaggtccttctttagacaccactgtttttgtcaggccagccatctgcatggatgtgtacgtgcacacgtgtgtgcatttaaggcaagtactttaaatatctttgcacagttcctactgaacatgtaagacctttggaagcaatattgtccagctccataccaagtttaatttaaaaaaaaattttgtggctaataagaaaaatttaaaaactatggcatcacacaaatccttcatgcttttttgttttgttttttttccttttccttctatttcagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaa

SEQ ID NO: 115947 - DNA, 1993 bp, Homo sapiens
gcaatcaggttttccaagatgaacctgctttttatgcagtgattttttttttttttttaaacagtgcagagttcaaatagctcaacagtattagcagtgaatatccttccttccgggtagttgtctctggctttgtcctggaatggccatacactattctagaatagtaggtggcatggtcaacaacaaagtgttctgttttttgtgcaaaaccattgttgctttcgttctgctgttctgaacatcaggagcatcattttcaatttattattattattatttttaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtg

SEQ ID NO: 115948 - DNA, 1464 bp, Homo sapiens
ggtgaatgtcgcgctgcgtcgctccccgcagcctccagggccgagcgcgcgggatggttggcccacgttgcatcctccccggcttggaggaaagttggggccatgcacagacaccctgagtgcgggcatgttcactgcggcggaaatgtctatagagaatgaatgaaaactgctttctgaaaaactagtttcttgatctgtcgtgttaacattattagttacaaaggataggaattggtgggcctggagatgaaacactgaatttatccacatgcggtttggtgtcacacaggcatggccagcttgttaaatagcgttgcaagtgttaataaaaagactctggcaagaagctacttttgttaacaagatctttataatgttctattgttaccggtaatgtaaatgcccagaaaaaaatctgcttagtttctcttttgattggattgagatcaggttcaaaacctggagaagggtgcgggacgctaagcattggaggcagagagcctgagttaggagcatgaagtgaactgaagttactgtaactgaagcccttttgatgttcacagtaatagcagccctttctctgtcttctttgcagacgtaggttaagtacatgtgtgcattttcttggccacttacttggtatgcaaatgtgatttctctgggggcttaaaaatgctcgaaagatgattcattttatgttgaaggtgtgttcagtgacttgtatacatggtttctgctgatattttgaggtttgcacagttttaaaccagaaagcaagtatttcctcttgggtttccaagtttactttttattttaatcaaacattgttgcaagaatgttgattgtgattttgactgtgacgtgcttttccatctgggtggtatccaagatgacaggctaggctcttccttctggcttgttgggccaacctggaacatacaggagcataaacacaggatgcggagagatgtagatcctatatcctaaggtcttctaagcaaattgttttcttaggtgtaagtctggttgtgaatgttgttttgcaccatcctgaatttaatgttcaaggaaatgtgttctgggcctagcatgattccagctcaatgtgtaagcattttggtgcctgtgcacctagtttcagggagcctcattcttccttcactcagggcagcatttgctctgagagaggcggcagattcacaagagtaagtagacagtctattgaggtttaggtttaaagtcttcctccagatactccagattgaatgtactaattaaaatagcaactacagtggtggagcattgagaatgctaatgaatgttttaaccctttggaaacctgatgcattcccataggttcatatggtcattctccaaaacactgggcattggttagaatggagtagacagtagatgcttagcttgaggtgggagtgaagctggctcctcaccattttttat

SEQ ID NO: 115949 - DNA, 1019 bp, Homo sapiens
agcaagagtggctgctcaaacggatccacaagggtctacacacaatgttcattgttttctttttcggtagggttggttttgaatatcttcagacccttctataattggtttttcattgtagccagaagagggcactattgctttacccaaattctgtgctgtggtctgtggaaacccgcatttgtgttctgtgctacagtgttccattcctggttttgttgagggtggcagtttcattcttaggtgactagcacaagaaacacacaaacaagcaaaaaaagcaaaacaaacttttgtccataataacacacatgcaaaaaattgggatgtggaaagttgtttatattttattaagccatagaaaattatgtatggaattttaaaaatgaacatgtatgccgatgacattgatcaagattctgcctggaaaaccactgtttgaaaaattagaatgtacctaggtgttcctgttcactttcaacaagtgtcctagaagaggtgtagaagaaattggtgcagttttggaaaaccccgggatgtttcctcccactattaagacagtataagggcaatataactgtggggtaaagctgaagaacagaaaataggaatggttgcatggttctttctgcagattgtgctggagaaggggattggaggtgtcaggggactgcacctttcctcttgtccttcggtactatttgagtgtgcctccatgtgtgtttactactttgactaatattaagaatttaaaaagtcaactacaaaagtaaatatgttttttaatacaatagtcagaagaaatggtttcatctcttacaataatctaatgcttggaccatttgggataattttcttaaggcaatgcaagtttctcaggcattaaataaaagaccattcacagagatcttcagtttcagagtgcttttatgctctataatcctcaagtatccctgcaaactggatattataattattaggccccattttactgatgagaaactgagtctgagagaata

SEQ ID NO: 115950 - DNA, 1059 bp, Homo sapiens
tagctggtaacccacctgtgtagtctctatttttatagtcctttgtaggtttccaagaagatgtttttaacatgtgtgtgtaggaaagcaggggcatgggagatgcctagaacactgtccacggggctgctattgcacaactctcctcctcctacacacacacacacacacacacagagaaaagtgtgcgtgggcatgaggacatgtatagatatccatatgtatttttagaaagttaggaaaagaagtacaaaaaagaaaattttaaaaatcctatggaattctattcagttataaccactgtttacttatgtacttttcattttacagaattttagccatgcttcctatattgctttgtcacttgcttttatcactgcaaataccagaaaactttttccttttataaaatattctcttaagttatgagtctggatggattaatttttattgaaccactttcttatttggggacattttaaattttcagacattttcactaccatagcctgtgataaatatctttatgtgaaaatctttttgtagacctctgattcgttcttaaaagtagaattactggatcaaagggcatgagctcttatttttgagtctgttttagtatgcactgtcccaaatgcgcttctccaagggcgtaatgggatatgtcgtgccctcccacaacgagagtgtgagcatcctgttttcctgcaggtgctaggtcctctcattaggaacagttccatagtaaagatattcatcctcttcctgccctattaattgccattgtctccttagcttgatacttgcctcttaacttggacgatgagctggaaaattttatttgttttgccagatttttttccctctctccctccttctgacactcttcagaagtcttaaacttctctctgtaaccctttcctttatggagtccttttcagtttttaagctttcccagcttgaaatcagattatcgatttccacttttcttaaatttgtttttttatagttcatttttatatttaacataaatctatccagaactgattttggcatact

SEQ ID NO: 115951 - DNA, 1003 bp, Homo sapiens
aaacatggcctatagccaattaaattgctataagaatgtgccagactcacatgaataataatgttgtaattctgctaaaaattcctctgttcccacctatacaaatgaaatatttacttccctgcttctgaatgccaactccattcctttggagttggtgtttctgggtggttcatcctcacactttgagtataactaaattctgacccttttgattattgtagattgacagaacagaatccactccagctagctttaggaggaattaactaattacagagtatcgagtggctcacagaatccttgtgagagctgaagaacttggctcttggctgaaatttcttgagtaactgctcttgtcatgaccaggaagctgcatgccggatggagaagcctctgctataggtgctaactctagaattacaccatttcagctccagtctacacagcaaagggatacgtcatgccctgtctcagtctccacctaactcacttctgaattcaaggctcatgcaatcacatctaatgagcagaaactaaagaacatggaaccccagcagcaagggagtctgggaagtgtagttgccagcctctgttctaccggaggacacactgggaggaggggagatggatggatgcctagtgagccacttcagcatccccatggacagtgatacaatttgttgaggtgggtggacagcctaggacctgggcagacaagcaagcaaagctgcctaactcctgcagaagtgggaacattctgtggcagggacggagctcctgaaattagatgatcacatttttctactctcatgacatatccataagcaacccgaaatatttgtgaattctgtcactgcaattatgaaaactgagattgagtgccatctggcaagggggagctaaactggcctgtccagaagggcaagaagacggcttggagttaaatctgctctggcaactggcaagcatttctccctgctttgctaaaattagccacaaa

SEQ ID NO: 115952 - DNA, 2145 bp, Homo sapiens
ttacccaggctggagtgcagtggtgcgatctcggctcactgcaacctccgcctcccgggttcaagagattctcctgcctcagcctcccgagtagctgggactacaggcacccgccatcatgctcggctaatttttgtatttttgtagagtcggggtttcaccaatttggccaggctggtcttgaactcctgacctcaggtgatccgcccgcctcggcctcccaaagtgctggggctacaggcgtgagccaccacgtacggccagcaccgggcatttttcttactttagccatcccgtgtttgaggttgctgtctgggctctgctcctacccgagggcacccctggaggaaattctcgaggtgacctggacagggcgggctgggcgaggacgctcccggggcctggaggcggagtcgggggcgggcgcgcgcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctcttggtgaagatgaccccgaacctgctgcatctcgccccggagaacttctacatcagccacagccccaattccacggcgggcccctcctgcaccctgctggaggaagcgtttcgacggtgagcgctcccggcccggccgggagttgtcctgggggaggggagaggcggaccaccccggagcgctgtgcagaccctcaccaccccactgcgcagacgagaaaccgcctgggagctggcaggcgatctgcccagcgccacatggactgaacccacgctcttgcccccaccctcctactgcttcttaagggacaccttgggtgctcaggaaccctggtttgagagccggatagtaagtggaagagggagtttgctctgaggccttgttgggcaaatggcatggacggaggggacaccggagctggggaggaaagtgacagctccttatttgaaggacgtgcaaagggataagttacccgaagggcttagacaagctctcttgagggaccaggaatcccccaaagctgactgtcatttataggccagtttcgccccctcacctctcctcacatctcctggtaacagctcaaatggcagaagtcctcagtttcgagcactgcctaaaactgccctctctcctaaaatctcttccatataaaatgtgacatgtttgcatctgactacgtttctgcggtcagtggttaggcagtatccaactttgtttctcaacaccgatcatgttgcctgctctccctgcttcctcttttacagacccctagatagcgcctctgtctctctcaccctttggctgcagacagggtgagttttgtcatgggagtcagccaatcacaccatagacaaggcaggttcccctggggagatgtttgaagacgccacacactgtcccctcagtgtgagacctgtgtaggtgggactgtcctgaaggcgtatcgtgccctgcagaattgtaatttggtgctaactgtactgcctcctggcattccccaagcctgtcgctgtacccagtggatactatagagcttaagtgtgcttgcaggaccctgaacaggtggggagggaatgtcaaactaactgaataatgtgttctgaccccagataggacaggtgcctaggctcaagctgcagaggcccaagatgctgatggcagaaatggttcattctctacaatcagaaggctcatggtttccttctgttttgtacaactaaatgggtattatcagtctctattttagacacacacactaatgagcctttggtatccaatctgctaaggccagagtggggttaagatgtagaaccaaagtgtttggttgcattgggatattcagaaagattgcatggaaagtacatgaaggttgtctcagaagatcatgactagggttggaaatctttttaaaaa

SEQ ID NO: 115953 - DNA, 1119 bp, Homo sapiens
tggctcaacagtgttaccagggatccatattctttccatctctgctctgtccactttagtgtagtggcaactagtccagctctcacatacagagaaacgaagttttcttgtgatttgctcagaactccccctaacccccacatcctatcactggtcagaattggtttttcattcccaagagtgatggattaccatgatggtttcattattggttcttaacggggcttcatatgtcacttcagagtgtggggaagcatttaaaattcccatgcctgaatcccattctaatagattctgattctgaaggcatggacgttgggattttcaaaaaacttcccaagtgattctaatgtacagcttggggtgagaatctctagttggacttacaatgggcagcatggatttgaggagttaactacaatgttactagcacatctgttttaaaaatttggctaaaatccttctaaaatgtgtttacatttatttctcaaacagatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttgtaagtacctatgcaatgtgagtgtattatatcccaggtgctcgctgacggacttaagtgccaaaaactgactccatgctaggaaccactgagttctcaaccagtgagtttatgattcctattttaaaaataacctttaaagtctgattataaaagtagtacatagtctttgtggaaaatttattaagtacagtaagtgcagaagaagaaataaatcactcataatcccagcagatagaattaatcactgtcattttaggtgtatttttttgcagagtaaaacatgtaaacattttacatagacataaatacaaacatgataagcattgacatgaaaatggcagtaattctgtacatgtgcttcttgtatttttgttgtatttttatatcatgcttttttgcaaaatacattataaattaaacatgaatttcactagttttctgtgatatcattttcaatggctgaataatgttctgt

SEQ ID NO: 115954 - DNA, 1051 bp, Homo sapiens
accaaggattagtaggaactgaggaatgtttgcactttcaactaaactcttagcttaactaggaccctactctgttgaggagaagttggagagactaactcttttaggaaaatgaggaaacatggagttgacacccaaattcccgttctgagtgactcaagtgactggatggtggtgctgtgactcactgaaatgaggaacacagaagaccagcaggttgaagtgtgcggaggagggagggaagagttctgttggggcatgtggagtcgaaggaacctgcaggacatccaaatggagatgtacaggaggcagttagagaaataggtcatgtgcttgggagaaaataatagtccagaaatatcaatgacatgtttaggaaacttattgtgtgtcattgagggattaacaaaagtgtgtgtgtgattttaaatcctcaatacagatactttacttgtgaaagaaccagtggctgtccttaaggccaacagagtttggggagcattacgaggtaagttccatgcagtttcattgttactttccagtaaaggaaaattttcagttggtgctttgtgaaattaagcacagcaaaactttgccgccttagatcctttacagaatgctttgttatgtagttccaaaatgatttccattgaacatgtactacataaagcatgggagaggtcagcacagtggctcacgcctgtaatcccagcacttcgagaggctgaggtaggtgatgattgcctgagctcagaagtctgagaccagcctgggcaacatggtgcaactccatctctacaaaaagtacacaaattagccaggcatagtggtgtggacctatagtcccagctactctggaggctgaggtgggaggattgcttgagtccaggacgttgaggctgcagcgagcctagatcacaccactgcattccaggctgggcaacagagcaagacccctgtctcaaaaaaatacaaataaataaatacagcatgggagaaaactcatttgacctctcaaaaaatgtttgaaggttattacattcctgcagtg

SEQ ID NO: 115955 - DNA, 1704 bp, Homo sapiens
caagaagtccatattttctgtttaccatcagactttcagagtaatgtactctaaactgatcattattgaacgtaatgtcacttaacagaaactttcagagttattcttcccagcatgaacctgtacttgacgaggttggagagacaggaaggcgtagcaaagatgactgaactgttcttaggttaaaaattccctggctatatagctgtcagctagaatgaggaatctgaataaagtcaaggccagttagaagaattagcctgtcaactagtatattaagggaataatccacttgagtaaaaaatgttcagaaggtagtctttgcagctataagtaaaatgctgtatattgtaaattggcctttatttatagtttcatggtttttccagccatttttccctgttgcatttagataccttctaaaagtgactatatttgattataaaaattctttctcatgatgccataaatttattaaggaaccagtattttattaaattactattcttcttttgtctatattgaaacaacccccagggtatgggtacaatgaagtaaagcacttttattagatgagtagagaagtgcaatggatttttttttaatttggctttgattttagaaattatggtagagggtgtaggtataacaatatattttagaggatagaggtataacactatattcaattatatttgccttacctggttatgagtctgtttgaataatataacttttatcatctcaatttgttgatttataaattaatgcaataaattttactttcctcaggtttagagacctttagccagttagtttatcaagattcttatggaactgtaagtatgattattatatgttactaaaaattgttagacaaattgctaatagaaaaaaatgtaacctgtttagctattgcttcctgaagatttcatttccccagatatttgtcttagccggtaaatgtaaatttcatacatttttgttgttctaaattaatattttatgaaatgcttgtataaatagatttagtcttcattgagttcaagacaacagaaaattctaaaactaaatcaaaattttattttgtcatagttcaccatcaatgaatccaccattattgattctccaaggttttctcacagaggaattttgattgatacatccagacattatctgccagttaagattattcttaaaactctggtaagtaattacttcattctaatctgttgtctattctgaagatgtctcctttatgttgtaactttatgttggttactattgtgtagtttggaacaggggaatttgtataagcactgggcattctttcctcagttcctagggaagtgtatttcctcagctgtgacgtggaggtccccttgagaatcaccctcctgttttcagtgcgagagccacgtataacatgtatttagccaagactgttaagagaaggacagtttaaacactgcccattggccctttacatatactcccatttgtcaaatcatgtgtctagacttttgattaggaatacatggccacccaggtgcggtggcttacacttgtaatcccaacactttgggaggctgaggcaggtggatcacctgaggtcaggagttcgagaccagcctggccaacatggccaaaccccatctctactaaaaatacaaaaattagccaggcgtggtagcgtgcgcctgt

SEQ ID NO: 115956 - DNA, 1342 bp, Homo sapiens
gaagtcataatctttactactttatcttcttgggccagtacatgtggttttaatttctatagctttagcagtttttatttttgtttttgtttgtattttgaagtcttaaacttagggaaaagttgtaaatagtgtgcaaagaactcctatatactctttacccagatactccactttaaaatttttattgtatttattaaatattaaatttatttaagctatatatttgctttattctccctctctaaaaatacgttttctaaaccacatgggcacatatgatgcatcaatacccccttaatatttcaggatgaatttcttaaaaaaaggacatttaataacttcagtacaaccatcaaaatcaggaaattgacacaatactgcatctaatacgcagaccccattcaaatttcgattgttccaacaatgtcttttataggttccacatcccatccaaaatcaggtgttccgtttacttgtatgtctctttggccaccattaatctgcaactgactatctttccttgtctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccttgtcttttaagaccatgacatttttgaagagtataggccagttgctttgtagagtatgccttagcttgtccattttccagaagataatattcagttatgcatttttggcaggaataaagcagaaatgatgctgtgttcttctcagtgcttatcaggtgacacaatgtcttatttatttcatttctggtattgttcacttataacttgcctaagatgtcatctgccaggtttctccactgtgatgttaattaaaaagcattttgtacttaacaagtaattaagtatcttgtgggaagaaatcttgagaccgtgtaaaatcccattcttcatccagcgttcactcactagttttagcatccacagatgattcttgcctaaatcagttattactaaggtggctaccgagtggtgatgcttctaattccatcactccttctatcatttattacttggcatttcagtgtaaggtagagcaatcccttctcttttatttaagtatt

SEQ ID NO: 115957 - DNA, 1148 bp, Homo sapiens
cgtaactaacctgcacattgtgcacatgtaccctaaaacttaaagtatgataataataaaaaaaagaaatgctttaaattttaaaaaaaaattcacatttctccaactgtctttttctcttatttaaaaaattattttaaaacatttgcagtgggatacaaataagctccataattgtggtgagttaatatgtctagtaattcttttttgatctacaggtctgctcttcccacctttttctcctgtaattgttgttgaagaaactgagtcatgtgtcctacagtttcccacagtctgggttttgctgattgcaccccacagtgtcaattaatatgtccctgtatttactataaactggtagttgaatctagtcttgatagaaatttgatttgcagtgctgggagacaagactgcttttccgcaactgagcacttataggccatagtttgagaaatgtgctaaggaacagctcacaactttagttacaaacaatattgagttctaatttttcaagtgacctataaagggactgaggtaatcattaaaaaaaaacaagtcacttattctggagtctatatgggaatttttcaagcttatagtaattcaagctgatagtcctttgaaggacaacagctatgctttgtaataaggtgtgcattttgactctaaaattgacaagagcagtgttttcggaagtttcactttggagacatttgttttgttgtattcttacatggaagttgaaacagcatgatagtagaaactcttgaaacaggaggcactgatggagacagatatttctaccagtaaatctgcggttagcccaaagtatactgagaatttattgctaaaatatggtaaacaaatgatttgacaaaagccccaaaatggctatcatcctttgagtatgtacgacttagtagaaattttctttctgaaattttctactcctgaaactatggcactatattatttttaaatgagtcatctaatatcacatgaaactaatacattgtcatagtgaaaaaattagctgtcaaatatcaaatgcaagcacaattgttaacaatttccaggatcaaatctacgttgtacattttaacttgaataaatatggcttttacagggaagctattctttgtctcatg

SEQ ID NO: 115958 - DNA, 3199 bp, Homo sapiens
ctcctcatgatcggcccgcctcggcctcccaaagtgttgggattataggcgtgagccactgcgcctggccaggagttgtattttataagttgcaaaagtgaatatttgaggtattgcatttcttattttatgacctagtgtttgctcattttgttcttaattgtgattggcctatcagtaatactattgacagatacaattcaatagctactctgtgtctattgtgagcaagtcattgtgattaggtactgcctaaagtataaaaaagggaatgaaagaaaacaaaaagtgattacaaaaagtagaacatgataagtgaattcaagaaatggtttcatagatgaggtaacacttaaaatgcttttgagtgatcacagaatatattcatgtttctggtagaggaaatggcataaggaaatgtgtgcaaaaagtgtaagatatgcttgacaagtatgtagctggagtagagtgtagcagagtaggaggcattatagggtggtgattaagaactttggctttggagccagacagcttgggtttgaatcttgcttctgccattataaactaggtgaccttgggcaagttacaatatctcatcttcagtttctccatctctaaaatgagaattagtagtagctatcatgtaatttttttgagaattaaataatgtaaagcacatagcacagtaccaagcatttataattgctcaatattattagagtagacatggggaatagtgagaggtaaatctggaaaagcacattagcgggcctttggtgaggaatgtgaacttcatcaggacacactggaaaccagtgaaaatttctgagcagaggagtaacatgatgggaaccacactttgggaaaacctttgggaaagtgacagattggagttctggaccaggagggtgatagtgggaatgtaaaataatggacagaactgagagacattctggaaatatccatagaatttggcaactgatggactccaggagagaggaggtatatactctaggatgacgatggtacccttattagaatacgaaaatcaggagaagctagagaagggagcttaaggactgcagatgttgttttttgttagcttgtatttgaagtacagctaggatattcagttgtatccagcagggaatttgaaatatgaattgaagctcaagaaaaagcgttgaggcaaactgaagatttgggagttactaacatttgacatagataaaatctcagatataatgggaaacaaagaggcaaagagacaggattcaggaaacccttcttatctggaagaaattactagctcttagtaaacatgttcatcttttgtgtataaaatcttgtagcttcaataaaatgacgtagtaaaatcatgtggaaaaccagatctttataatgagtacacttcttttaaaaagaatcttaatattttcttctaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttggtaagatgattccttaaaacccctttaaaaaaaaaaaaaagagaggctgggtgcggtggctcacgcctataatcccagcactttgggaggcagaggcaggcagatcacctgaggtcaggagttcaagaccagcctggccaacatggtgaaaccccatctctactaaaaatacaaaaattagctgggcgtggtggtgggtacctgtaatcccagctccttgggaggctgaggcaggagaatctcttgaacctgggaggaagagattgcagtgagctgagatcatgccactgtactccagactgagtgacagagtgagactccatctcaaaaaaaaaaaaaaaaaaaaaaaaatggaataaaaaacctgttgcattgaagtagctgtagagggctccacaccataaggaagacttaagagtaacatgcctgcttgtaagggtttaaactgggcaacatgactcctgagatggtagatttgtggagaatgtacattttggtatggcaaagtaaagcttgaggaaaaacaagatgcagaagaaaatggagattcaaaaaaagactactgtgaaatgagaacacctttagtgaaagagggcaatcaatgattaaataggaaagatttttcaaataaaaattctctctgcaaatagctttagatggaggagaaaggtggtaaggtaaagaaagccatttttaaaggaaatcagcttcttgaaaaaattgtttgcaatggataattaagataacttgtaattaagtttttaggcttctttttactacctacaaactttaatagttttaagtctgcacaactgatgttaggcatgtatactgctctaaataataaactgagcatatcaaacttctaatgaaattttaatcactttttgcttcagggaatcaaatccaaaaattcaagatttcatgaggcaaaaaggctttggcacagattttaagaaactagaatctttctacattcaaaagtaagttgtttgaaagcctatttctgtattaatgctttttgtaaaagtttatttagtaatgtgctttattttttacattttctctacatcctttgcctaagtgtagatgtgaaaaatcactaaaggaggcaatacccactgcttgctttaaatcagtaacatggtgactccaagtattttccaatagctgttgaaatataggaaggcagtcatctgttctaaaaactcagattgggctgggcatggtggctcacacctgtaatcccggcactttgggaggccgaggcaggtggatcaccggaggccaggagttcgagaccagcctggccaacatggtgaaatcccatctctactaaaaatgaaaaaattagccaggcatggtggcaggtgcctgtagtcccagctactcgggcggctgagggagaatctcctgggagatggaggttacagtgagctaagatcgcaccactgcactccagcctgggcaacagagtgagactgtctcaatcaatcaatcaatcaatccatcaataaatataaaactcagcttgaagccctggctaccctgtgaagtcttcactaccatccag

SEQ ID NO: 115959 - DNA, 1682 bp, Homo sapiens
cctttgcctgttcagctttttgtgtgatgcatttaagtgttatttatctgcagagcacctggcattatgtaaatatctgtaaatatttgtggattgtcagtaactgttacatgtaatttatgtgatatgacaggctagatcgtggtccctaccattttaagacagccataaaattgtaagagattgctgtttgtacaatttcctgagttgcctaccaactcaatttgaggccacttcttcctatcttaggggcatgtttaactcattcattcagcaaatgattattaaacccccatactatgttaggttctgtatcaagtgctaaaaaggaggaactacttgtgacacttcccaacttgagctgcttctgctataaagctgaactatactaaaaggcacctctcaaaatgcaagaaatccttggtagaaaatgtacatgttttaaatatattgttaagcttatgatctaaaataactataatttttttgtaatactagggttttggatattattgcaaccataaacaagggatccattgtctggcaggaggtttttgatgataaagcaaaggtgagcattgtgaagactgcatctgatcaatataagagacttaattatttttcttggggcaactgggaatttgcaagtctaactactagtattacctttctagtgtagttagtgaccactttggacctcatagttccaagctaggtttggtagaaataagactaaaatgcaagtctcagctttagttaactgaacctatgtggtatccatatataagcaaaagttaaatattcaaacctaaggttgatgaaacttttaagtccctaaaatgagtatcacatggcactaactctgaagaaaagaggaaaaagaaaatgcagattttttttaaggatcttagaaaattatgttcctagtaataatgccttaaactttcaatttcatctactgttctaggcctaataatatgtattgcaatttgtaacgttaatagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtaagtgaagcagttggtccaagtgttgtgggttactgtgaagctgatggtaagtgaagcaaccattgttacctttgttttatgagttttcttccctaacctcccaccccagaagtctttacctagatattacctaccaactatcttttatgtttgatccttgattttatgtgtttttttaagttcagtatcattttaaactctcaagaaaccatacagttgcctaaattcaagaacttcaaaagtattatagatccccttagattttatctccattttcagtgatggctcctcactctctacattctaaaggtatttgattgcattaaccttacatgccctcttctgaactgcttctccaatgtaagacacctaagcaaagctatagttttagttcagtggatttcaggctgtgttgtcttaggattctgaggagtagaatccttggtggatgggacaggagggaacatctgaagggtggagcttcaggctctcagatcccc

SEQ ID NO: 115960 - DNA, 1050 bp, Homo sapiens
taggtgtcttacattggagaagcagttcagaagagggcatgtaaggttaatgcaatcaaatacctttagaatgtagagagtgaggagccatcactgaaaatggagataaaatctaaggggatctataatacttttgaagttcttgaatttaggcaactgtatggtttcttgagagtttaaaatgatactgaacttaaaaaaacacataaaatcaaggatcaaacataaaagatagttggtaggtaatatctaggtaaagacttctggggtgggaggttagggaagaaaactcataaaacaaaggtaacaatggttgcttcacttaccatcagcttcacagtaacccacaacacttggaccaactgcttcacttaccgccaaaatcaagaggttccactttatagtatttcctccaatcttgtccatagctaatcaaatctaagtaccaaggagcagaaaggattacagggaagccagatgctgtgactctactgagttcctcaggatatgcgctgtctttccatacttcaactattgtgcccggcgcaagctattaacgttacaaattgcaatacatattattaggcctagaacagtagatgaaattgaaagtttaaggcattattactaggaacataattttctaagatccttaaaaaaaatctgcattttctttttcctcttttcttcagagttagtgccatgtgatactcattttagggacttaaaagtttcatcaaccttaggtttgaatatttaacttttgcttatatatggataccacataggttcagttaactaaagctgagacttgcattttagtcttatttctaccaaacctagcttggaactatgaggtccaaagtggtcactaactacactagaaaggtaatactagtagttagacttgcaaattcccagttgccccaagaaaaataattaagtctcttatattgatcagatgcagtcttcacaatgctcacctttgctttatcatcaaaaacctcctgccagacaatggatcccttgtttatggttgcaataatatcc

SEQ ID NO: 115961 - DNA, 1265 bp, Homo sapiens
tttaaatgccaagaggtagaaattaaaggtaggcatggtggtcacagtccactaaaaaactagtattccaacttctattccctggcacactactaaataggcaaccagggatttaaaaaatggtttctggtgtccaggtaagtttgcataaaaccaaaataaaactgtttaatactggcccactacattaatctatggtgctaacacgtgctgtgaaccgtgggtcagggctggggataaagtttgcaaccatttttttggggggtgggggaagaggaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggtatgggatttacctgataacatttaagaattaaggtgccttagctttccttctctgtctaaacacaaaagtgctaaacataaatttaaactgcttgcggggggatgtgtgatttaaattttaggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacagacgtggaatagctgcacaacctctttatgctggatattgtaaccatgagaacatgtaaaaaatggaggggaaaaaggccacagcaatctgtactacaatcaactttattttgaaatcatgtaaaataaga

SEQ ID NO: 115962 - DNA, 1048 bp, Homo sapiens
tcaagccatgaatcctcaagatcaaaatacactgctcaaccggagaagtggtttgacctaaatgttttagtttttggagagaaattcaggagcacctagctacttcattttcagtaagaacaatttttattgctttatttattggacgaataaagtactgtttcagtacattcagagaactagataaaagatataacttaagctttgatagtggcactggagccacccgttttaatttatataatgagaaatgtgctttgatgtttaaagccactgtacctgaatcatgctgttcatctatgaagttattactataagtagccttcagaagagtggtatcacaaagttgtgtttcttttgtgtccttaagcttgtctcacaagaaagatgccaggcctctaaatgtaataagatagagggtcaaaggttcaatcaataaaaatattttattcaaaaaacagtctaatatcttattttacatgatttcaaaataaagttgattgtagtacagattgctgtggcctttttcccctccattttttacatgttctcatggttacaatatccagcataaagaggttgtgcagctattccacgtctgtagataacatgaataaagatattttagattgatttagattgatatcattcataaagatattttagattgatattcatgtcatcttagaaacttaaattagaatcactaaatcacagcattactgaaaataagggaagaaaattaaagcaactcaagatggagttctaagttacaccaacattttttgtatctataaaacagtcacaagtctgaatatatctttacaggtattattacttacaaaaaaataattcctggtttcttctaattactatttgttaggtaacatacatttctatttatagcaaaagaaactaacactgaataagaaggttaaaaatcacactggacttaatagatttcttactcgaccatcctgcagcggtgccttgtcagtctgtcataggcgtcatccatatctctgacatctttggaactccagagtct

SEQ ID NO: 115963 - DNA, 1068 bp, Homo sapiens
gctactgtaacctcaagattcatcagaggctccaaaacttgcttatcagctttcttcagagcctaaagaaattaaagaatgttaacttatctttcataaataaaaacttaaaataaatacagcctagagctcatacaaaaagacataagcttgctttaactctctctttaaagataacgttttataagatggcaacaactataatatttgcttgtataataagcatgataacagaatttatagatcttttgtatggtatgatgcaaggggatgtttataaaaaatgcctgtgaacatgtggtcagagtcacagaaagtcctcccctttcaaagattcatttgttcatatttaaacctcatgtttctgttcctgatgtctataattacagtccatgccatgccacatgccagagacagcaataaaggggagagcttaaaaaaaaggaaaaatttagtgcaataaggtagtagaaacattatgtaaaatcttttcttatttagaatcttagatttcaaaggccaagaagaacatgcataaagaatgtggaaactgaaaatgtctttcagaataaaataatggaattgaaaaggatgtaaaaattaagagaaaaaaatcctaaaaaagattgaattctgcatatctaactagggcataccatgctcacagaactgttcttagtcctcttttcacaatcttttcctgtcaatattacctatctggagagcttcaaaaacgacttcaacatggcttcctcaaaaacgttaaatcctatgcagcccatagtttgagtgctccagtcctgtactccattggcctgctttgggatagtgtctgaatatccggcagctctccaacatgtcccacactgagctcatcattttcttctccaaacacttctatgcacatccctttttctgatgatgacatcagtagtcttcagttcacctttgacttccttttccccaagtaagctgtaagattttttttgtttttcccattcctattgctggcatcctaggtcaaacttagtccatttcctgtcctctactatctcttccctattcaaa

SEQ ID NO: 115964 - DNA, 1046 bp, Homo sapiens
tcattaaaagaattaaaaacacaagagctgaaacatgttattgagccactcataagttagaatgaaaaaaagtattttttcttttgaatgaaatgtgaattttgaaactgtttatttttgagtgtttaaatgtgatatttattgtaccctatcttcacataacatgatttatgttttcagagagctcacaatctaaagtagaattgacccaccaataatagcttgcaaacacactcaagcttttcttgttttttgaaatctttctaaaaattttcctacttggatttctcatttttcccttaggattttgtttaatatggatttaatttatttgaagaaatggtaactcagatttacatattttatttatgatcagttcctctgttagactatcaaggttaaatcacaagtatattcatttattcaagaaatatttttaagcacctgttttaaccacttttcttgttgctggggatttagcagtatttccaggggtaatgcttatatggattttacattctagcgaataggagacagataaactaataaatatctaacatccagatagtgatgagtgttaaaaactaagccaacaaaatgatgaaggtgtgatgaggagtgctggttacatggctggttagagaaaacctctaattttgagcttctcgccaagaccagtacacaaaataaatgctcatttgtatctctgctctgtagctacagactgcaatacatagagtgacactagctcagacagcagtgcctgtgctttgtggaagtgccctgaaaaacaaagggatacagcccttgttagatgctgttactatgtacttaccttcacctgaagagcgtaactatgaatttctgtaagtatgcaatcacatatattaaaattctatagctttgaagaaacaagtaggcaaatacttttatgaaaagtagttaaatcaccatttttgaataatagtggtgagtgttattgcaaatgatgtaataaggaatcatagtaatttttgcttgaaaggaacatttttcatctcttgtaa

SEQ ID NO: 115965 - DNA, 1048 bp, Homo sapiens
tacagcaacattaattctcttagtttgactgtcttgggagatctggtgaacattcagaatattagaggaaaaccagatgaaacttttttataaactaaaacctccagatttatctaagaaaggccaatccattgtatgtgctatcattgtaagttgcacattttctttgatttcttttgagcacactgatagcatttaattaagatgctttatcaggatctggctttctgtgaatttaggaaactcctaatagtatctttagttttccatttcttttcctttcaaagaaaaacatttttctttatctctttagaagaagtgaagagttgcttggcctaggtaaggtagctgtcttgaaatatttgaatattgtctgtttatggtgtttggacaaattaatagttaatgaaagtaaatgcaagttatagaactctaaaacctttctttataggttgcagatttggatgatgaatttgctgacttggttttagaagaatttagtgagaattttgatttgttaccagctgaaaaggtaaattttattattcaatggctttcacaaaattttactaattggatgtagtttgatttctctgcctttgatgtgtgtgcattttttttttaaactttgcatattattagaaagtggtaagtttaaagttaggagaacattaagttaaagtcactactaatacaatacttattggcagtgatttattactttcatatatactttacaaaattaaaaattgaatctgtttaacttctattgagtctgcatcagttaactactcattctctgtagtcttttcattctgataattcctctaaggatgtttagggaaatcacagaaagtttatattaaaatttactgttgtttcaggctactacaattaccatttttctgagaacattattttctgaatctttttaaatttttcatggaaactcattacagttctttgtttttgtcttttgacatacagtaagccagagaagaggcaattaaaatattgatagtaactgaattatgacagatttcttgaa

SEQ ID NO: 115966 - DNA, 1593 bp, Homo sapiens
tgaaaaattccttttatggcaaagttactaatctagctgaaaaactttttctaccatgaggatttacttagtgaaagagtaaaggctctattaaaccaaatattttaggaaagatttttcttaaggcaggttaaactgtgtcaggtagatattgagcacgaataaaatacacttgctattaagactaaactgtatcatctttttcctggctagatgttgatgatggagacacagtgacagatttcatggcccaagagcgagaaagaggcattactattcaatcagctgctgttacatttgattggaaaggttatagagtcaatctaattgatacaccaggtatggtacgattccagtaacacagagatgctgcgtcatttggagtttttttgtttttctggggtttttgttttgctttttattgtggtaaaaaaacatgtgttgcaaaatttaccatctcaaccatttttaagtgtacagtttagtagtgttaagtataatcacattgctgtgaaacagatgtccagaacttttttatcttgcagaaatgaaactatattcattggacaacaattcccttttgccccctcccttcacccctgctaaccactgtgtactttgtatacctatgtatttgactagcttagatgccttatgtaagtggaatcataccgtatttgtcctcttgtgattggcttatctcattagcataaagccctcaaattttctcatattgtagcatgtgacaatgtgctacaatattttcttttttattctgtgtagtattccattgtatgtgtatatcacattttgtttatccattcatacatcagtggacatttgggttttttccaccttttgtctaccagtgctgctatggagggtgtgcaaatagctctgagactctgctttcaatacctttatatatatacacatatatatacacacacacccctccccaggagtgagatgtgagattgctggatcatatgatggttttgttaaaaagaaggcattatacgtcttatctttttcttaggtcatgtggactttaccttggaggttgagcggtgcctaagagtgttggatggtgcagtggctgtatttgatgcctctgctggtgtagaggtaaataatattgccaaagtaaagggaattagaacagcatgattttttaaaaagtagaatatgtcaaatttagttaactgtaaccatctatttggtaagttcacataaatcaaataatggtaaaaggaaatcagaatttatattgagatgtaatctacatgtaatctcagatatttcatagtaaaaggagaaataggaaagctggtgtcaagaactttgagagatcagagattctaccttacttttgagctaacaagttagcctgccatagtttaatggattctggcagaagacactgtggtgtgagattgattatacactgttatttctgtttctttctgggtcactttatttcctaatagttccatttttctgttgttgtaactttagataaatttgacgtttaatcattcaaacagattgcattacttacaagattgaaatgtgcttgaataggaagttgct

SEQ ID NO: 115967 - DNA, 1054 bp, Homo sapiens
cttttatatattttttacatgatttagtttttacatggtatggtaggaaaatcagagtatacaaatgaatcaataaattttactgccaattagaaattaccaagttaatatgtggatgcttagctttttatgcttaattctatacatttacataacaatgcattttggttgatacaatgttttgtaatttcaataagttgatttctactgtatcgccatatctttctttaaacattacattgacaaataagggacattttaaacctaaaaaccatatttctcatatttaatcagaattttccattttctgaatgatgcattgaatttttggtagctaaaaatattgttccaactttttaaaagtaatacattttaccatacatattacatatgtctaacttacatatgccttgctgacatgtaatacataagtttagttttttgattttgtatatttattttttcagacagtaacagtttggaggatcaagatgttgaccaacttgaggatatttgcaatgagtcatcagacaatacccagtgtgtatattaatgtaagcatttcttataaaattaagtgtcctttaacaacctcagctcctttactgcctaaaatgcccagtatatctcatcagctgttgattccaaatttagttgagtcataacctttggaaatcttcaagctaaactaatttgaaagtaattaccttaatttattaagaaatataagaggaaattaccttaatttaaaagtaaaagaacagctgtagctaaatactggtctcatggagtactaaaatgccagttgtttttgaaggaggggtagggttttatatctaagaatgtcatcacttaatgcacatctttaaactactaacaaataatgtgctttgtaatattaagtatccatggattgagactcttatgaaataaagtttctgttaatatcaaagtacaacataattatacaatggttgatacaactacttttggctgtcttctgcagagctgttggaagccagcttcttcggcagtctgatatttgtctcaggaa

SEQ ID NO: 115968 - DNA, 1261 bp, Homo sapiens
agggaattttagggggaaatggaaattctttgtattttgattgtggtggttacagaactgtgtagttaggaaaaacttagaactgtatacctaaaaaggacaggttttactgtgtgtaaattatgcttcaataaaactgacttaaattttttaaatgtgaaatgaaggtgttattaaaaaagcaaattatgtcaaggaaaaaagatactgtaatcagttcatcccttttgtggtccagtagattttggaccattccctaatgagattattagagatgtaagccctgatgcctcatatcattcaagaccaaaatttaacttacatcatgtgaataaacttaatggtgcaagaatcatttaagtaagtgaacatttggatgaaacagggtctttgtgctgtgtaaaagaaagcattttagaataattgtcagtactttaaaaaattaaaataatatttcttccatcattatagccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagacgtaagtggtctcatttatttgtcataacaagttaacatcttttgagtaatcattattaaaacagataatcttgaatcttttttccttcttggtagtatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcggtaagcaataacaattgaagtctttgttttgtttaggagaattacttaaattcaaatttgaggttcttgtttctcggtttaatttcaaacatgaagtacagctattattcccattatttagatgttgaagtctttgtaaatttaataaaaaacttgctttctcatcataaggttttaaaatttaagttataaaaaaaatttattagaatgccatatgaaattaaaaagctggtaaggagtgaatttcaaattcaatatttgtcttcctgtttgaaaacccacagtgctatgcagtcataaagaaaaatacaaatgcttcttatttgtgctgccctgtagtgccaaacttggttaaa

SEQ ID NO: 115969 - DNA, 1037 bp, Homo sapiens
gtagctgggattacaggcgcccgccaccacgcccagcttattttttgtattttttagtacagatagggtttcactacattggccaggctggtcttgaactcctaacttcaggtgatccacccacctcaacctcccaaagtgctgggattacaggtgtgagccaccgcactgggctaaagatttttgactagtggaaaaagtactaaataacttctgtcaataaaataacaaaaattgcataaaaatatctttcaacctgttccacatcaatttaaagaatttcaggaaatgataatgttctttatccgatttaataaagtcaactaacatttcggtcattacactcttccaaggacttaccattggcctgatgaatctttcatatttaggtggttttcttgtaaagccatctccaacaaagcacactttagtaaccattctcttccatgccttcttctttctctttcctgttcgaataacttttaatacttctgtttctccctgggcacgtactttaggcagagggacttcccattttccctaaaaatatgccacagttaaaagtttatattgttattaaaggacaatgagaataagtcaaatatgttttagttgtacaaagtaatagatctattttttttgcttgaccatcaacacatttttggctcaaccgtcttctagaggtctgtattgtctcataagctgcaaattaaacagaacaagtttatatatcatgggtatgttaaataaatggttggcttaagctaaaaatcttaatgctgtgttatgggtgagaaaataccacctgtaatgtggtggttttttttttttttttttttagatggagtctcgctctgttgctcaggctggagtgcagtggtacaatcttggctcactgtgcagcctccgcctcctgggtacaagcaattctcctgtcttagcctcccgagtagctgggactacagacacacaccaccacacccagctaatttttgtatttttagtagaggtggggtttcaccacattggtcaggctg

SEQ ID NO: 115970 - DNA, 1079 bp, Homo sapiens
caaaaattagctgggtgtggtggtgtgtgtctgtagtcccagctactcgggaggctaagacaggagaattgcttgtacccaggaggcggaggctgcacagtgagccaagattgtaccactgcactccagcctgagcaacagagcgagactccatctaaaaaaaaaaaaaaaaaaaaccaccacattacaggtggtattttctcacccataacacagcattaagatttttagcttaagccaaccatttatttaacatacccatgatatataaacttgttctgtttaatttgcagcttatgagacaatacagacctctagaagacggttgagccaaaaatgtgttgatggtcaagcaaaaaaaatagatctattactttgtacaactaaaacatatttgacttattctcattgtcctttaataacaatataaacttttaactgtggcatatttttagggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatggtaagtccttggaagagtgtaatgaccgaaatgttagttgactttattaaatcggataaagaacattatcatttcctgaaattctttaaattgatgtggaacaggttgaaagatatttttatgcaatttttgttattttattgacagaagttatttagtactttttccactagtcaaaaatctttagcccagtgcggtggctcacacctgtaatcccagcactttgggaggttgaggtgggtggatcacctgaagttaggagttcaagaccagcctggccaatgtagtgaaaccctatctgtactaaaaaatacaaaaaataagctgggcgtggtggcgggcgcctgtaatcccagctactagggaggctgaggcaggagaatcgcttgaacctgggaggcggaggttgcagtgagctgagatcacgccattgcactccagcct

SEQ ID NO: 115971 - DNA, 1027 bp, Homo sapiens
ttattgtgtttaagtgagccagttgtgagctagcatagtggcctggtatatataaagtccttagtaagtctaagtgtagatgactagacagtaaaaatctgggtatgttgctaggtagctattacagggtgaaaaaaaaaaaaacttttcagaggctagctgtggtggcctgtaatcccagcactttgggaggctgaggtgggtggatacgttgagagcccaggagtccaagaccagcaggcaacatggcgaaaccccatctctaccaaaaaaaaaaaaaaaaaaaataagctaggcatggtggtgcgtgcctgtagtcccagctactcaggagcctgaggtgggaggatgtcttgagcccaagaagtccaagctgcagtgagccaagatcacgccactgcactctggcgtgggcaactgggcaagaccctgtctcaaaagaaaaagaaattcttaagtatttgtgtgggtgttttccccacatatttatactgtaaccatcagctttttactctgtaaaacatattttgttagcttctttaagatgacattattcaaccatagttttttggagatggttgaaaaagataagcgaaaacgaccactactcatcactgttaacattttggacgtaaacattcttatgttgtgtttgacttactagggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggtaagtgaatttttgaatacagggctgctgtgttctgcagtactaatagaaatactattcaagttgatgtattaataaaatatacagcaaatttttttaatgcagtagagctaaaacactgtaaatcagatgtaaatatttagtaaaaaatactttatagaaaaagttgt

SEQ ID NO: 115972 - DNA, 1183 bp, Homo sapiens
gccgaagtgagcactaaaagactttctttagacaagtgtagttttttaaagattgagctcactggctcaactcttgatgtgtgaatatagttgagtttacaaaaaatgtttattaatcatatatgaccattgggggctaacagtataaacttattcttgttaaacttgtttgggttaaatagtaagtgaattgtaaacaatttagaagttttttgttcagcacacaagaacacttctgttacagattctctctgacagaaattgttattttggggtttatagattatagagggaaaagttagatcacttggaaaaacctaactctcatgttcagtaacttgagtatagaatttataccacaatttatcttcaataaggaacctacatgaacttaatcagttatctgtagtttttgcaaggcattagaaaaaatttcacaattacagaggactgaaaatgtgatttcaaccggctagtctagttgttgaatgtccagtcacattacacatagtcctttgtgaacttatttgtgaagggagttcactttttatgtacatacgtgtatatttccttgtgtaatataaagcagatggttattagtattttagttctttcaagtttaaattattcaattgctagacatcacagaaattagtatatttaagaatttattataaagctcctctacaacttttaaaggtgagagggtctattatgatttttttataaaatcaaacagcatgatttagaacgtcagtcttctacttaaaatgtgtctatattcatggtatttccattcagtgtagatggtaaggaaaacatctagtcattaaagatttacttatagcagactccagaacactacctacaatggggtttcagtgactagaaatcttgaaggtttatgattgcatcaaattgagcctgtactaatatctaaatatctgctcttatgttctgctttatcccttgggattaccttctaaggtttggtcacaccagcaaactgaaacagatcttaatgtacataaaaaatttatactaatattactcatctgtgttacagtattttgaaaaatgtttcaggtgtcatctagtcgtctttcatgggtgtgattagttacaaatgttatgcttatgttttcatacttaatatcaagctttctttgtaccttacaagata

SEQ ID NO: 115973 - DNA, 1629 bp, Homo sapiens
ttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagtaaaaaaaaaaaagtatgactactattagtgaatctaccaaacatttatgctgttttatacattttatgagaaacttctgtcaatatcacaaagggaaatactctgttaagattcagtaaattcttaatctttacatgtttcatt

SEQ ID NO: 115974 - DNA, 2807 bp, Homo sapiens
tcttttttgaaaatacatccgatctcatgacttcaactgttttatctatgggaatgaccagtaactctagattatatgtctctcgactctggtcatttttatgagctttatattaccttctgtgtgaactctattctgtgtatcatatgatataataaaatagatattttatagacaatttttattttagaacaatttaataaattttttactatagaaaaattaaaaaccgtgatttctcttttggaaaaatttccttgatatgcttttaggggtcctacacagtcaaatctatttgtgaacacttgaatgcatcagttttataattttaataatggtaataaaattccccttaattattagaatgtcaggattagaaatacttgatattaaatagaagtaaatggataaacattgggagaattttagaaattggagagttcatgttatcaaatagcatttccatactttaatgatatgcaaggagcaggactgttcagaaatgaccctggtgttgactgagactagggctctctcctcccagcaagatgcagcacccaaactgaacttcccataagactggtagtgcttcctacctctggcacagaaaactgtaatttcccatagattccagatgctgaacagctggtgttatgtaaagagctagcatcaagtctatactctgtctggtgcctttttcctgaaaaagttctttccctgattgccctctaagaaggaggaacaacaagtgggtagggtcttttcattgaatctccgacccatactgtgtgtccacagagcatcctggtcctgccccatctttccttaagagcagtgggagtacggggtactcaggattattttattttgctgatattgccttatgagtttcctccttcccccagtaagactgttctttaacccatgtcctataatgtaaatttgagtcttggtgtaggataggtaggcactgagaagggacccgtcatgcatgacaaataagttagtttgtaatcatgtccttactttttccctctctcctcatggtgtaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataaggtaagggggcaatgagctattttttaataaagtttaccaatgttggtgacattagcgaggagggtgcatggtatatatatttgcttccacctttacatgtacagtgctttaggaagattaacttttatactagatttgatattataagaaaatcagtaatattctataaattcaaataataaccttattcatatctgatatgtggtaacaaaatgagttttattacttttaatactttgtagttaggaaatgcttagaaaattggataaagcattatttaccaaatatttgagtacctatatttgttacatagactatgaccaaaacagtaatttatatttgttttaattaggcagacagattaggttagtgggggaaaaaacttgttggagtattttaaaagaaatttaattttgttacttttgaatattacaacttatggctaaaaaactgttgtatggcattattagtgtctcacctaagcaaaagaataaaacttccattgccctaacttatctaatgaaatcgtagtcaaacgtagtgtggtagcgcagtgaagtcccaaggtatttttggttctggctccagtaacaccaggaaactaaaaaaactgagttgattcatggttttaaagaatcttgatatgaagcttaatgtgtcttaattatgaaataattatttcattatatcctcaaagtaataacttagtattaaaattaccatgtgaaacaattttgaagaaattgagttgtattcagaatatatacacatatagcagaacagaaattcaaaaaaatactcgattttgagtaatgaataccgaattaaattctagttcagtgtcactgcatattagagcctgagaatttatttttagaactgtagtacaagtttatttgttgaccaggtttttaattttcagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagca

SEQ ID NO: 115975 - DNA, 1037 bp, Homo sapiens
gcaaggtcaggtactagagttggggagaggataaaattacaaatatgattgtgtttataaaagtttgagcttataaaagtttgaattatatcgaagataaaatagagatgtttagtaagatcttttggtgcatttaaagtataagttaatttgtggaattaaacacacttacatacacaaatgatataagatctaccttatagaaccagttaaaatgctttcaggtgcaataaaccttcaggggcacccccattttagttagaggggtaggaattactaatccagaaaaaaaatttgatgactgttgatctcacaaagttctggaaaaataactaaattcatgttttttaaacactagaaaaaaatatataaacccttggtaactaagtaaactcttcatctgggttgatttctgcagctttaaagtatttatccccagcttcttttttctttcctctatccatttccatttttctctttagtatcttcaatcttttcctttccacagattctctatttcttctttcatatgttcataaatttcttgaaaaaatctttcagctgtttgccaagtctagcaggcaggtgaataagtgaaattatattaccaattttgttttctttttctttttgagacggagttttgctctttgcacccaggctggagtgcagtggcgtgatcttggctcactgcaacctctgcttcctgggttcaagtgattctcctgcctcagtcttccaagtagctgggattacaggttccccccaccatacccagctaatttttgtatttttagtagagacggggtttcaccactttggccaggctggtctcaaactccttacctcaggtgatgtgcccgcctcagcctcccaaagtgctgggattacaggcgtgagccaccgtgcccagctaattttgttttcttaagttactctgatttagctcctgcttcctctatttcatgaaatgacatatgttatgtcagctcactgcagcctccatctcctgggtttaagcaattctcctgcctctg

SEQ ID NO: 115976 - DNA, 1939 bp, Homo sapiens
ttttctggctagaatgactgactgaatcgtcattaagcaagatagggaataatattggggaaagataaagttcattttgggaatgattgagtgtgaaattggatgggacatccactgggagatatttcattggaaataaagctttggaaatcaggaagaaagtttggaggcttaagtctcatatttgaattcatcaataagcagatactgaagtaagcatagtgaagggagagcatgtggactgagcagagaaggtggctgaggacagaactaggagacactagtggacacactatgacatattagatgacttgcatatgttctcagtcttttaaactgaagctgaactataacctttttatttttaaagtaaatgttgttaacaaaaagtgctatttggaaaacattttacaagtttttctttgaaactataagtgaaatagatccatagggagaaaaaatagtctaaaactttgggtttgaatctctctcttttttagattgattctctaaaagatgcctttgcaagcacttccgaaggtaagaaattcaactgatatatcagtaagtatttgagacacttcaaattagggctgtgtgtgtgtgtgtgcatgcatgtgtgtgtggtgtgtcaccctgagaaagtgaagacttaaccagctctaaaatctagatctgggttctcatgccaccactgccactgattttgctatgtgaacactgagtaagctattgtacctctctcttccttgtttccttagctataaaatagggatggtaatgtctacgttgtttattttccaagattattgggagggaatgcaagtgaaatacaaaaacactttgcaaagcccaagataacatggaacgtgaggaatgacttacacagttcatataacttgacaaagttacataatttagaaaaagatgtaaattataaaataattttcttagcctgacataagtgaggggagggtgaacctgtgtaatgtggaggatatgtgtaaactagtgtagttcttgcatttctgtgtattttaataggtagtccttttaatatataatcaattaagtgcagttttgctgtttttctcctcaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaagtaaataattgttgattttactctcattttttatttgtacttttattttttgtttatacttttatattatcaatatttaatattttatatataatatatactattttatattgtttattatacttttggtatacttttaatatacttttaatatactttttggtatttagcatttaaggtagaggcgattacattgtttgtgtagcagatgactttggtgtaggagtttgtatttgaattatttatatttgaattattgtacaagattattagttgtttatcagtgctaagtgttgccttgacaatgctattgggagaagctgctaataagagactggcataaactcacttcatgtgtgacaatccaggagactattctagtgattatattatcccaaattagtcattatcaccacgctgaatttgatggtatggttttaagtaatgctgagatatagtcagtttttttccccccgcattcaattcttttatttaattttctagtggacagtttacatatctccctgtcttttaagttagtgtgacaattttccataataaactacttaaaagaaaagctttggtcaagaatggaatgaaattgcaaaaaaaaaacaaacaaaaacattgcttttaaaaaaccaacattttcaccaattttatattcaaacaaaaccacatgatattgg

SEQ ID NO: 115977 - DNA, 1254 bp, Homo sapiens
ctgtctcaattagcatgagagttgactattcgagtggcaaatttgtaaacatttttaagaataacaatatatgtaaggagttagattcttgggatttttttttcctacttttggaaattcagacttgagaataagctcctgttctactgcagtccaaattcctgagagatacacagattcatttagtattggccagttataaaatcaaggaaagtagaaaatctactcttcctataaatgtaacgagagcaatgatttactttaatactaagccaaataattttagatgtgtcatttgagtgagaatatatgacagtggtactatatcatacagttgacagcataaattagattttagaatctaacctatttaagattttagaaattcatattcttcatattactttaatgttttaaatagttgaaggaaatgtttatcatattaaactatttatatctctttttgttagtagccacaaatagtttagtttatttcaactacatgatttattctttaggtgatgatggtattgttacctgctttttcctattatttatcttacactttttgcaccttttatttattcatctttatctacattttaaccttttcttgttggactacaagttggttgaagcaagatatttgtcatatgatttatcacaattgctcccttgcttttgttctataaattgaaggctgtgtgcccactatattgtggagttttagtaagcatgtaatggatgaataaagtagttactatggcaagcattggacatataaagatatggttcttagacatgggagaactagatggtccattgttggaaatatataatatactatagcataataattgctttattatagcaagtaattggaggtacataggagaggatgacttttaaagggtgggtgggaattttcttagggcattccagacgatagcatgtaaaaaagttacagaggtgtaaaggaaatggcatgtttgatatgaaagaggtatttggtattgaataggttgagaatttgtattctaagcagtggttggccattaaaagttttttcctctttttttttttatcaaaaaaatggtacaatttgtgattcgaaagtatcactttgtcatcagggtggaggggtgtagatgggatgtgattagaatgagggatatgagtgaggaggctgttggaatagttggttcaagagactaaagatataaactaaagcaatggtagtacaaaggacaggac

SEQ ID NO: 115978 - DNA, 1041 bp, Homo sapiens
tccagagtggtagtgtattataatgtgattgttctagtaacagactctcttgtctaaggtttgaattttggtaatgtattaacttttgagtccttagtaacaaggagacctagaacagcccagtaggaattggtgggtaagaaataaacgtagattactcaaacggcatagaataggcaccagggggtccaaagtaccccttaatctcatgcacttctccccaaagctactaaatacttaaaataactatttaacattgtatataatggcaatgttgcattataggatattggtgaagagaacatctcacacctagattttcgtgacccttctgtccaggctgctcttcagagcttttaggaaaatcagtacaatgttagagttaaaaccaaatactgattcggttacagtttttaaaattcttctatacgcagcactttctcaaaatgaacctaaaagacctatgtctggagaatatggtcctgcatctgttccagaatacgaagcaagaactgaagacaatcagtctagtgagatgcagctaactgtaggtacactgtctatatgtttattgttgtatataaaatttttgtgtttttaaaaaatagatacaggttatatttgagttttaaatgtcatagttcattcaacaaagctatgtaatttctactgtgttagttttcctggcatcttctgttaatattactaaggactttaattttctttgaaaaataattttaatgatgttaaaagtatgagctaatttaagggtaatttagaataaacataaaataatatagaagaaaataaaaatctataatcccactattcagatatagccactgttaaaatttttgcatatatatttaatatcgcatattataaagcatgtatctgtatatattgtatttttatttttattctcttggattgcttctaactgctgttctccattaatgtaatattggaagcattttctatggcattaaatcattaaaatgtgattgttacatagcagcacactattctattatctatttt

SEQ ID NO: 115979 - DNA, 1044 bp, Homo sapiens
gcccaggctggagtgcggtggtgcagtcacagctcactgcaacctcaacctcttgcgctcaagtgatcttccccctttagcgtcctgaatagctgggactacaggtgtgctcagccatacctggctaatgtttgtattttttgtagagacgggtgggttttgccatgttgcccaggctggtctcaaactgagctcaagcgatccacccacctcagcttcccaaagtgctgggattacaggcatgagtccccgtactggcctgtgtatcaggaacacctcactatttgatatcagaaagttctgagtgttggtgcggtccctgtgaccatgtagccctgtgtgtaggaagtgagactctgtttctgttctattactgccctaagtatgtttttattagacttctttggtatccccgtctttgttgacagcaaagatagggctattaaatgaacattttaccaggaaaagatgagacacatttctttcccaagagtgtaattatggcttccctcaccaaatgatgtaattgttcttaaagtgttcaggggataacactaagctgcctttttttttttttttttaaatgtggagactgaaaagcagttgaagtagtttactatagtgagggctgtgattagggttggtaagaccctggatctgggcagctggaagcagaaagaagatggtgagtgctgaaagacatgctcgggattggtacattggggacctgttttttgcccgatttagaattttgttgaaaggcagtattctatgcataatatgtgtgtgtggaaatggattgtaatctatgtgaatgattagtctcatctctgtggtaataaaatgttttgcaaatttttttgaatgcatttgaagtgctttgaattccagtatgaggtatgggagcagggagcaaagtaaatagcatcttgtgattgatgcatattataactgctgtgcctggtgtttgactctctttgtaggtgagcactcttggggagagagtggttctgtatgttctgaatcgaattatttatagaaaac

SEQ ID NO: 115980 - DNA, 1022 bp, Homo sapiens
aggataagagaataatgcacttagtattattaagtattagtaacttttggatattgcattaattcttcagtgtgccttaagattcccaaagtggtaggcccatctgctgaaggctcggagaatgtgtgtacctggttatctgccagtctgatatgaaactttgaacagaaactgaaggggaggagggaattatatccctgcataaagctgtaaaattggaggagtagatagcaataaaggagtataatatgttctcaggaacagttctgatagtgaaaagaagtatgtatgtcaagaaaataagcattctgatgtgttttaacatgactgaggtttggcatattatagatatgaaggctaaaggatggagaaggagaagggaaaatcttaatatgatggtatattgtagcttttgctgttcaagtggagaaactatgaaacctccagatatggattgggaaaagaggaggagtcaaaaccaaaaataagactacaactatgtggactctttcagccttagttaccttagggacaacattccctctctttttttttttttttgacacaggcttactgacgcccaggctggagtgcagtggcatgatctcggctcactgcaacctctgcctcccgggttcaagcaattctcctgccttagcctcccgagtagctgggactacaggtgtgtgccaccttgcccagctaatttttgtatttttagtagagatgcggtttcgccatgttggccaggctggtttcgaactcttgaccacaagtgatccacctgccttggcctcccacagtgctgggattacaggtgtgagccaccactcctggcctacgttccctcttaaatagagaaatcagtgaagggggactgctattccagtcaaatcctggccagtaaggaaaaattggttggtaaagttacagaagggtgtaaccctttttgtacttaacaaacacttaacttggagcaagttgactttatttttataaacctctctgtacctggaaactga

SEQ ID NO: 115981 - DNA, 1044 bp, Homo sapiens
ataatttataatataccataatattcatctattgcaaaccgtacaattcagtgattttttttttttttttttttttttttttttttttttgtgatagagtctcactctttcacccagactggagtgcagtggtgcagtcttggctcactgcaacctctgcctcccgggttcaagcaattctcctgcctcagcctccccagtagctgggattacaggcatctgccaccatgcctggctaatttttgtatttttagtagagatggggtttcaccatcttggccaggctggtcttgaactcctgacctcatgatccacccttccttggccccccaaagtgctggaattacaggcgtgagccactgtgcccgcagtgattttttttagatttttttttttttgaaatttatagggttgtgcagctatcatcacaatccaattgtagaacattttcattattccaacaagttctcgtgtccttttacagtgacttttatgttgagtggtttatgagagtatatttatatgtgtatttttgtgtgtatgtacatataaatatgtcttatgcctatgtgaccatatttattatgtaaggacgtatctgttaatttatttcattgcctgtttttaatacaaatgaataatgtttgaaagttttctttttgacatgcatggttaaatcagcaggttcaagttgtattctgcgggcaaagtgaaacagaaaaatcttgttataacaaaatatggcaacattgtagtaaaatttattttctgtgagtaaaggaagatggcgtttcatattctgaattgtttgttccatgttgtttgttaaagaggatggcattccctgtggatatgctggaaaattgcagccatgaggaattggaaaattctgctgaagattacatgtcagatttaaggtgtggggaccctgaaaatccagagtgtttttctcttctcaatattacggtaaggtgttctgcagtgattgtcatcaatcttttcagttcagtttatacatgaaataaatatccttttttaaaaaaa

SEQ ID NO: 115982 - DNA, 2697 bp, Homo sapiens
ttagattgtataagtcatactggttataatttgcctctgagttttttctttttagatgcaaaagttttgattgatttctagttattagttgcagcagtttattcctttctcaaccagaaggaattttcctctatgtgttctgtatgttcaggtaatttgcccatggttacatagctagtaatcctgttagtttggctcaagaatacactcccttaaccagtattttataccagctttcacacactctcaaaatcctttgcaatatagctggattttgcttttgaaggcctaaaacataccaaatacgcagtatcttcatgcttaaatgatttcttatctaggagtattttcctgtacatgaagagagaattaaaccttgagttggaaagaatacttggaacacttcccctgacatatattaagcaatctttaaccgtattagggctgcctgagatgctgtgctttcagacataccaatgtgatggaaaaaaacagacatcggagtccgactgccgggttcaaatactagctctgctgcttactagtagtgtggccttgaacaagttactcagccactttgtgtctttgtttccttttcggccaagtgaagagaattaaaacacccacctcatgggttttagataaaagttacatcaggtgatacacgtgaagtgttcggaatagaacctggcacatagtccactatcggattagtggttataacttcaaaagatggttttgcttcctgcttgaaataaggagagccaacagatatgaatcccattcaacttcctgctctattacctaatttataggccgtcctaacccatacataattaaatgtttttactttcccagaaaacagaaaaggattgctgaacagtgttgaggcccatctgagattttgatagttgtagcagttattttgtcatattcaaaaactcggctctcatagtagaaaaagatgagtggttagaggaatctagcgtttaggaccttgtgtagggcaggagtgatggaagaaaaagtaaggtaaagggattagttgagctgatgtagtacagggcccaggttaattagggaaggaaatgatgttagaaaacagaaaagggagggatcaagagaggaatcataataaggttcagaaataaggttgagagcattgctgattatgttgcctggatacctaacctattctcggtgttggagagaccattgtgagagttaggatcatgaattggattggttgagataattatttttttccctgagaattctttcagctctatagtgtacatacttctttttgggtctgcctctctccacaaagcccccaaataatagcagtaacctgtaagaatcatgaaataacttacgagctgaacatgtagaatatgttcccatcttttcagaatatagttggcatccagtaatcaacaataaatagggaaaaaatcacaataatataaatttgttttctaactcttttcatgcttttcttaaggttatccattctgtcaaatacataatttttttgggaaaaaggaattattaaaaggtagatacaatatagcagatgctcatgatcttagatctcttatataagaggtcttggtattatgtttttatacagcttaccctggattaatgagcataccattcgcttaatttgtaaattagtttggacactttttacacttcgctgtccattctgtgtcagttttttgatgagttcacttaaggctacattaagctttctcattcatgtagaatctagttaggccttttggtttatctcatggacagagcataaagtacttgacagaatttgatctgacagctttacagttacataacatagaacagaagcttaaaaacaacaaaaaagagagagaagcaagggatttatcatagcaacctatatttctctctggaactttaccacccttccgctgcctctctaaactatagtagcagaaccactgttaggcttgcaatttacatagtcttaaattaaccaagactcaaaaacaaacaaaaaaaacaattccaagcatttagaggtgaaaaggtctttaggattatcctgtccagttgcatcacgttaccaatgagagtacagaagcctaaagagggtaagtaacttgcctatggtcataaagctagttagcggcagagctgaccccagagccaaggtcacagaattccatttctagtgctctttctcgtgtaatatgtgaatagaatatttaataatataatcgttatattttacaaaagaaaatgttatgtaaccatgacaaatactatatttgattttgcatatttaataaaaataattatatttaaaagtatatctgattgcctaggttcatatttctctagtcttactagtggtatgatgttagtcaagtctcttgaactccaaaactgtttcttcatctatcaaatggggcagataggagttccttgttatatagtaaatgtgacagtctctctaaagcctgataaagggatatttctcaataaatgttacctgctgctgttactgatttataataataatttctaattctttcatcttcctttaaattcgaataaaatttagcactgagaatgactggaaacaaaagtaatggatttcagaacagatttgcaaacataaaaatattttagaagagaggtataggtgtgtgt

SEQ ID NO: 115983 - DNA, 1072 bp, Homo sapiens
ccttaactctcttggtaaatccaactacttgccgttctcggtgtactttcagtcatccattcagcatattctttttgagggtcttccccactatctgcctcttgaaaggacatctgttactttttatctagcagcatgttcttgttcatctgtggcagctcttcctcctagcaccagtgtttggtttatttatacaaacttttattcagtcattcatttatttagtaaatatgctttgaagttagataagactactgtctcttgtaccttcttcccatgggcctgctgccaatgagaggtaagaattgtactgaatctgggtaaataagcccacctgagtttgcaagagagtagcacaagcaggttaatgaggccatagctccaagtgcagagttggagaggcccaaaagcacagaattggagagcctgtggttcaggggctgccatttttccaaattgctgagatactctgctatataatggcagcccatggttatatttcttagttgtctagtgaaaatactagggagtttggtcgggtagtgatggggattgtgactcagcagaatatttcgcaaatggtatgccaaaattaagtgccaagttttggtttctttttgcttttgttgtgagttagacatgtttcctttaaaatgaaaacatcagtcttcattgttctaaatgagacaaatctctgtgatattttatgttaaaaatatctacaacagtgaacatatagttagactcgtgtttttaaaaattggttgtatcctggaggtttactatgtccaatccctgttaactttactaaagtccctgtatagtcagatacgtggtagagaagccaggtataatgtaagaaattttatattgtcagtgttgaaatggacacaattttatgatttattaatttaagtgcttattttttctttcctgagctttgtacactgctgatttataaagagtatttagtagtctgggttgtgaagtaccagagttgctgacatattccacaggcaaatgtattactttactgtactacagtatgtagtaggatcatgtggaagcttca

SEQ ID NO: 115984 - DNA, 1033 bp, Homo sapiens
catgttggccaggctggtctcaaactcctgacctcgtgatccgcctgcctcgacttcctaaagttctgggattgcaggcatgagccactgtgtccggcctagactttttttttttttttttttttttagtgctacattgcatttggagggatccctgcatttatggattgtgcagaggagaggggtcagttgctgaaagaaactaagaagaagagagagaagaagaatatttcacctaactataagccttggctattccacttgctcttacttagaaatcttatcctgtctagtggctccatttaccaaatatatacactggtagctcccaaatctgtattattggcctagatccctctccagaaagtcagattgtcctgagtgtcaaggaaagacagaaacttttaagtgacagaaggtggtcagtttggtgtagtctgtcataaggtcaagaggagtaagaatgaaaataatcaattgaatttgggacttggagggttattggagatcttatgagtaggagtattaatatagtgataaggacagaagccaatttagtaattcatagaagtggagaaaaagtcagtgagtttgacttattgttatgtaatgaaagataaagtactaaaccatattagtaaagaattttgtagtctaaaagcttttatacatgtatgccagtgctttcaagtttggattggcttgtgatatacctgattaatttattctgatacttccatcaacagtagttactactcagtgcagatctacagtttaagcccataggcataggtttgaatcctgactttgctgtttctagctgccttttattaagatactgaatctctcctggcctcagtttcctcatctgtaaaagagtggttattacagaatttatctcaaaatgttgttgacagaattacctcaatgtgataatgtattaatggtgagctactaatatcattatcagtggaattaggatagcttttagtatctagttcagtgatcctcatcttcttaccttttctccctt

SEQ ID NO: 115985 - DNA, 3289 bp, Homo sapiens
attaaaacgtgtgtacgggtttttgggggattgggaccggagggacatatttctaaaaaatttccagaagggaaagttttcattgtgattctcacagaactgtgacacaatttgtcattttcaaggttcctgagaatttgggaattcttttaattcgttggcttcttgcgaattactacttacgaactgagcagattatacccaagccatttatattttgtcattgcatcacagacagggattacaatcgggagtgctggctgttgcataatgcacacatttgggccctggagggaattcaccgaagtggatctgggtttggtgtgccatgcgtttttattttttacacaggatgtacagatgatctttgcaaactacgtcccttatcgtgctataaagtgtttacaagaggaaagatttttattgactagtatggaccagactaaaatttttagtgttttagttttgcttgttttggaggaaaggcaaggaatgagatggtgagaggcacctgggaaaagtccgtttatcctaacacttgaagcgcaaacaaagataaaacatgatcgtctttcacagaaatcttgtagctattatagtggacttttctctaagttaatgatggggatctgtttggggaacttagaaatagcttatgtgagtagcaacattgaccttccacatgagtgaccataaattaaggtgttttacctgtggattttaggttctaaaaggcttcaaattagtctgacctttgagatagtattcatgtcattacaagtggtatttatttaataaagatgggatataggccgggtgcggtggctcacacctgttttcccaacactttgggaggccagagcgggtggatcacgaggtcaggagttcaagaccagcctggccaacatggtgaaaccccgtctctactaaaaatacaaaattagccgggtgtggtggcacatgcctgtaatcccagctactcgggaggctgaggcacaagaatcacttgaacccaggaggcagaggttgcggtgagccgagatcgtgcccttgcactccagcctgggcaacaacagtgaaacaccaagatggaatatatatccaacaaaggattttgatttggagaaaacaaaataattaagtgcttttgaggtaaagtttccatgccatcctccttattaaattaaactatttattttctgttttgttgaagactctcccactaattttgtcttcaaacaagtgattacatattgtgtaccatccctggcaaaaatatcgtgcttcccattatagatatgtttattctatagggagaattatggaggcgagaagaaccttggacatttagagatgagtcttggtttagggaatttaagtaagcaaagattgcctgctagagattgcaggtgacctgtctggacctatcctaggcctatggggaatgagatttttttttttctagcaaataacagtgctgagtcaaacacaactcttaaacttttacattgattctgttattatacaagtcagagaagttcactgaattggtaagattgtattgactccagtttggaagtgatcttggtgtgcttttgtctttgaagttgcttgagattttgagcattatttaccaatggttgagaaattgaaaagaaaaatcgaatatttttctctattagctcctacctaaatactccgttttaagccttaagcatactatgttcagtcatctgcctaaaaattcagtaagatttactttttaaaggtaagtacaacataagagagttgagtattcatgtagtggttcccacaatatctgtcaaggattctgtataaaggattgttgtttgggtaggaagttaaacaaaacttgtatgttccttcccctaagattttatgattctaagtgaaaaaaggaattgtgtgattattgtatttaagacgatagtctcttcacatgccattattttttgtatatttagctctgaaatttaagttctaaatttggtatgcctcagtggtggtaggaatatttcacaattgtttcaatgataacaagaaaatcacttaaggtagaatttattaaggaaaaggtgtgatgatttaaagataataagggaaaaactaataatttatcagagatatcctagaatgcttattagactcatggagttttagagttggtatatgataccttaacgtttacatgctctgtataggggactactcatctatgctaacctattttttaggctagaaagtttgtgacgtacctagattcctcccacccctgccttttttttttttttttaaatgaatacagttttggttactagctgttccaataagatgctagttttagactaaacaaagatagctttcatttattccacaaacattgagtgtctgttgtgtgttgtaggtcacaaacaggccctactgtcacggagtctatagtttagtgaagtattgtggattacaatgttaacaattccttaaggtctaactgtacaaagatttttgaaaatacgagttgggaacaaatttagcaaattgcatttttaaaaaagcgccaagttgcatgttgtcacactttatttgtaacttctcaggtatagaattagtttaatttggaaaattcattccagtagtccttgtaaggtgtactgttaggctgggtacaaaaacatgaatgtgcaaagtaatctagaaattcagtcttaaagatgagacaaacattaagcagataattctgtcctgtgagtgaactgaacaaagtgatatggggcatgccgaggagggctgcattaattctgtctgagtgactctggaagggctttacagaggcagtgacagttgaacttggtcttgaacaatggatgagtgagaacttgtcagaagcttttggggatgtgggatatgacgagagacagtcccagcaaatgctaaagcatagagttataactggtcctgttctgaaaacagggaagtcagttgatctggcccaggtcccatggtgggttggggcctgattgtgaatggatgtgtatgagttttgctccatggtgatggggaaccaataatgggttttcaaaggaaggaatgaacagaatggggttctctctctctttttaggaagagcattccaatagcagtttaaacgctggattggagtggagaaaagatacgagcttttatgataatcttggcaaagccttgaagcaaagctgtggctatggaggtgacagaggaggggctagagttgagacacatctgctgcagtaga

SEQ ID NO: 115986 - DNA, 1105 bp, Homo sapiens
gccaaattattcttcttaaagatctatgttgcttccctgctgctgcaaaagtaaaatctaggcccagtattcaagattacctaactatctggccctaacataacctttcaactttacctcccaatgctctctaacctttgaccttaaactcccttttcatttctgttatgggctgaattttgtaccccaaaaattcatattttgaagtcctaacccctagtacctcagactatgactgtattttaaagataagataaattacaataaggtcattggggggggctctaatccaatctgactgatatccgtataagaagaaaaaattgggacacacaaaggaacaccaggatacatgcacacagataaaagatcatgtaaggacacaacaaaaaggcagccatctacaaaccagggagagaggcctcagaatgaaatcaaccatgtggacattttgaccttggatttcacacctccagaactctgagaaataaacttgttttaagctacccattttgtggtattttgttatggcaaccctagcaaactaatccctaactctcccctacatttgtttacactatttcccctacttagaatgttccctcctctctttgcccatctgtgtttttcttattctttgaggcctctcctcagatatgaccacctgtgttgctttctcagaccatcccaatccaagcacttaacatttactgcatggctatattagacttttctcacattgcaataaataaataaccgagacttggtaatttataaagaaaagaggtttaattggctcacgtttccgcaggctgtacaggaagcatgattctggccatctgcttggcttctggggaggccttgggaaacttataatcatggcagaaggcaaagggtaagcaggcatgtcttacgtggtgggagcaggaggaagtggggggaagtgccacacacttttaaacaaccagatctcatgagaactctatcatgagaacagcattagggggatggtactaaaccattataaaccacccctatgattcagtcacctaccaccagaccccacctccaacactggggattacaattgaacatgagatttggg

SEQ ID NO: 115987 - DNA, 1044 bp, Homo sapiens
gaccattagccccatagactggcagagccaaaaggaaccctctttatcatcactcctctcacatctcagagatggaagtctggaaaagccatatgacttgcttgagatcacacaccaagtttgtggcagaggcaggactagaaatcatgcagcctaatactctttttagtactaaataataatagcgtctagtatttattgtttgctatatgcccggcggtatgctaagaatttcacatgcaaaatctcagttaatacaactgttttattctccgtttattggaaattgaggcagagaggagcttgtaccactaccttcagaagcttccaccatcctttttctgctgatgttttagacttcaaacaggcccctctttcccaagatcaaccaatgctggttcatagctttgtcttgagtacagaaaataggttgagggaaaaggtcctgatcagaaaacctgttatgtgtgctctcaaatagacttgattggattctaggatttgtaatagcaaaatttacatcttaaatttcagagggcagtttttaatttgttgatacttctttaaacaggaacttccagagagtcaatgcaaagcagcccacgttatctacaaataaatgaaatactattaatcagtgatcaagaatttctcccatgccacataatggatcagcattggaagttttgtgtggaatgtgaggaactaacaccctaaaaccttggtttcttaatattttattggatatttgttcaaattaccaacaaacatttatatttcatcttgtataatctggtgggcctattttaacatacactttatgagttgctatttaggatgtatgtttactgttcttaagatgtatgtaactgttcaacaattatataagattaatgcttttttgccattgaaataaaggcacatttgaactagaccatattgattggctctctggctttctttttactaatataaacttaaaactaacttttcaatcaacacctctacctttgtataaaaaacaattgatccctaaggaaatga

SEQ ID NO: 115988 - DNA, 1025 bp, Homo sapiens
atttttagtttattattttattttttaaatcatctctcctaaaatgtcaaggaagagctatttgtatttcccatcggtagggtgaccatcatcctgatttgaccagagcagtcccctaattcagcaaaattattactaacgttttgtttcactttcagaagttgcttgtttagatgacccagtacaggaaccaaacaaatcaatgtttgagaaaacaaaatttggacaaggtaaaaaaaaaagaaaatattcaattccatttacttttataagtgtttagattctacatattgtgcaaatagatcaaatagattgtcaaatattatgcatatcactccatattataaataattgctggttacatcatctttatttcctgatagactaagaagatctttgatttcagagaacttttatgaactcttacttcttatattcttcaatgcctggcacaccatagctttccaataaatgctcattgaataaataaatgaatgaataagtaaatgaaagcatgaacgtgatttaaaagattgctgttttaaaactggatttactttgattgtcttaagaggtggacatacctagatcttataggctataatggaatttgtggtgaagaatttaacaaatggtaaatgggattttggttagttaatactatctcctttatctgaacttactgtttcttttttttttttagacagaatctcgctctgtcacacaggctggagtgtggtggcacgatctcggctcattgcagcctcgatctcccaggctcaagtgatcctcctgcctcagcctcctaagtagctgggagtgcaggcatatgccaccatgcccagctaatttttttttgtagagagggagtttcaccatgttgcccaggctggtctcgaactcctgagttcaagtgatctgcccacctcagcctcacaaagttctgggattacaggcatgcaccaccatgcccagacctgaatttactgcttctaattgtgggatataagagggatggccttggc

SEQ ID NO: 115989 - DNA, 1050 bp, Homo sapiens
tggctctccttagccaccaattgctaccttccaaccaacgactaaatagatgtttagatagatgatccaagttttgtttgtcttttagagttgactcccaattgataataattgtatgaatataaaatcttgataaccttactgtcacctccttaaaaaaagggcacatttacttaaataaaggaatcagcttcctctcaaaggaaatattttgcgtcaacaggctgcaggtggtcagattaaaaaaatcaaaggcagtaaattgcacaggcatagttttgtgtattttaaagtgattaaaatttggagacaaagtatctttaacctctaagtgaccgctttgaaaagttttctgctgttattgcattttttctctttctgtttcttcctatagggtatccatagagtcatttaagcatggagccctgagagaacaattggccaacttggctgcaagacagaagagccttttagttgtggcaaaaaaacagaaaaaaataagcctgaaaattcaaaactgtaggaatgttacatcattgccttgtcttagtttaaggaagctcccacccagatcagaaatctctagtgaaaaagacagccaagagctcactagtctggaaaatttagagcatccccaatcaggttcactttctcctgtttctggaagcatgcaggaaacacaattgtctctggaaacttggaactacagccaaaataccaacatttgtctaaattcagaggcagtgagaaggggagaattttctggaaatgatatgaattctaaacaaaatggcagtgattgtaccttggatggttttccaaaatccagacattcagatggcacagagaagaataaattaccatcccaacctgttgcttttattggtcaaacagaatattcacagaaagagaatgatcttacagaagctacagacaaagaccatgaattctatgtttcttccccagtaatcggcaaattaaatatttcagaaactgcaagtgtccttgccgaaaatgctgcccatccatcaaatattatttgtgatcagg

SEQ ID NO: 115990 - DNA, 1007 bp, Homo sapiens
acacacacacacacacataagttttcaattcttccaataaagaattttggattgctaatctctaaagagcaatatgtttttgtctgggtgccagtggaagagatatatgagacttattcttccctgtgattcatataacccaagaatccattttttagagaatggttctctaatctttttatctcttgccctgaaaccatatgcatggttgatgacatttaggaagtagagcaagaagattgtcccaaagtttaatgcagtgattctcaaaccttagtttgcatcagaattacctgaaaagcttgttaaaacacagattgctgggccctaccctcaaagaatctgattcagtagttgtctctattacacacttattgtctcatactttctgtaggtcaggaatcaggcatggcttagttgggacctctaacagaattgttcgtaggcagcaaagtgttggccaggactggggtctcatctgaaggctctactagggaaggatacactttcaagctcatgtgattgttggcagaattcaatttcttgaggatggttggctgagggcctcagttcctcactggtgattggctggtggccatcctcagtttcttgctgggtgggcttctccaacatggctacttgcatcatcaaaacttacaagctgaaggcaatacagcaagtctgctagcaggacagaaaatgttacaatctcttttaacttaatcagttaaatgaaataccctcaatatggaaatattctattggttagaagcaagctattcaagagaagaagagtacacaaagtcataaataccagatggtgaggatcattaggagccattttagtctgtcctccaaagtaagtttggagtggactggggaatttgcatttctaacaagtttcctccatggtgccgataccactgatttaacgaatattttctgtttcttcaccctatccgtttattttgctttgcatctcagtctgaagcttctctaatgcagtt

SEQ ID NO: 115991 - DNA, 1050 bp, Homo sapiens
cagtaggttgcctgttcactctgatgatagtttcttttgctgtgcagaagctctttagtttaattagatcccatttatcaattttggcttttgttgccattgcttttggtgttttagtcatgaagtctttgcccatgcctatgtcctgaatggtattgcctaggttttcttctagggtttttatggttttaggtcttatgtttaagtctttaatccatcttgagttaatttttgtcccctgagggtaaggaagggttccagtttcagttttctgcatatggctagcctgttttcccaacaccatttattaaatagggaatcctttccccattgattgaataaacagtatttctatcactctttctgttgctttttaatatagtatttattgagcatcaggaaacctaacaacattttgatagcaggaaattgttaggtctattcatttcaactatctactatattcccatcagagctgcaaccagcaaactttttgtctgttacataaaaacatttttaaaagcttccattttcttaaacagtccagtgtggaacagaaactttaaaaaattagaaattttattttctaattgtataaccaggtaggagaacaacaacactgatattgtaaaatgtttgtttcagatgaggaattaactaataacatcagtggagatgaaataactataagaaattgtgaggagataaaagaaaaaacggagtcagaaattcacatgcctactaatagccaagaacacaaaacagttcagaatttcagaaaaagacaaagtttcttaaaaactacctgcaacctaggtttgtattcctataattgtataggttaaagtttacaaaatcaagcccagcaattcactctacttcaaggaatttctaaactttcagatatattgtttctttttgtagttattcactgacttatatgactatttcagcaatatttgttgttaaggcatcacttgataatccaataatctttaaatatattcatgtcatacttctttctatgacttctagtttattatattagag

SEQ ID NO: 115992 - DNA, 1412 bp, Homo sapiens
gaatcaaataatagttgatttatcaataatccagattgaattgatatagtactaccgctgaaaattaaagctaactatgtattttttttctatagaaaccaaagttcagttctaaaagtcacatttggcatgtttataatgaaaattccaacagacagaagctggaacatgtaaaagtcaataaaggaagcaaagcgagtttatttataaataaagaagatgtatatgaatattaccaaaaagatcccaaaaacacaaaatttggtaaatccaagcataaacaatcaactcttgaccagatatactctacaggactcagaaagggcaatctccataacgtcaaagatcccaacacaaacgtaccaaaaggtataggaagaagaaaaacacaacataaaaggacccaagtagatgatgtagactgtaatccaagaaagatactagctgtctctccttccaggagaataaacagattggttacctatcagcagcatattccagaaactcataatgaccttccagaagaattgtgtgaaccttccagcttaactctgtcaagcctgagaaatggattagatagcagtactgaggcttgttcagtttccaaagagaaacacatccagaacctggatttatcagatagtcaagaagttcaatgcttggaattagaatctgttgaccaaactgaagctgtttctttcccagggcttttattacataaagaaatcaagttaccagttgttactacagataagcagcctcacactctccaggaacaacaccatgtactttataaatctcatgaaaacagtaacttggtcccaaaagatgagagatttaacaaatgggaaaattctttcctatcctttgtaaaggaaaattctgataatgatgatgatgatgattgctctacctctgagaaggctataacatctaaaaaggtgttgtgttctacaggtggcaaaaaacactataattttaaggagaatttaacaaataaaaaagaaatgggtttccaacagtttttactttctgaagatcatctttcacaggaaaatgagttaaaagcagtcagcctaaccacacttccagaacaggaagctgttaatttttcttattcagataatgcagttatttctgaacatgttgcaaattatgaacaatgcatatttggaccttcttttgatcactcaaatggcaatcctgagcaaaattccctggcttgtatgagaacacttttgacacatgaggcttcaaagttgactaatcatgtggagctattcaaaaagccacaggattatattcccagagcaccaacttttttaatgaatcaaacagatacacatattgtggaaaagatggcaaagaattgtgacactgagaggaattacattgacagagaccaaaaaata

SEQ ID NO: 115993 - DNA, 1052 bp, Homo sapiens
cagctgaatcactcttaggaaagtatagcaaagtgagcctaaggtaagttccaaacagaaggctttcagatcattttcctgttgaagtagctcatcaccattatctttcagggaagagggcagggtgagaagactgggtggcaggagaagagcattatgtttctccttcaaagattatgccaggtgggttatgtgcagtggcatccagaaggtacctggggctggctttgcatggtcattgttactatgagactcagccttgaatgaaggagaaatgatgtcaaacactggaagaagctgatggtgcactgagctgtaggggaaaatttatgatgaaatggtagatgtacagcaggagcagtggccagggaaatggaaaaaatacagtatgaagtacagaggttgggacagggagctcagaaagtgcagtatttctgcaaggctgggtcactggtacaatgttccctgtgggtagaatgtgacatgttgtgctagagaagagtgattccttaaaggtacttaagtacttaatacactgaacaatacttggacagcctggatggtgcttttgggtgtccatacttttcatgttgtttctaaacttgctcagtttagaaacattgcaaagagtcttatggtgcacagagatggcacagtaaaatccagggacaagcaagtgatttcaagtgcacccccagtactttaccttagcaaagcctgggtttatactataatcaggattttaacaggatattattttaaatgtcatacccaggttatagccctgttataaccctcaaccttgtattcttatttgccagccacagcacttactctcttgatttcaagagatatgcggttctttctgttggtattctttgtctgcccattgagttcaagagtagccctatatgcagccaattttgactttatggatttctcaagcctctcttaacatgtttctttgtattagccttttttttttaatgtgccagtgttaacattctcagtggctgttcccttcttgtcttcagccagttaatatatacctt

SEQ ID NO: 115994 - DNA, 1060 bp, Homo sapiens
gattttttaaaaaccagaaaaagagaaactaattatggagatagggcatgaagattaaaattgcagtgttctaatatgaaaagagggaatatgagtaaagtgtaggaaattatgattggtattaatacagtgaatatgaatttagcaagtcttcgaaaggaaaaaaaataaaccctcttaagtagaaaggagacttacttagaagagatcaaataatatactcatttactcagctgtaataaaaatatggagcttgttaccttgagaagctttgcaagacggatatgtaagtaagctgaagaaaggtttagatgatacgtataaagaatacatatgttcatggaagttaaatctataatgaattattaagggaaagaacaattcctgatacactgttaaccttttaaaatcaatgtaatggaggttatgtactatcttgttccacaaaatatcacttgctgctgctgtcagataataaaaccctaggctgaatagtccattgatctagcctagtgtgacatttctaatgtttttgtagatctctcatcattctacattccaaatttcttgcaaaattaaaactcctagagtgaccatagatttgcctttgaattttcaagataaatattgatcaaaatcatttttacttatgctcttaagcttttaaatctgcattgtcctttattacattaattattattaaatctttcattatgtccacatatgtctatgaattcttgtacttggatcctataataggcattttaatttaagcaaaggtcaagacaaaatttaacttcttatagttttaatttttttgcagtgttgtaattttttgtggatgtatttacgtatttgcagactctgcaagacccaaatccatctggattgcaaactttggctcatcaaaatatcacttcttgtgagccactaagtaataagagaaattcaaattcagtgacaaatagctctgatcaggaaactgcgtgtgtgttgaggagatcatccagactagaaaaactgaaagtaagcagagatgcaaagtactcagatcacatgt

SEQ ID NO: 115995 - DNA, 1021 bp, Homo sapiens
cagtggagcaagtagctgaaaatatgagtctatgattttgccttttaaacttcaacaagttttcattgtgttaaaatcaaatctacccaaatatcaacaccgagaagatactttgtgacttggaagcatagagtgatctttttagaagttcctaggatagagttttcgaggagttaggaaatgaaaatagaaagatttcttctcaacagggctgagaagacatatctttagattgcttatatgtaggaaggaaagaattctttactaaaattttctctgttagctcagaaaatcactatgtctacctgggtgcagagtactgatgggataccccacattaatttacattttgacatagaatatatgcagttgggatgccaggggagggaaaaaatatgcctagcttaagcagaattttgacttctatgtctgagaatactatcaggtggcatagctcttggggtttagaattcttgtagtattatgcctggaggctctgtagtggcctatcactcacaaagtccctttgtcatattgacagtttctttgtttttaaaaataatctttattttttcccctgattataataataatgcatcctcattataaaacacattttaaaccttacagaattacataataatatggtaacaaatatcctccacagtttcactctttagaggtaatcactgttaacagtttggtgtatctctctccaattatttccatcatattctatattagttcattttatactaatgggattatattatatataatgccttccaacttattttttaaatttaataatgtgttttgtttatctttcaatgtcagcaaatgtagcactacttaaatcttttaatttgctgaatagtattccactgtgtgaatatattgtaatttatttaatcaattcactaatgatggtcatttggattgttttctttcttttctttttatcttccgattaccaaaatgtttctgtgaacatccttgtgaagatttatgtaacaaaatg

SEQ ID NO: 115996 - DNA, 1152 bp, Homo sapiens
ctgaaagcaatttcaaaagagggattctaacagtattttgagtattagaaacattgtgaggctgggcatggtggctcatgcgtgtaatccctgtactttgggaggccgaagcaggcagatcacctgaggtcaggagattgagaccagctggaccaacatggtgaaaccccatctctcctaaaagtacaaaaaattaacagggcatggtggcaggctcctgtaatcccagctactcaagaggctgaggcaggagaatcacttgaatcctggaggcagaggttgcagtgagctgagatggcaccactgcactccagcctgggtgacagagtgagacctcatctcaaaaaaaagaaaaaaaaggaaagaaaagaaaaaaagaaacattgtgagaacaggtataacctattaaggtgatgtcttagagaaataatagtcatttagaaatgttaagtttagtgggtttttttgcttaaaataaccacaactcagagccattcattcacagctagggcttgtaatatttatacataactgtaccctcatttctccaccttttccctctgacctcttgtcctttggcctctttactccacatttacttattcctacaaaggtgggggaacaaaaagaaggtgaaattttattcctagttaataattttataaatcaaataggacattttggcaagaaagaattttataaccattaatggctatgaagctttgggatcatctgttaatttaactatccatgccatctctgcttcttctgttagcacagataatttaaacttaggtgaataatttgccatccgtaattatggtccagccagttatgctcttggtctattattaaatgtttaaccatgttttcagtaattagcgatttggtataggaaagcaataaagagtattccctttatttatggaagggaaggaaagttgatgataaattttgagggtagcttacaaacaagataaactataaaactataaagttttcattttaaatactttattgtatatgctgtaatgatgtaatttctatttgtaatacacaggaactaagtgaaggcagagattctcctgaagttagccttctctcaggcactgctattacagtatctgatacagttgctgtaaaggagacatc

SEQ ID NO: 115997 - DNA, 1032 bp, Homo sapiens
atgtattaaaaagatagatgccaatttgtgtttcttatgaaaaaattgattgacatgtattcttgcatattgttcattaacaaattaacagctccagcccccacttgtattcaatggcattagctcttggttggtagttctgtctatagaggaggaaataaatcagctgtcaggagcaaccttccttcctacttgctttcttaccttttgcatttaccttttgcacttttggaggccaacatgggcagatagcttgagcccaggagttccgtgtagaaccttaagtaggtacagtcaagtgaataattagtcctcaacaggaaaagtcactggtcctttagtaagataaatgaaaattacaaatatttgaaaaattactttgcagagacacagaaatatcttgtaagtgtgtaggtataccctgtttaattaattcttgggagtttctgggtttgtctctcgacatttcttatctttggcctctgagctctgtaaagcctgcttgggaagtatatatgtgtgaaactaatgtaactttggggtgtttagggatgcattatcagtatataatactgagcattaattggagaaggttgaggttatcacattgctttatttgtgttttttgatatgatttgcatgttgttcattaacgaattaacatctccagcccccacctgtattcagtggcattagctctgtattgtattagtgtaatcatgaaaatgcttgcaagttcagcctaatggctttattttcagagagctttataatttatcatagaaacaaacataaagggcccctaaagagaagtctttttctaaagctcttagatgctgacaacatattaaaggtaaagattccttttaaagtgacaaaagccagtaggttgtgaactcttaaaatggaagcatgttatcagtgtattttatctttttcgaaagggacacaacaacttcagattttctgatatgtattaagaattaggcagaatcagttttgagttggggtctctgtcacccaggctggggt

SEQ ID NO: 115998 - DNA, 1150 bp, Homo sapiens
cgggcaggagctgacagctcttcccgtatctggggctcacaagcatcaggtgcatggcaggtcaccctcccggccaagggtgttaagcaggctcggtctgagttctgggtgcgccacgcctgcctttctggtctctgcagcagcaaccccagcaccctcaaagcctagcgaccgagaatgagaaaccgtgaaaaaaacacgcagcggcaggccacgcccagagtaggcctgcgcgcgcgcgcgcggcctcccacttccggccacgggagctgggggcggggccgagcgctgcgcagggctccgtcgtgtggcgagcggctgccccctgtctgcgacgagcggcgggacccgcgggccgcctcgcagactgctaccccgccgcgctcgcggccgcctgcgtcctcctcagcagccctgcgacaagtcccggctcctgctgcgattatattatttttatttttaattcacaatttcccctggccctcaaagcgtttttttgtttgcgggcaagagggagttagaggagggtaaaaaagactttgaatgtgaggcaaagatggaggaaggcgtccaggccccagactgggacagtgatgaaactgtgatagagggttcagtgacggagagcgacctggaagaaaaggagctgccctggagaaggtgaccatcattagggccacagtgcctgaaccctcgcgccagggcggcccaggtgccctctgagggggtcagagttttgagtggagatcgtgaccagaacatgtgcttgtgggcaggatcagagccttgtggggcagccgtgcctgagctgagagcttgtaaataagcaaacacagtctgttcccacctacccccaaccagctagggataaaatgaggtttgtactaggtggctttatagcatttttcaaaaggctttccttttgggggctttaagtctttttgcacaagcaaaaaagatcttgggtctgaacttaactgcattttgtttcaggagacttcattttgcttcaagagactcgtagctcagttctaggaaaatgggtaacagtttctctcaagaaaagaatgtgtgatggggaaactggtccctgccaaactggaaacgaatagttttatacgaatccaaaaaagtcggtatttcaggttat

SEQ ID NO: 115999 - DNA, 1018 bp, Homo sapiens
tgagctttcagtcatcgacctgaccctgcgttttccctcacgctccgattctgcttcctatcactgcctcctactgtactatcacagccaggacgagcacgggtcaggcactgaggctgtgggacactccacccgcctggtcccctatcgcctccgcctaggcagctgccatgcgtgcgcccccacagctctaggaccaataggcaggccctagtgctgggactcgaacggctattggttggccgagccgtggtgagagatggtgcggtgcctgttcttggccctgcagagagctgtgggcggttgttaaggcgaccgttcgtgacgtagcgccgtcaggccgagcagcccccaggcgattggctagacaatcgaacgatcctctcttattggtcgaaggctcgtccagctccgagcgtgcgtaaggtgagggctccttccgctccgcgactgcgttaactggagccaggctgagcgtcggcgccggggttcggtggcctctagtgagatctggaggtgaggcgggcggtgaccgagaagaggggcaggggcggcggggagcggggcggagatgggtgggagcggggtttgggctgtgttggtggcaattctggagcttccctcggccctgggaagtggctaccggcagctcctgcggacctggagggggctgcggttgcgctttgtcggtgtggcagctcggacccgcggggactgcaaggaatgtccttgaggcccggcaggccgagcggcggccggcatcagtgccggagtaacccggggtcccggggtgggcttgagaggcgggcggcggtctggcctcttcgtgactgcggtcatcatcggtggacccgcggggcgtagctgcgttcatcgtccctgttcagtcagagtaggcagtgctggctgcacggtcacgaaaatcggggcggaaagggtgtcaggcagggtgacctcggaggcccctggattcgagaaatgctaggggtctatggggctgtcgggccggcagctcgca

SEQ ID NO: 116000 - DNA, 1107 bp, Homo sapiens
tgtgggataaccatttcaagataagagtgtgagtatgcgtgcatgcacacactctttgtattcctttatggtctagtttctagactatagatagccacattatggaattacatggtctacttaggttgacccatgtgaaattgccagtatttaaaattcaactaacctacaaaaatagcagtttcatatgattccatttaacacttatctttgtcagagaactttggagctctagcttcataagtgaatgaagagaatagatatgacttaaaaaacaacatgtaatagaatgtgagctaattgggtatagaatccagatttcctgattgccagtgcaagattcgtttttttttttttttttttccttctttctggaataccagcttgagcagcagaatgctagatcttgttgggattgaaaatgactgccatataagacgcagttcttggcttcaaagagacaaaatgtacacatttattaatttgagaacactgtgagatagtatataatcaaatactggaatgtgtaatgcaggcggagtgctgagtaggaggaagtaagatgccaaaacatccttttctgcagttggccatggtaggtggcttctgtagcagattggattgacatttaagaattatccattcttttaaagaatctgtaaaagtttgcagcatactttttagtctgaataagtaaggcataccttgcctatttgtttctttaagtaaaattaatttttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaattaatttttattgcagcattgcataaatactgtcaacttaatttgcaggagctatcctgtagcct

SEQ ID NO: 116001 - DNA, 2228 bp, Homo sapiens
cccacagtaggaaatacacgttaatttaaaagccagacacacacttatataggtatagtttcttgaaacatagttttaagaaataatacctacccatactacctggcttacccaacagctattttttataatattgttttctattttattttatttaaaaatgtttgttcttaacgacaaaattgatgtcatgatgtaattgatgcagttgttgtggatcaacagtttgaaaactgtttagctagtggtgtggtatgtctgaaatgtagagaacatggagtgatgcagtgagagatgacacttggtatttgctttggttccttaaagctgctctttttttttttttttggtctttcccctaaccctttataaatagattaatgctttctttcacttacttgattgcctttttatagtctgtcttcaacagatgaatcacttttatttattactaaatgtgagattcatttgaattcttgctagagtggcagttaatgagctttttaaatctttttggttgatttttgcaggttactaatatgccttatcacaggcattgattttagtgaaagaagtaagacttgcaggtttatttgtggagaccaatggtaatagaagatttgttttcaaaatcagaatgtcataattattatttagcaaacaggaaatttagtcatggtagtcagtaaatcaaaatcttctatatgttcttttgggaatttttttgaatgctatatacagatacttcagccagtcatcctcttctagtactgttccagcttttgattagttgtgaaagtttggagcttttcacatctaatgcttttccattggtcttctagcactattgttgatgaatctgctagaagaaaagcagccaccacagcaaaattcttaaccctgttttattaatgtagaaacatctatcagaaaagactttttttctgttgacagcaatgttaggaaggtttattaaacatccttttgctagtgacattatgccatatgttctatggaatgaaaaagtacaagaggtccctgcccttgaggatcttatcaactaacatgatttatagcaggacactcaataagtggattcttgggtgtttaccttttgtgtaatcagaatgtagatgatgaagaagatacttaacatgcattttatatctaggtaattagaaaatgtgaatagctgtttctcacttgtgttttctgcttgattgctcttctacttgcaaggcttaggtaataaggtcgagatacttatctggtttgatcttaaatgtttgaattcatataatttttaagaaatggctgctttaaagttggttgccagtaagtaataaaggatttattgtttgagtgaagaagaaataacatagttctcttaattttataattattttccagaattataaggaacagtatcaaatagtcatatgtatgggacactgtgcatacaaagcagggtttatagcacacttttccttaaaatcttttcctaaaaatacaatgagctgtatactaagtgttcacccttgatattccttccaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggttagtgaagttaatttgatactgactaaagtaaattacattttcaatttttgaagagcccttaagcccctatagggagcacataatttttaaaagttagagtaaaatatttattttagtattttggaacttacctcaaatttctgcttacatggaatgcactggaaatgctcttattttgctttgtctttacaaatgaatgtaattgactttatttgagaaatacatcttttataagtgactaatagtcaaaaatgattgtgggccgggtatagtgactcatgcctgtaatcccagcactttgggaggccaaagcaggagaattgtttgagcctaggagttcaagaccagcctgggcaacctggacaacatagtaagacccagtctttaaaaaaaaattaaaggccgggcacggtggctcatgtctgtaatcccagcactttgggaggccaaggcgggtggatcacgaggtcgggagatcgagac

SEQ ID NO: 116002 - DNA, 1717 bp, Homo sapiens
ttttaaaagtcaaagctaatggaatttccttttctttctctcctattaggatgttttgagcagtgacattataattctgacaataacacgatgcatagccatcctgtatatttacttccagttccagaatttacgtcaacttggatcaaaatatattttgggtaatagttttacatatttaacttctggtgtcatcagatttttgatttgctgtggaaataaacctgttcattcaaatcatgtatttggaaatatgtgtattgctgaaagtgtgctgcatgcattgaatagtttccttattattggcaattagacattctgaaatttgagaccttaataatttggagtaaactagtattatctcagaatgctgtgtgacactgttattatttgtgtagtaaaggataaagtttttttagtattgaacttttgtcattttaggtattgctggccttttcacaattttctcaagttttgtattcagtacagttgtcattcacttcttagacaaagaattgacaggcttgaagtaagtatttaaaacctaaatatactttctgtcaaaatacattttaaaaaacttttcttccccatgctgtaaaggtacattttcaaaagttaagaaaataaggggaaatttttttgtataattttactattagctaattttaataactattaacattttggcatatatccttttctactgtttttatacttaaagaaaatatctgatatcatatatattgttttataatttctttatgcttaataatagtttatcaacatctttccatgtcccttttttttttttttgagatggagtttcgctcttgtcacccaggctggagtgtaatggcacgatcctggctcactgcaacctccacttcccgggttcaagcagttctcctgcctcagcctcctgagtagctgggattacaggcacctgccaccatgcccatttaatttgtgtatttttggtagagactgtgtttcgccatgttggtcaggctggtgtcaaactcctgacctcaagtgatccgcctgccttggcctcccaaagtgctgggattataggcgtgagccactgtgcccggcctccatgtccttaatgttaaactaaattgtttgtaatggctatatgtattctcttctgtctaaacgtcttgtagtttattaatcatctaatgttggactgttaggttatgtaattttttttattaataacaacactgtgatgaatgtctttgtaacgaaatttttgttcatatttgtaatcattttcttaagatacattcctagaagtgagacagtggttttgctttttttagagctttgcttttttttttttaagagctttttagtgctattattgccaatttagtttacagaaagtttgtttagtttatccttccacaggtagtgatcaatgaaaatttttatatattccactttttttccctaatggtaatccaaggagatattttttactaaggatgatactttgatacaaaattatcaaaaggtgtttaaatgtaaatatacttacattttaacattaaaaatatttttaacaaatattttgagcaactactatgtttagctttgaggatgccaaagaaatatagggtatacttttttgtctgcagaaaggtacacatactacaggatcatacagtatggagggggaaaggttttgttctaaaaagaatttttt

SEQ ID NO: 116003 - DNA, 1181 bp, Homo sapiens
aaatatagaatgttgtaggatttaattatgtgtgatttaaatgacagagttaatgcactacctcaaaggaatattcctaacaaatatcttattcagtggaaagggaatcagggcactatatgttcttttttaaaaatttggctgggcgcagtggctcacacctgtaattccagcacttcgggaggccgaggtgggcagatcacctgaggtcaggagctccagaccagcctggccaacctggtgaaacccagtctctactaaaaatacaaaaattagctgggcatggtggcgggtgcctgtaatcccagctactcgggaggctgaggcaggagaattgcttgaacccaggaggcagaggttgcagtgaaccaagatcacaccattgcacattgcactccagcctgggaaacaaagtgagactacatctcaaaaaaaaattttttaaaatcctttatattacaatcatactttgtatcttgaatacctgttagttttatcatattgtatattttactctttgaatagtaatttgatattaatataagccataggatgctctaacatttaaaaaagttgttctgtcccttgccttcattgatatgtttgatctgttttaggatgaagtaagggaaaatattgctcgtggaatggcaattttaggtcctacgtttaccctcgatgctcttgttgaatgtcttgtgattggagttggtaccatgtcaggtttgtaagcaatttttgccatattttaaaataggtatgtcgctaaagaggaaaaagaacatcttggatttgtattatttattgttaaattctgacttttaaattactcttaaaattttttattatattagtgtgtgggtatatctggcctgtttgctttggtggaaacttagcagcaggttactgatttatttttcactcctgccatcctctctttgtgttccactttgtgatatttttattcatttgatttcttttgtttgtttttttaaccaacattgcattccaaggttggtctggaaaacactttccagcccctgctgttacttagactcaattggtgacttggttctttgtgttttaattatcatgtagggagaaaagagtcaggaattggacagatctgagtaagattcacctaataaggtgattggaaatatttaatccgatagtaagca

SEQ ID NO: 116004 - DNA, 2700 bp, Homo sapiens
tcttaaaatttaggtaataaaatacaactttgagtttttgtgagcagtttttataggacaatttaaatttatgtttcaaagcattgggaattaaaaaaatacaatatatgcttgttctagtcagtcaaattatatcttaaaatgtaggtaataaaataaaactttgagtttttgtgagcagtttttataggacaattcaaatttgtgtttcaaagcattgttatgtttgagcgacatcagaaatatgttttatattatactcaagtttatttgtaaagtgagggagaaggatttggtggtcatctaaggtctcttctagcctctataattctgttttctatttgagatcaccaaatgataccttaaacagttgtagtacaatatgtttgttaatttttagtcttaagttggcattttgtattatatcattttccaaacagatcaatgaaataaccaaaattataagaacttcagtaggcatcatagaggttatattgaaattagagtttgttggtacacaaaaaatattattttgaccttatatcaggactggcataactggcaggatattctacttatataaaaaatccttggttaattggcaaattgcttttctcctaacaagtgggattagatcaatagtgtcactggggttttgctctgttagagtagcctgtcctctccttatttaataataaggcactactgcttgacaaaaaggaattggaaacacatatgttttatcaattgtgtattaaacactaccattctgcctggcattgtgatatggggacatgagagaaggcaagagctttgctcttgagggacttagagttctgttgttattcctgctgtttcctaaggcttggcatcacctctaagttgctaattctatttccagtaagtggcaaggagcttaatgtactaatattttcatgttttgtccacctgcaggaagacaaatatatccttgtgatatatgcagcataaaaaataacgtagactttactagttgtatctttaatttttctctaaccaggggtacgtcagcttgaaattatgtgctgctttggctgcatgtcagttcttgccaactacttcgtgttcatgactttcttcccagcttgtgtgtccttggtattagaggtaagaccaattcttacatatggcactagtagaagagtaagatttctgcttacacagtttacctaaacagaatcaataccttctaatgtcacactgacttaatttgtagctttctcgggaaagccgcgagggtcgtccaatttggcagctcagccattttgcccgagttttagaagaagaagaaaataagccgaatcctgtaactcagagggtcaagatgattatggtaatgacatggttttcttcttcttttagtatcctcagttccaatctcattatttttaagatttctttttttctacaattttggcccattcaatgatattgcacccccttcttcctttttttcttaatgtgttcatttctttgaggctcctggtctttattagcccctctctcctaaacagactttttaagttcccccaccttatctctcgttgaaagcctgttctttggggtgttttcagtagttcagtggggtcactactttagttagttgcatagcaagcttggggctttttttttttcatggtaaggggaagctatgagagataatgtctggctgtccagttgctagggataagaaatttaagttctattgatatgcagaggatacattactttaaaaattttatttcagtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaagtaagttaattgaaatctactttgtgatatattaatcataacactctatgctaatgtaagtttagattgtgtcctttacatttctgaataagattttaatttgctttcttttatttagaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaaggtaacttgttattctcttcgctttcaatccttcattgctttgtcaaaaagtagtctgttttcaaaattatgtgccgtgttgtgagatttcttttgatttcttgaacagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagaggtgaggatgataacataaactccaatgtggcatttttcattacaaaggagctttttcaaggaagaaaaatctagtatctgctgaacactacagctaagtt

SEQ ID NO: 116005 - DNA, 1574 bp, Homo sapiens
aaacagtggtacctatttatgtgtaggtagcaaagaactgggcagatggtagacagggatgggatgaagactttttgttatatctcttttaatatttagtttttaaaccatgtgaatatattgcctgttcaggatatcaaaaatagcaagtttactagagtttaaacaatagctgttatatctgacacacacttgaaaccttgctaaattcacatttatttttctttttatggtgtattagtgcaagcctgtctttgtattgtaaaatctaatgatacggtatttatattatttttgtttggcattttttgcattaaatgaattattttgcagaggtatcttttaattaaaaactacagtgatttaatttaaaaattacattattttagcttagcattgtttgtattaaatggtttataacatgaaatacagtccttcaagtcttctgtttcatctctctctctgaccacaatttcattttttttctccatttctttagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtatgttattttctcgattaagagagatttgctttgtatgtttttaatcttttttcttgattagtttcatatatgtacatagttttataaaacattttccttttaaatcattttatcctaattttttattctgcttatgatgtaggtcatagaaattaaaaatatatttcctgcttttatagtcattactcaaagattttagtattttaaacactttttaaaggtgaattaaacattttgtttaaaaagaatacatactaaaggattaagtttgaagatagttatactgacaagctgagataaaattttgtgcatttactatatagattttcatttggtgcctgactttaccttttaggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtgtaagttggcatttatatatttgccagtttaaaaatacatcataagtaaggcaatgagaagagttttaaggacaattagtgataccttttgggtcaagcatgagcatttttgggtaacatgtgcttgcttctctaacatatactgtgtagcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcaggtgtgtgagtggatttgtatgtacagttatatctatttgtttattttagaaccag

SEQ ID NO: 116006 - DNA, 1415 bp, Homo sapiens
tcattacttggggttttaggtaacagctgaataactagaagatggaatttattactcattccccagtgacatataaatatgagtatttttattgaatatttttaacattatcatcttttatctacatctttttcaacaatgactacaaagaacttggttttcataccgagaaagaaacacattaggaatttatacctgaccaagaaagtaattgtgatggttaacaaaacagctgttacttttgtgctcagtttctttgaagtatagttattatacttagaaatatatcatagatacaaattcttctcataaggatgaaggatgaatatttcatgcagtttaatatgtgtgtgttttgggttcttgttaacagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtgagtgactggatggataatttatcttttttattttgtaatctttaattgtatttaaaaatgggggaaaggagtattaacattttaaataaagttaaatatatgggacagtgttttccatcaaagatgactgttgtaccttgcccatctgtctgtgtgtatcatccataggaacaaactttactgattttttttaattttttttattttttaatggaggacagggcttaaatggggccacatctaaactttgttttctggaggttcagaaagatagatttgggtaacattcccctgaaccttctggaggaacatctaaatgtacacagctctgttttgtaggtattaaagactaccacagaggctatgattgaggtcaacattaacaagaatttagtgggctctgccatggctgggagcataggaggctacaacgcccatgcagcaaacattgtcaccgccatctacattgcctgtggacaggtgagctctccagcctccacttctcttgtgttacgtctttctaagtgaaagaagtatattgtatattttttcttttcttgtttccaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcaggtatgatgtatcaggcatagagtccacaagcctagttctgactctctgggtttctctttctatctgagactatgtatcactcacctctattttaattggtcttttccaaactcttttgtcatatcagcctaatccattgtgt

SEQ ID NO: 116007 - DNA, 2663 bp, Homo sapiens
ctgtcaggtgtggctgtcaagtcttggaaagttagtgcttccagtggagtctagttctattctgatgccattacagttgccctgtttttagttgatttagtaagaaattggtcatgattttaagggtgaatcttgttgtgtctctccctggctacagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtaagactcaaagatatatttaacatgttccccctatacttcaaaaaatatgcagtgtaaaaacttactattcatctactgtagttccaagttaaaattctacactcctgatatttatatattgctactttgtcattttctaccataggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaataagtgtaagcagtaaccttttttctttggattaaccctagccctgaggtctggaagcttgtaaagtctggtcatagtagtaacctgtaattcatgctaggactcacatgaccatttattctcaaattctacaacattgattgatagcagtattctattacattaaaatgagctctcttagagggtttgattagttcagatttatcatctcaactagacatcttttggatagtgagagtgggagggctagttaaggagaagaggggcagccacaaccaaacagccattgcaagcatttaagctgtgtgagctgaattggagaggggaatttgtacagcttggtatagctgaggatggcctctttagaaattactgtgagtcagtaattt

SEQ ID NO: 116008 - DNA, 2273 bp, Homo sapiens
aaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaatatgctggcttgatttgttttccttaaccctgagatattgccctactctgaatagttaagagcttgaaattcagtgttcttcccgtaacccagttagggatcaagaaaactactgagttgcagcctaaatttttttttttttttttttttttggagacagagtcttgctttgtcacccaggctggagtgcagtggtgggatcttggctcactgcaacctccacttcccaggttcaagtgattcttgtgcctcagcctcctgagtggctgggattacaggcatgaggcactatgcccggctaatttttgtatttttagtagagacagggtttcgccatgttggccaggttggtctcaaactcctgacctcagatgatccacccacctgggcctcccaaagtgctgggattacaggcctcagccatcgcgcccagctcagttttttttttaacaaaatataacaggaggaatatatcaagtacatgacatgtaataaatattttgtgtatcttttgtcatatgtattacacatacgtgtgtaatgggttacagtttacaatgaatttcttactgtggatcacatccagaagttttaaaagattggtagagaagccatattcacttgggtgtttctaaaatggaagcacagtgctggtgaatgatacacacttattttgtaattgagctgtatgcatttaatcataaataaataatctcatttatttaaatctcgtttaatctcagctccacttgttgcactcaggtaatttatgccctagaacaaccatgaaatgggaagtgtggacttccatttcactcagtcagtggattcatattgaaaggcactgagcatatttctctcctagtgttcaaagatacatgccatccaaacaatgtgatctgtaaacaaaagccaactacttaatctggtgggatgctggagggaaaatctgacttgtgttgaatttgatgacagagaaatattatgtggtcctcattcctagagggattttctagggcacttttaactgtgcagtttttctttagacttgactttggcatataacctgcaaataaggtgtagttctaactagcagtttcaaatgaggttgcttttataggatcttccagattttcttgccattattcgaacttggttacaacagagttcatactatcatttatattgtctaccttttaagacacattttctgtgaacgttccacatctgtatactttgaatagccttgcacaaataccataagtgaagctactttatttggcctcttcattctctcttcctatagaattctgtgaggttagtactagaac

SEQ ID NO: 116009 - DNA, 1668 bp, Homo sapiens
gctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaagg

SEQ ID NO: 116010 - DNA, 1022 bp, Homo sapiens
aaaaactgcaggaaagcctattttgttctagtattaacaggtactagaagatatgttttatctttttttaactttatttgactaatatgactgtcaatactaaaatttagttgttgaaagtatttactatgttttttgatgttcccctatagagtattgtttcgttggtttttgttgttgtcgttgttgttgttttaaacagggtcttgctctgtttcctaagctgaagtgcaatgacaccatcacggctcactgcaacctcaacctctggcctcaaacaatcctctcatctcagccttcccagtagctgggagtccccacaggcatgtgccaccatgctcagctaattttttattttttgtagagataggggtcttgctatgttacccaagctggtcttgaactcctggcctcagacaatcctcctgcctcagcctcccaaagtgctgggattacagacatgagccaccgtgcctggccttgaaaattgtagtttatagcctttaaaacttaattcttttattgtttcctttttcttctaatgcttatgtaaagaaattttgatattatagaactgtagaattgtagaagtgcaaacttcctgtattctttcctttcccagaaactgttatttttgttgtatattcctccagatttttctgtgtatgtactgacatatttttgaatgttaaaatgtttatacttactattatacaaaattcttgttttataacctttttttcacttaacaatgtatcttgactatctttctttataagacatgagatgtgtaaaacatctcattcttttaacatctgttacatgcatgttgcagaatttattaactagtcccatgttaatgtctgagttggttccatatttttactgtcaaccagtacagcactgaacacctttatgcaaagaggtagaatctttaactttattttggtgttgttgagacaaagtttctctcttgctgcccaggctggagtgcagtggtgcaatcttggctcactgcaacc

SEQ ID NO: 116011 - DNA, 1030 bp, Homo sapiens
tcttagctttcagccattgatttaacaaataactgagtgcctattgtgtttcatatactattctagctgttggggatacagcattgaacaaagcagacttaatttagtatctttaaggagaatatattctagccaggtttatttggttttcttagccatgttaaacagtcttttgagaatggtaaataatgcctaattcaaattgatacatttatttttaaacaactcacaataagtcatttatcacatatgcatgtttttatctgaggtttaccttggatttataattttaagtacttttttgtctgttaatttgaaatttttaattttcttttagcagaatatgttctataaatagactttcataaaaatctaaagagcagctgtattaaaagcatgctttcctgcttttatgggcttgatttttaattttcaaacagttttggaattatgttctctttaggtatacagaagagaagtagaagaaaatgggattgttctggatcctttaaaagctacccatgcagttaaaggcgtcacaggacatgaagtctgcaattatttctggaatgttgacgttcgcaatgactgggaaagtaagctgtcattattaatatattttaatctattattttgaatttaatatcaaatccaacctagttttctgcatctcctacatagtttacaaagtcaacgtagaaagtatttggaaaatcatatagaggactagcaatacatttatgtagagcttttcagtgtatgaaatgcttcctagtatgtaatttgatccaataacctcagtaatcctacagtgataggtaggtattattgcttattttacatacaaataaagtaaaattcagataggcaaagtgacttgtcaaaggcaacaagagctatatggtggagaagccaagactgaaattgaagatttctgtttcatcatctactctttcctaaactgtttccgtggtaaatcctaggtgaatccttttgtgattactttagaattattttatttttttagaca

SEQ ID NO: 116012 - DNA, 1044 bp, Homo sapiens
atcagtggcataagaaaggtttttcaccttttttgtattgaaatctttgacatatacatatatatctttgctcatctttgtgtatctttgctcgtatgagagcaaagatataggcaaagatatgctctctctctctatgtctttgttcataccagaccttcctgatatctccacataatcttaaatataggaacattagactggatgatctctgtgccccctttatctctactcttccattattttatactttaacacatcatctctgttttatgatatagaatggaatatttcttttttcctgaaaatgcttattttggtcacttgatacacattaggccaatatgtgttacttgagtgacccatcttccttcttttcatttctgtctcctgtcattaacctggatatctggaatgtggactaaactcttcaaacactatgtaaaacctactaacctttgtgcatttggttgctcagctactaagagcaccatttctgaactgaagttaactgaagaccattctgttttagagattatgacataccttttggattctcatgcctttttcctcccttctcaaggttgaagagatggtgcagaaccacatgacttactcattacaggatgtaggcggagatgccaattggcagttggttgtagaagaaggagaaatgaaggtaattccccctgaaatgttatagattgccaaaggcgtctctgtttcagtcatattatcattactattgatatgaataaggatagcactttcaacttacctttaaaacaaattattacatgtgatcaaagcagtaccatatattgagcaataaaatgtctttttgcttttctggctttgcctttactaaaggtttttatgattataatataaatatatgattaaacctttctgttttgactaggccatgaagaaaataaaatttagagaattagatatgaccaggtcacaattagctgatggtcctgtatttggatatttccttttgttttgtttttttaacatactgaatgttgtgcctagatg

SEQ ID NO: 116013 - DNA, 1036 bp, Homo sapiens
tgatctgcccacctcggcctcccaaagtgctgggattacaggtgtgagccaccatgcccggccctgcgtatgtttttaaaaagagactcatattcataatgaatctgtgacaaaactacataatactgggagactttggtttattgtgctaagctccacattgcattaaaatcatatcacagactaatcaaaaatgcaggaatacataggctataaatgaaagaaaatataatgacagcaaagaaagaatgtaagccagtaataaagaatgcctaagaattaggggttcagaacccaaaccagggccctcactgtagtgctgtagaacagctgaattgcttttaagtccaggtaactatatcactgagaagcaggtgcctatatttttacaaaattttgctgacagcttacttcttcgtaatattaataaccttttgtaaaactcatgtatgtaacttgagagaaatcttgctggatttttttctctaatatatggtgctcatgattgatcagatcctgttttagcctttgattatgtactgttttatatgccagaagaggtaaaaatgaagaaaataacattaaggtcttcaagtatttgttgtccttgctaaagcattagttgtcattagcagacgtggactctagcaattcactgttgtaattaaattgtgtgccttatgttcagcagttcctttataatagatgactaattcccaattgataagattttttgtttcagaggatgttacactgccttatcagccattatcaaaggatctagcaagttgattctgtatagtcacacttgagaatatagcattggatgtagatctggagttaatattagttgagaaacattgtgttatctggaaaactcttccagttcaacacagtgtaaaattatagtagtgactatacagtagtgttacattttacagttctcacaccctatagagacttttgtattaagcaaaataagaggctcaaaggttattcattaacattagaaacacttatgttatattacattgca

SEQ ID NO: 116014 - DNA, 1039 bp, Homo sapiens
taaacctgtgagtcagccttccaggggcggcctgctaaggtagaatcattggaatgatttggccagggtttggataggagagaattggcagcagcgttaagattgacccatgataaataatgctatgcaggtagcagggagtctgactaggagcaaaatcaacgaacttatcccttgcctaacatagtatctgtggagtcagaaagaagaggttaaattgggatatctgaggcaagtatcaggatttgccatgtctgcggagtagtttcataattctaatggttataagcactaaggcgttcactaagtgaatgttggtagttccaggttatattatccattcttgagttacaaaatacactttaaaaccttcccatcttaatattatatgtttttttagtcacagagtgaaaaggtgagattacattggcctacatccttgccctctggagatgccttttcttctgtggggacacatagatttgtccaaaaggtaagctaatgtcagagtttactaaaagtacaccttgtattgttcttcattgttggtggaaatatcttttatttgagacggagtctcactctgtcaccagagtggagtgcagtggcgcgatctcggctcactacagtctccacctcccgggttcaagagattctcgtgcctcagcctccctggtagctgggattacaggcatgtaccaccacacccagctaatttttgtatttttaatggagacagtttcaccatggccaggatggtcttgatctcctgaccttgtgatccacccacctcagcctcccagagtgctgggattacaggcgtgagccaccatgcccagccggaaatatcttgtagtatataagttttctccccttttcattaatttaagtaatgagactgtttttggttttatatattgtattccatatacatcctccaaaacagttagaaattttgttctgaaaataaagttctttcatttttatttaaggggaaagttgggggtgggcaaataaggagtggctagtccaaaatagt

SEQ ID NO: 116015 - DNA, 1046 bp, Homo sapiens
aatgtttactatgtgtttgccactaacaatttaggttactgttactagattttcagcttatttctctatccttttttcgtctgtaatttgtaaactatttagataacaagttataaaaaaaggttaatctagagttaaataactgttccatataattcttacagaagatattaaagaaaatgagattacatactgcaaaagttatttctgtacaatgccctaatgtggtatttaaatttttatttaatgaagagggaagatttctgacagtcactgggacacatgggattctgcttttttctatatttaatatggaaaagtaatggtgggagacatggcttatacatattgacagcaatataaactgttttccaattttgcttgctgagtattaggacattagctgggagaaaatgtttcctaaagtcaacacagaactgcactttttcatcaaatctttttaatcacttaaaagtattgtacttatattatcgttattgcttggtacatattctcagcttgtctgatactgagaatgaaaaacaacattggggtaggaataataaaaataggtagcaaagtaaattagtatcccgcaggttaaaatattaccgtaactgaaaacagttctatcatttttcagtcacacaggaagtccatgtacttcataggcaaataatgattaagataggaatgcttatattgctgttcagttcttagccccttgttctttttagtagtactcctctgatatatagagggatagaaggaataattcagcactttaatgtgttatttaattctcacagaagccccattttacataaaaatgaaattgaatggattatgagaatattgattattgattggtaagtagtaacattattttttcaagaacagcaacctaaaatactcatacagttagctctaacaatgtttacaagtcttaaaactattcctgcaaattgttgtattacataaatgttattgactcctcaaccatggttttttaaagtaatatttgttaattataaagtaagaaaata

SEQ ID NO: 116016 - DNA, 1075 bp, Homo sapiens
cccttccagtcatggtctgaactagtttttcaggtttagttgggtcctcttggccaggaggagggtacattcagctagttggtggggcacctagaattttatttttggtttacacccaaatacttcaaaaagtaaatcttaaagagagaagaaaggtcagtgatttttcaggtgggttcttctgtctgggaaggtgcttagcttttaccaagatagtaaaaggattgggaagattgtacactgagtagtgaagaaagaagatatttagatagctagtcatattaactaatgcaaccaatgaagagatgtaacttaacaagatattatgtcaaaaagacagggagattgttaaaaatcaatacaaaaagtttaggaagttcatttaaggggggaaaagccagaagatttgactgctgcttcataataggatgctgaaatgggtagtaaacataaataaaggtactccatgctattaatcatcagaaaaatgcaaatgtaaacctcagtgagataacaccatatacccatcagaatggctttaaaaaaaaaaacaccaccaccaagtgttggtgaggacgtggagcaacaagtaatctcatacattgctgatgtaagttataaattgtgcacacacttggaaaaaaatttttcaatatctactaaagctgagcctagaggtcccctctgctcagatgcatattgaaaatttgaagctctcacaagtattgatgtcataggtccattcattttaattaagctgtttagattatggggactagaggccaacctatattcccttgagaaatgggaaaattcccagcaaccaagaaaatttagaatacgctacctgcaaggcaagttggaattgtatacttaactcaagtgcttttattgttaacaaaactccaatcacctgccctcagctacaattaatatatctgtttcatcctattatttcttttctcttttttgtaattcctgtttattcataacttttgctctcctatcctattcttagtttctgtttccttggtttgtcatttttctgtcttttgatttcaacccctaactgcct

SEQ ID NO: 116017 - DNA, 2150 bp, Homo sapiens
agcttttctttcttggtttattgatttaagatttctcccagcctaaataaaattgactatgttacctttcttttttttctttgttttagctttaggactatatatttaaactttagtgttaagtttttaaaacattttctaagtcttagttatcttggtaatgttacttcagaaaagtctaaatatggaaaaaaattattgtttttctattatttaaaagagaaatgagctactattcaaaaaatctcaatgctctggagccaggccatgcatgcagcctctgccatgtatgacatatgtgagcttggctgtgttaattaacctcttcttagtgtttattctcagctgccatgttggtacttctgctcaaagtagtagtaagacataaatgagataatatgcaaagttacttaccagaatgactgatgtatttccccatttatggcatataggaaaagcaagagacttggagtctcaactaaattcactaaattataccatcttgtttctggatgaagagttttacgttaggtgagagaagctaaatgtgcatataaggagaacagcctgtttcatgttatttaatcagggccagccgtctcactagtgattaaagatgttattaagtagaattaatttctatatttttaatggagatgacctttaagggcttaatcagttgatttttattacagggcaagtttttttctgttttaattaaacatattttattttgctcacttttctctgttaagtccaatgacagttcctttgcaaggttcccgttttgtgttttcttcctttagtgaagattaatgcacgaagtatatatttctcctttagtgttgatttctttacatctttgaacaatggatagatttaatctttgggtctctctcagagcagtgggacttaagctgagataacaaattttgagtgatttttagttcctgaaaaaaatactcaactgcagggttgtgatgcattgtacaagtttgccctttctttttttttttttttttttttttgagatgaggtcactttgtcacccagcatggagtgtgatctcggctcacttcagcctctgcctcctcggttcaaacgatcctctcaccttagcctcccaagtagctgggactacaggcatgcaccaccgtgcctggctaattaattttttgtatttttggtagagacacggtttcgccatgttgcccaggctgatcttgaacccctgaactcaagtgatctgcccatgccagcttcccaaaatgctgggattacaggtgtcagcctctgcagccagccaccctttcttatttttaaagatagtttatttgtagactaggagaaatcattgttaattgttgttaatattatttaatgtactaaagtaaaatatgtgatgtatgccaactgagcagcctatcagtgaatatttaagtgaattcatatttagaatatgaattctaaaagtaaattgttgagttatttaacatgtaagaaggagaaatttcaaatgttgtcattgttttttttcctcccatagaccagggctagtgagatgtttcttgattcattcttcagtatcattaaggaatattgattgtggaagctaagtttagtaattttactatttaagtatgcattatcgtcttgatcctctatataaaactgtacaggcataatgatgataatgataggagctaacacttattgaggatcaccaagtactaatcattgtattaagtgctttatgtgttttattttctccctactatcctgaaaaataaagtagtattttgcagaagaggaaacaggtttagattaaaattaagtaatttgcctgagactgtactgtcttttagtttgtgatttctgagtattcaattttgtgttaattctcttgtctgtctgttaccattagtaaacggactgtttatgaacaattcccatgagctaacctcctgcaaattgtggtgtataatctgagttctcctactatacctatgcaagataaatatgaactcatttttcttttcgcccgtggattgtcaaacaggacagtatattatattggtaactgtttcagtagcggatttcagactccagagtctggcaaatgtggatttgaatcctggcactactatgta

SEQ ID NO: 116018 - DNA, 1053 bp, Homo sapiens
tcaaatgatctgtaaagaccagatacttaattgcttcctctatcctacaatctcctatcttgttaactccccttagttagcatatgggcatatgaattaggcctaaactatcagaatgttgcgctgtccttctctacccccccttttccttgttttcctctccagccttactttgattctataacaggaccaatacagagaatcaagagacaggaagtttttcttctgatagtgctggcagcaggagaatgcagtttccagtagaagcagtgccagtagtggctttacagggtccagaagtggaagcagtcctgtccatacaaatggcacctgtggtgcaatcccagcaggggtttttgttgcctagtctaccctggctcctttccattttctgatctcagttctttgtatttcttagcaatatgaactgcctaataccttctaaatgaattccttttcttcttaagtgagcaagaatcaatttctgtggcttacaatatagagcactgattgattcatcttgtttgtacctaataggattcatttagctgtcttgttgagtaaagaaattctaatattttgtgtttatttgtaaaaacagaaaagagatgctagacttagacaattttaagtcttcagcctcacaagtgtttggcaggatatttggaaattatcagatatcctactgtcagggtagaatagggtcaaatctccattgtgatggtggtgctaagtgtctgtaactctaacagaaaaatcagccaaccatttttctgactggtagaacctgggaaagttacttgctttaaccagggctattagaaagcaagttgaaaacttgaaaaaggagagagctagaggaagggatctcagaattgtatatataaactcttcaagtctctggttgactcctgaaccatgcatgtgtgcacctgactgagagcagtctgaaccatgtccgtcatggcagagatgtgagagagctaaaactccattaaagaaaacctgccatcattttagctgtaggaaccaggcaaaagaacctagatagta

SEQ ID NO: 116019 - DNA, 1099 bp, Homo sapiens
atatattccatctttcaataacatgattcagataatgtaactcaaatagcgtgaagtagaaagtacttaaaatatttggtaagaggccttggaagaagaaaaacatgaaaaagggcacctgttgaaatctgggtttcagaatgtggaaataacttacagaaaattatataattttaattatataattatacaatgtattcatttgctagggttgccataagaaagtaccacaaactgggtgacttaaacaacagaaatgtattgtttcacagttccagaggctggaaataggatcaaggtgtgggcagggttggttccttctgttggcggtgagggagaagctgtttcatgagtttccccttacatctggtgtttgctggcaatctttggtactccatggcttgtggatgcatcactccaatctctgtctgcatgtacacatggcattctttttatgtatttgtctttttccagatttcccctatttatcaggacaccagtcatactggattaggggtccaacctactccactgttatctcattctaactaattaaatccacaatgctgctgttttcaaacaaggtaacattcagaggtactgggagataagccttgaacatataatatgattttgaggggggcacagttcaacccgtaacacaaagtatctgttaagccaagagccccagtctgattgccatctgttattttatgacgtcactgggcttaagaaaattgtatatgtggtgcattttattttgtgtaggggttgtaggaacatgactgttaaatatttataaagcaactcttaattccgaagtgcttaaaacgttgtgcatgggccgtgaagtcaaatctgggttcagaccttaactgtgtgtattagtccattctcatactgctgtgaagaaatacctgagactgggtaatttataaagaaaagagatttaattgactcacagttctgcatggctggggaggcctcaggaaacttacaatcatggcagaaggcacttcttcccagggcggcaggagagagaatgcaaaccaggcaaagggggacaagctctttataaaaccatcactcccatgattca

SEQ ID NO: 116020 - DNA, 1038 bp, Homo sapiens
tttagttattgtcaaatactccttcaagagtaccactcctcactcctaccagtagtgaatgagtgcctctgtttctccttacccgcaagtattgaggaagttgggtttggcaaatgttaaagtatttgtcaaactgctacattaaaatggtatcttattattttaaattgcactttttatccatgaggttgagtaacttaataatttatagcccatttttatttctttttccttttccaattgcttatgcactttttttttggtttttctttcctttttggcttgtagaaactcttcatatggtaattaaccatttggcacatttgttgcaaatattttcccccacattgtcacttgtctgtttcttctttgcttgttttatagtctatattaggccctagagaaatcttagatttttacatactcttattgacatcttttattacggcttctgtatttacttgtttagataggtgtttctctctcaaagactatctctctatatgaatgtagatatattttcatctaaaatttacacttgaattttgattcctgtggaagttattttagtttaaggagtgatattgatgtttttagttttttttccacatgactaattatgtatcctggtagcattaattaaataactaacctttttccaagtggtttcaaacaccactttcatcatatattacggtcccatatttatttaaggttgtttctggactctcttctgggcatttggcttgtccttcttatcctctgtttaaaattatattgtgggtatttcatcaaccagttccttaaactgctaatgattcattggtgaagatagaagtaatttatttgcagttactaaagttaaaacaggtagagatttttggtataatatcttcagatagaattagttttcctaagttctgtagtttcatgtctcaccttaggcatctgcctttgtatacctcatatcttgttgaacttttaaaatcaccagatgagtagaattcctattattcttatcataggttggttttaggg

SEQ ID NO: 116021 - DNA, 1051 bp, Homo sapiens
atggggtttcactgtgttggccaggctggtctcaaactcctgacctcaagtgatccacccacctcagcctcccaaagtgctgggattacaggcatgagccaccgcgcctggcctacttagtttacatttaacttagtatatagaaacaactgttcctttttgcactcgtagtcattagacatgaataatgtttaagatatgtaagaactataacaagtaaactggcataaacaggtttgggaacaaccaactgacttgttaagcatgtaacccaactagtgagaacagaagtacctgataatacaaaaaatagcatactggttaagaatggtcagcatgccatgggccaaaaaaaaaaaaaaaaaagtgttggctaaggccagacagttaaatagaggtcagttaagggagctgttgtagttaaaatctgaaaatgggtacgttaaaacaaaaatacagagtttactaactcactcaaagagaagtcacattttgtgatagaatttatttggcttataaaagtgaaagatatatatataatacttcagatttccgttaatatctaatccttacttagcgtatgtttgttatgcatttagggaaaatcttacagtatttttacattattttttatacattatttccccccttgtatattcaaagtttgaaaacaaaagtttagaattgaatatcaagttagagaaacacagaagaaatatttggaagtgttgataatgaaactacgctctctattcttagagacaatttttaggaaatagctttaacataaaggctcagtatttattttgactggtatgtggtacattgtaatgtgtttagaaattgtatctagtttaatattttgggtgtttttcttccgagatagatcattattcatatcaatggacagaatagtggattgaaatgtaccttgcgatcttgaagtgtttttccttgatcctccactccccttcttttgcgtattattattggatgtttattagttgcaatgcttaactctttgaaaatagtataatgattgatgtaaaaa

SEQ ID NO: 116022 - DNA, 1076 bp, Homo sapiens
cttcatgcagtctttggtgtcagaatgagagactacatacataactgaacatacttctctgttgaatatgttaattatgacaaggaccaaaacaaatatcatgaaggtacttaggagaggatgaaagcatacgaagaataaacaataattttaaccaaaatctggctttcgttttattcttcaaatgttagaagaaaatgttatattttatttcttacagatttatttataatattgtaaaaattactgaaaatcattatgcaatctagaaaatctcaacttttcactttttgtaatcattttactgtttatgcttagaattaagttggacttttcacgttttggttttaaaattagattgctgtttcacaaagtttggatttctaaaatacttctattttttgttttcttctctcttcccttccccttcccactcccagtggacaaactacattcatgggtggcaggatcgttgggtagttttgaaaaataatgctctgagttactacaaatctgaagatgaaacagagtatggctgcagaggatccatctgtcttagcaaggctgtcatcacagtaagttccttttcttcttcattcaacaaatatttattgagtgtcagctacataccaggaactgttctacgtgttcaggatacatccgtggataagataaagatccttgtccttgtagaatatacattctaatacttttttccataaagtgattttactgtggtttttactacatattgttattttgcatagacatgtagtttttatctggtgggtatatcaaaccagtttaagggcttcaggaaaaaaaaatgtttgaagcctttttatttgttgaggctgggacagttactttgtaggttactgaatatttaaaaataatacatcttgtaagtaacattctaaaattttaacttaaaaatataaatgtaaattcatttttaaactttttaacattgagctaatgccatctctttgtggagttgggagaagctgttctcatgttcctcacacatgatttgctatttacagttttgatttctctaatgtggaataaaagcc

SEQ ID NO: 116023 - DNA, 1027 bp, Homo sapiens
ccttagttcagaatagagatattgaatcggcacatgatgggtacaggaaatattcatagtaacttggaacatgtgagaatggagactgatctttagtccaggaagagcattacttaataataaaatatttttgcggtaaggggtcgagggtaaggaaaagatgttttatcttttatatattttttaaaatccctgtatcaaaattttagcaaagcagtcattataggactgcaggtggatgatctcttgatattacatagttgtggggattttttttttaagtttttgctgtaagaagattcacgtagcctttttgacttctctctcccttcctgttaaacttttttagacatggctggagctagcagttaacttggagagggggagctgggccagtccctcaacaagctggtcataagatactatgtcatgtgcagccagtggctattaagaaatcaccctgtttccagtattcatatttggcaaatcacttggacattatttgtggaattgtttcatattaggcttttataatgtctagaaagctaatgagaagggggccaggaaaggcatgagtagtcagaactaaggattgcaagtgttgacttttatttgtatagcagcaaaattatgttgtatattgatgctgtgatcattcttgaaatttcagtgcaaggttttcagtaacgagaagctcctcaggatttctttagattaaatgtatcctgtaatttaggaatctctattgaacacattgtgtagtaggtatacattttcagttggtaataggaagtgggttacttgcttctcagtgattttggtagtttcatcactgctcataagatgggaagctgactgccatattagtattgtgatgtgttaagtattttacgaaacaaattgtacttttgacctactgataattacttttttgggggttgggggagtggagtgaccgggggaaaaagtaaccagtgctctggagtaggtatactatagataaaaaaatggaagaccaatctcgata

SEQ ID NO: 116024 - DNA, 1031 bp, Homo sapiens
ggccgctgagtcccgcgtccactcacacctccgctaccgccgccatcttcctgcctggcccactatttaccctcccctcccctgtcctttcccctccccttcgtcctcccattctcccccactactccccgccccgtccccctcccggcgtctgacgcgacacgccgagccttcgggatcctcctcccgaaccctacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacgggtgagtatcccgcgcggggatcgcttgtccccttggggccttgtcagtcggtgggtgggcttcgtttgacagttgcgtgaccagcccctcggcctcgcttctatccttgccttgtgtgtttatgacgaaccctccgggcttgcgggcccagacgtgagagagctttccgctgaagatgacgggcctgctttccagggcggcttgtcgaaagcccgggagcatctggccgcttccgcctcaaccatgggctggggttttgtgagctactagtgccaagggttttctttccaccagaccaccgctgtaaatctcgagggtcttactcattagaagttagaattcacatttgacgtttaaaggaagaatttccttagtaccttctcacaagcacgcacttcgcatttttagatttctagagtttgctttgtagaaagtaattttgaggttgtcagagaataaatgacgttagaaaggtttttaaagtaaaacaagaatgtgagatgatagcctgggattttctcttggttgtaaatgaatatcttactgagaaccacgttaaccatgcctgcccctcaaagataggaaaggttggatatatagaaactttctcgtattagaaataccgaagtgcagtggttttgtgtgtacaagggattaggcaataggaggctatttttg

SEQ ID NO: 116025 - DNA, 1386 bp, Homo sapiens
tatttttttgtgtagacagggtctcactatgttgcccaggctggtcttgagttcctaacctgaaatgatccttccatcttggcctcccaaagtgctgtaatcacaaccctgagccactgcccctggcctaattttatattaaaattgtaatattctagattgtagagcttaaaaaatacagtaccaaaaaaggtactacaggagaaatgttttctcgttttctaaggacattagtatgaactgtcccttaagacctgtgcattttactgaaacaaaattagtctgtttagcatcacttttatatagataggtatttttgccgacatctagtgcccaaagaaactcccagcctatctccttcatgttgattcagcattccaagaaacaatcaactcctataagataaaaacttagattttcacacttttgagtatgtttatttctgagttaaagttttcattgttaaagaacctggaaggctttttataaaatatgcaactcatcatccaaatagaaacttaaaaacttggaggctcggcgcagtggctcatgcctataatcccagcactttaggagacagaggcgggcagattacctgaggtcaggagtttgagatcagcctgaacaacatggagaaaccccgtctctacaaaaaatacaaaattagccaggcgtggtggtgcatgcctgtaatcccagctgcccagctactcgggaggctgaggcaggagaatcgcttgaacctgggaggcggaggttgccgtgagccgatatcgcaccattgcactccagcctgggcaacaagactgaaactctgtcttctgtctcaaaaaaaaaccaaaaaacaaaaacaaaaacttggggcttggggaattgacctttgaattgacactgtaggtaatatgtttatatcagaatattattcatcctgtcgaaagaagataatttccacttattgttctataagaatgaatttaatgtctttaggatgaagtagagtatagatttttaaatttccctctgtcccattcttcttcactagaaccaattaaatgaataaaaaaaggagaaaggcagtagaagagaatacatgcatggttctcacaaggcaggccttctgtctctggtaaaaaacttgagttttagtgtatatactcttggtttaggatctgtggaatttcattatttctgttctttctctcagtgacacatgtaaatgagaaaatcattcaaatccagtctaaaataatttttaaagttttttcctcttgttttgcaaaaatattaaaagctaaagctaaaaattcaaagttgcacctatactttcatttttgtcatacaaaaattgtggccatatggtttcagtgtatgttttcatgtatctgt

SEQ ID NO: 116026 - DNA, 1033 bp, Homo sapiens
agacactatgttcagtgatgaaatgatgggcagttttttgaattattttctacattttctttaatgacttaacattaaatatttgaaaataccttgtaaggagtatttttttaatgcaatagataactgatgatccaacccactaaggcctttgatacccactgtggatcctacctaggacatactgttcttttctgaatgcaaacctgtattcatctcagagagcttgtgctgtgctaagtactgctcacaacaatcctgtgatttagttaactactaataaattcatcttacaaataaagaaactgagatgtagaaagattaaataattttagggtcacctagctagtaagtagtagagctaagttttaaatttaatcttctgtttcctgagtatgtgctcttagccaccaggttatactacagtgatgctttccttcagacatttttcttatgctttgttttgttttcctccataggggtccagattttatggaaatgagctcaagaaagaaaagcaagtcaaccaacgaattgaaaatatgatgcaacaaaaagctcaaatcaccagccaacagctaagaaaagcacaattacaggtattaattaaattgttaaataaagtggaagctggtagaatagtaattgacagttaaaatgtattgtcaagtcataactgaaaacaagatgaaatgtaaatgttcattatattgtaaagcatacatattcagcaaatgaacatactttactttgctaagtgttgctctgctcatttacataaagactccacacatagacattgtcacctctattatacagaagagtaaatgaagtcttaattaagttgagtaacttgcccagcttgataggacaggtagttagcagaactaggatttaatccaaagcctatgttctttttattgtatacatcgcagctagaaaaggccacgggataaatgtggaatgttttctgcaatgctgattttgcaaaaaaaatttgaggaatatgttaactaattaaattggagagtaa

SEQ ID NO: 116027 - DNA, 1001 bp, Homo sapiens
agtttggaaatatccaagttgcagggcactgtgtggtagactgacaactcaaagcagtcaaatttctgatagtaaaacaagtcatggcaagaggaatttgctctttatcaaaatctgatccaatgttaacagagctctatagtctataaggtaacaataaaattagattaatctaatatgctacaaaatccttctcttgtgacagagttcaaagatcataaattttatgttttctttatcaaactatacaatgtgtgattttttgatacatatgccttctcagagcacaagataatttttaagtggtcttctattatgatgaaagatgatttatttgtcatatcatcatttttaatgcttcacagcattccactgtgtggaggtaccataatttatttaccatatcccaccttggtttcagttttttatttcatacgcaaccctgtgattatcattcttatctttgtactctagtgctgttattttgaccaaagatggtatcattttacattttcaacatgaaagtattgattttctcacatagttgtaaaccattaatatttccttattatgagaatttcctcttttattctgtttgcgagtatatacactaagttgctagcacaagagaccaaaaatgtaatattttaaataagagctgctttctttctcacataataagtgagtagttctagctggtgagtggctgattatcatttagagacccaggttctttaaatcatattgttccatcatcccctggtgttatccttacctgaattaacaaaagtgaattattttccatccatattccatctcctggttaaggaagaaagggaaaatattgaaggcaagtacagtaatttgctattaaacaagtgaaaaagaagttgcacacattacttcagctgacattctttggcaagaatttaagttacatggccacacctaactgcaggagaagctataactttagctgggtgccatgtgcccagctgaaa

SEQ ID NO: 116028 - DNA, 1049 bp, Homo sapiens
ttccaggaacaatattcttataatttttgttgttgttttttttttttggtctgggtattgtacttggaaaattattcctcataaccatgcctatgtcttcttttagtatttttatagctcttggcatactcatatctttagtcaatttggaatttgttttgatgtaaagtgtgaagtatgtttttcttaaatggtgttatgttttccctgcatagtattattttccctaagtggtgattcacttgtcccaactccatttattgaatcatgaatcctttcttcactgagttgaaatgaagtacttccaaattaaaaaattctcaattgttctttgatttatttctggactctctcttctaatcaattcagtcttttcctgtatcagtaccatacagttttagttattgaacggtaggaatatagtttaatattctcgcttgtaactcttctttaaaattttttttgtatttctcatgcatgtttctttcaaataaacttaggcatcattttatcaaggttttaaaaaaatcagttctatccacagtaatattattttaaaattgatattaatccttaagcaacgtactttctggacattttcattttattgatctataatctacaaatatatttaacagttttaatgatacagtatataagtgatgctaacaactgttagctattcatactatttttaaagctcatatccttaaatatactaataatctgaaggaatagaaagtatctttcattgtatagcagaatttaagattttgttccagttttggttgactatttcatcagaggctctctggcatcttttgcaacaggaatggcaggaaacgtgttttatgttgattgttcaattgtttcatttgttgagcttcctccaaaagaatttgtataaatgggaggagattgaggaagtttaaggagtcaagaaggcctgagagaacagagttgttttcgtaggaaatgtgtttctattttagagtcttaaaatttccaagtactcgattttattatgtgtgatatgatagtatgaacta

SEQ ID NO: 116029 - DNA, 1740 bp, Homo sapiens
gagtacaacatgagggaaaaagccacatatacacctatagctctccacctttgagaaaacttgctagagggaactccacgttccatagatgaccccacttgctcattgctggctgtttttctctcagtttttaatgttttattatgcagctatccattgatccttttagtaatagatgtatttattgaacttgtgccatgtaccaggtactgttctatgttctgtatattttccagcttatttaatagctttcttatgatttttactttaatggtcttggtaacttccctatgttgcatagatcacaactattacacagccacctccagctgcagggtaagctgggaaagtgagtatttagcctttcttgccttgatagtggaggccggccacaaaaatggaagttagaaatgagtatgtctgctgcaaaatcacttttcttacttgcttcctttgtttatttctaccccctttcatttctttctcgttgtaaaactaagttgttagttttctctgaagaaactaaaattctttaaagattaagaatcttcactattgtatttgacatatatattaaagttcatgaagaataaattacagcttgggttttaaattttacttgtatagattaacatcaaattttaacattataaaagcaattctacagaggaacatttacattatgctacagtatcttcagttgtaccttcctgttcagcataaacatcatatgccaaagaggtactatattttgttgtatatttcctttgttgcttttttaagacattattattatgaatcaaatgtcagttgtttattttacttacattgaagcttttagttatagtgagttggactccaaatttataaagcagtagaatcatttgataaaagcagttggattagatcattcattcattaaatattaagttcctgttatgtgcctaagggtatggagagatgaaagggttagtagggaattatatttgaggataggctgtctctatgaaaataaaagcaattaccaattttaatttaaaaaacaatacaatatacatagataaacacttataaacaataataaaatataaacccataaacacccatgaacaacaaaatacacacccataagtaagtggatgggtggatggatgaatggatggatggatggatgaatgggtgtgtggacagagactgatagacacttaataaattaagattaatgttgtggttaatggtgtttcaatattatgttgtctaaaagtatgttaacttttttaaaaaattaaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctggtaagtaaagatcaaatacaaaaaggaaattttataacgtactcaagtaagctttactgtttcatgaagggggaattctttattgaggtctaccagtttgctgagtatttttctgggtgccttatatatgactcaattactgaatcctttcaacatactttaaggcaggggaccccaacccccagttcacagattggtattggtccatggtctgttaggaactgggcctcacaacaggaggtgagcgtcaggcaagcaaacgaagcttcgtctgtatttacaaccacttcccatcac

SEQ ID NO: 116030 - DNA, 1057 bp, Homo sapiens
agtatgcaggcagctgataagtctgattccaaaacactgttttttgaaaggaaactcccctttcctacaaatcatcaataaatatttcaaaaaatatatttaattttattaagatataacaccataaatttatgtatgtttatgtatgtgtatacatacaaacttgctgtagccatgttaaagctaaaccaactgcttttgaaatctacaaaatattttctttcctacaatttctgtcctcctaaaaatcagttattgtttctaaattcaaaattattgttatatttaaacaaagattaccccttttgtatgttgaacaaatagttttcccttctactaagcataactttttgtcctattaaacatatgaaagtatatctacaaattaatgggagtgattgtttgattattcccactgataaaattcttttttggcgaatttgatggatttttgaaatgttctaacttggcactgagagttgcaactgagatcctacagcagttacctattgctgcataacagcctcccccagtatttagtggacagccaaaatttatttgctcatgattctgtaatttgagcagagtgcgatggcgatggctcaaccttgctctacctggagttggctagggcaatttaactgaggctaaaaaatccaaggtggcttcattcataggtctggcacttcgactgaggagattggaatggattccagcttcagaactttctcctctccattgttgcttcaacatttagtaatctaccccaaaatatttacaatggttgctggattacaaaaagcaaaagcctaggtttcagaactcagtgtcacttccttcacattatttttatcaaggcaagtcacgtggcatgaggaactagaacccacttttgataagagtaacttgtaaagtattgtggctgtgatctacaatataccacaaatctaaaagttagagaaattcttatttaaaagtttgtttgtcctctgctatagatctagcttttatgtcaattatattaaacttatttactaaaccattggttttgtttcta

SEQ ID NO: 116031 - DNA, 1024 bp, Homo sapiens
ctgcatatagcatccagaatacatcattctttttcccaattctttgcctttccatgcagttttcatttgcttagaaaacttcccatttcctcaaactttgaactgccttaatgataatataaaattaaatttagctattttttcttaatgtacaatatacattttttctagaaccacattttatttataacttacagaatctactcatcattaatttcaacctattgtctgaataattacttattaatgttgttaaacagtgacaaaattcatgtattttgattagcctactttacttgccccataatcatttgctgtctaagagactgataattgaaaagggagtaatccattgcttcaaaaaggatctttgaagtagatttgattatttactaaaattgccaaactgtcatatgtgaaaaccgccattttttctattttttatgacaactggtctatcatgcagtgctggaatttaatttttgaattaaaattttagactactacatcaaatacttttagactgctatagtaaaatgtgtttaagactgctgcctgaatggaaacacttaaaaaaactgtgacctaatacttattactctttagttataccaggggtctttaaattcacccctcttatttgtattccacctcattttccctagaagtgacactattccaagtttaaacacaggtttgtttgttttttttctgtccaaggcagtctgtgacagcaagtgctttttgcatacctctgaaaaggtggtggaggagaggggagcacacttacatttggttactgcttatctctttcattgtattcctaattaaaaagagataaaatactaatcataaatatagccttttaagaagttttaaaaatcctacaaaagtttagtaagaaaaggtattttttaaagtcgtactttaactcagcaaaacttctggcagtatgccagtgaaaaccaaagtgtttttagttattttagtctggttatttatgtaagtcagagaactcttcaaa

SEQ ID NO: 116032 - DNA, 1050 bp, Homo sapiens
tttcctaaggtctaactaacaaagagtttggatggcattgaagctgaggaagttgtctgtttaaagcggccttttcttgttgttagaaaagactagcctcaaacatatcaaaacattggatgattctatttttcttcattttcctaattttctataatctaattattatagcaattatgactgtttttagctctgccaaaattaatgacttcccactcccttctttgccttagactttataatttcaagactccagggtttttttaaaaaaataatccctttatgacctatccaaaagcaatgccaagaaacatgcagatattacacatactgctttcaacattttgtcaaaggtatgattatgtctgagatgtcctggacccctgaacaaagttcacctggatgaaaaagtgacacagaagggtttgctcacaacccacaggaacatttcatgtgcaccactcattgcttcagacgggccaggcagtgctggggagacctgtttgtaactttccctgaagcaaaaatggtagatccacaatgacattaatctaactctctcacattatttgtgactcacatcatttgatgcaagtttaatatgggcatcaaatacaacttcattaccttatttaaagtgctaagggatagctctctctttttttttataggagcattaaacaataatcatcatttctcgacacaggcacagagcaaaaggttttccttatttggtgtaactttattgtttgaggatgtggaacataaagcctgatgtcactttgtataaaatcttactttattaattccttactttcacaagagaatgggggaaaatcattaaataattatgtcaaagcatcccctgagggcctcccataacaattacttgcatgatgtgttttaaaagctttacattgggattaaagtaaatgttttcattttctactaatttttttcttttttttgagatagggtctcactgtgttgcccaggctggagtgcagtggtgcagtctcagctcactgcaacctccgcctcctgggttca

SEQ ID NO: 116033 - DNA, 2032 bp, Homo sapiens
cagagaataaaccaaaatattttgccatttttaaaatggtaaaattatccctcaggggttccagaaagtgtatactttattattttttagagcttctagatttttctgcatatatacactattttttcagtaattgcactatgcactactgtatatgatgttctaggacttgcttttctcattcaacataatgtacatgaatgaatttaaatatttttcaatgctcagtatgtaatatgtaatgattactgactagtatatgtgaggagtagctgcaaagcagtgttttccaatatgtttttcaagtatggatagatattccctttaaaaaggttctggggtcagatacctttggaatgtaccattgatgtgtcactatgcatattaatatattaaaaattcataaatcttggaataaaaagtttcacttaaatttgtcaatcccaccattccccaagtttatatgacaacagcactccttttttaatgccttttgaaattccatgaaacgctagtttagtaaatgtggtcaaaaagtaattaaagcagttttcttgcatgacttgtgaagatagtcacattattcataccttttatcgatgataaaagatataatgagcactttgggaggccagggtgggcggatcacctaaggtcaggagttcaagaccagcctgaccaataagaagaaaccccatctctactaaaaatacaaaattagccgggtatggtggcgcatgtctgtaatcccagctgctcaggaggctaaggcaggagaatcgcttgaacaacccaggaggtggaggttgtggggagccaacttggcaccactgtactccagcttgggcaacaagagcgagactccatctcaaaaaaaaaaaaagtgtaatgaggttgtaatctcaatttttagcttcactttaaaatctattaataataaatattgattcttttctaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgaggtatctatatgtattgtcattctgctttttcttcagcatttgctgcaatatcagttttaaccattgagatgaggctatatggataacatgttttaaaattctttcaggctagtttaattcaaaatataatgtttgaattagagtcaacagattggatgtaggaggaaagaaaagaagaataaagaatcactcctaggttgtggtgtcagcagttgtgtagagagacaagaggaatgatagtttcttttttatccctaccttgttctttgttcagaacctaagagaaatgccagtagtcaggttgttgtggaaagaaagatggccgtattccataattcaccctttaaggaaggagatgtaatgattcttcgaaagccttaaactacatttcttttcttttccggattcattcattcagtactgactactttactttgtgttaggcactattctaggcactgtagataacagcagcgaataggacaaattcctgccctcatggagtttacagactagtgtgagagatagaaaataaccaaataaacaaatgaagaaagtaaagcagagtgagggtatagaaaatgactggggggtaagtgtgagggttagcaaccatcatccaaaggcggagagacctgagggagccagccatgcaaaggctggaagagggaacaggtggaggaaataccctgggttttcttccctgccactctttcatctaggtcttaaaaagaggaaccctagaggtagaaggtaaattgttgtgggatagtaggtgaaaagaaggaaattttaaaagactgggaatcgtggaagtcaactctgggcactatttttacaattttgtcatcaccttgtcagcctgtcctcaaaatgactcctttatattcttgtatttaaactaaag

SEQ ID NO: 116034 - DNA, 1345 bp, Homo sapiens
acccccatctcaaaaacaaaataaaatgggattttagcttatgtttggaaagggaagtaaacgtttttggctaaaatggtattttaattattctttttttttctgagacagagtcttgccctgtcacacaggctggagtgcaatggtgtgatctcggctcaatgcaacctccatctcctggcttcaatctattctcctgcctcagcctccccagccgctgggattacaggtgcctgccatcacgctcagctaatttttgtatttttattagagacagggtttcaccatgttggccaggctggtcttgaactcctgacctcgtgatccgcccgcccaaaatgctgggattacaggcgtgagccactgcagccggcctcttattctttatgatatgtttatcaccatgttttataaataattggttataattccatattcttatgtccgtaaacctttctgaatttttctaacatgtaaatgacttttttctagaagttaggaagtcatacagaataatgtattctggttgggtgcagtagctcatgcctataatcccaacactttgggaggccaggatcgcttgtggccaggaatttgagactagcctgggtaacatagtgagactctgattctacaaaaaaataaaaaattagctggtgtactggcacgcacttgtaatcttagctactcaggaggctgaggcaagaggattgcttgaacccagaagttgaaggctgcagtgagctacagctgtgccagcgcactccagcatggacaacagagagagaccctgtctcataaataaataaataacatattgtatatgttatagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtatgactttttcatttttttgtttttccttaaatctgctagattttcccaaataatcaactttgggaatacagggggcccccaacttaacaatggttcaacttaatgatttttcaactttgcgacagtgggaaagctgtatgctttcagtacactcttgacttacaaggtggttacatcccgataaacccatcataaattgaaagtattgtaaattgacttattatgttttcaatttacagcgggtttatctggatacaatcctactgtaactcaatgagcacctgtattctcgccttcattttatttcttaaacctgtttacgaagttcttcctttgct

SEQ ID NO: 116035 - DNA, 1040 bp, Homo sapiens
tttgtccagcgcccaggatgtattccaagggtgaaccctatgtaagctatggactttgagtgacaatgttgtggcagtgtaggtttatagattgtaacaaatgtaccactctagtgccacatgttgatagttggggtggtggaggggtgtgcatgtgtagggaaaggggatctttgggaactcattgtaccttctgctcaattttgctgtgaacctaaaattcctctaaaaaataaagtctattagaaaaaaaagagctaaagagtctgtatagttgactccagttagttactggtattaatttaatggtattatgtgtcacatatgaattaaaatcctacatcattatactaactccaaatagttaatatttaatgatattcttttataaaggaaggtaaatctgtacttataataccagctttgaaatgttacttatagtttctctctagccaaccttttgtatatgtcatagcactagacaaaatgtttttatgcattgtgagtgaattggctttgttcaatttgaaattgattgtgattggtttaatttaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaag

SEQ ID NO: 116036 - DNA, 1056 bp, Homo sapiens
aaaattcaattattttataaattattaagtaatcaatattaaaaatgaattattttctagaatctcttcctgcattttaattgtgtgttccttttcattctaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaat

SEQ ID NO: 116037 - DNA, 1059 bp, Homo sapiens
tcttctaatttgaatataagttctctgcactaatttttattataggaaataggttttcttgctgcctcacattgttcacaggacatcagagaataaatgtgatataggcaaatagaatcctaaggcctttctgaattactaggctgtttcttaaagggtattagatatttacacaacacttgttctggattctggcccagctaccattgtggtaaacaaacagctccacccctcatggtcttcagcaagcttttcatgaacacaaaccacaagcacctcatctcgtgccctttccatgtgtgtgctcttcccgggcttccccgttcactcccagttgagtcaggatagtgcaggctccactggggagcccactcatgcaacccagaattaatacttggcattatggtaaacagaccaattcttccttccttctccctgtatgaattgtcctgagatgcattagtatatcatgtctctcagaatagagtagcccaagattaaataatcagttatgcttgtaccaagtgatggccacttaggtaattcgctttgttcttgctctccctcctccctagacaactcccctttctcctccgctccttccccggatgtacacttctgaaaaagttgttgcacacaaacttcggtcttagacaagctctactttttgaggaatctagactacaactaggaatggttttcagtatccaagccaaaacaatatggacaaactgaagtgaatattatgaatgttgtgattaagaatattataaacatatttttaagctttaagctctagaaatgtatgttgtctaaagcaccaagcaattagtgttggcctaagttaatgtaaattcaacagtttaacacttgacacagttatagtatatattcatatttgtttatttttgcataaagaggttaccccaatctggtggggagcagtaatagagaaagagaggtcagtggaaactggccatactgaagaacagatgggacaatacttcttctcaatatgtttttgaaaaacgttttggaatcatgtgaatctattacctg

SEQ ID NO: 116038 - DNA, 1060 bp, Homo sapiens
tttgtgacactgtagcctcatctgctgggtaactgcatgcttctagggccacttcattctctgtcatattttgtgtatcataatttcagtggctactttatttctacagttcctcttgcccatcctcctcaaggagaaagcctttttggcaggctcaggttagtggctggcaactaattaggtgactggcaactaaaatttcttatctgttgcaagagtatctcctatttataatggttatccagttgtttatgtacaaataaacgtttttataagatactttaagaaaagaagttatttttctttaaaaaggagttctgttctttttaaaatggaatctgacaggatcttttgtttttaagaagtttcattctttttttaagcaaaaactacagcttggagttttttaaatacatagtgaatgttttgaccaaatacatgtaattttacttaaactattttaacaatgacttttctaagtggaagaccctaatagaaattgacatgtcctagtcagtgatatggactgagaacttgataacaaatcccactgctggctactaagaagctttatcgggtttaatagggaaaagccttgtactgatacatattgttcatgtttacatgtaaatgtgtacttgtatacatagtgtgtacttacatgcattacatgcatattatgtgtgtcaagtaagtcacgtgtgtcctgactttaatgactcagtgctcatgtctgaggtgttcctttgagctctgaggtgatgtgcataaaagttttagtctgctcccaggtgaaccaggttaaatatgagggctctggtttaaagcaaggaccagactgcatcctgagggcttccgtgtgcccctgggattgtgagataatcacatccacatactaacagtcaagtagagagaaggaagttggatggaatgaggggaggactcagggctgacccctcttccagacaccacagagtttctctctgtatacaaagcctctgtacacattacaagattccacttggccctgttggaggaatggctgccgtggctttcttaa

SEQ ID NO: 116039 - DNA, 1536 bp, Homo sapiens
ggaaggaacagagagatggatatgactgtcaagggtggcacgagggagatcttcgtggtgatgagtattctgtatcttgattgagtgatagttaacaggaacttaggtgataaaatgacagagatctatacacaggcattatctcatggtgagcttcctggttttgactttgttatattctaattatgtcagatgtaaccatggcaggaaactgggtgaagagcacacagtacttttcaatatgatctctgtgtctttctataaatctatcatttaaaaaaaaaaagttggttttttaagtttctaaaatcttataaaatcgttggcatactcaggttaaagggatattttggggtgttcagttttgttttgcttttcgtcttgtgattttgttttttccatgttaaagttggttgaacatacagttattttaagtgcctgtgtattcttcataatttatggaatcaatagattttgctgtggattttctgccaccttgttacttcttttatttttttttcttcttagtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtggtgagtccacatttgatgaccttttgtcaaaaagtctttttcctgagagttcatagactagtaaacacttacataacatgttgagaagataaaaatttatgatgactggtacttgttctgccttttcctgttacagttttttttttttttttaatatatatacttgtttttctcaaacctgctataaatctacgtttctgctgttgggaaattaatttcagaaacatcgtttcttccaaactgtaaaaattataaaatactaaaagtaatccagtgtgtttgtggtcaaaagagtaaaatatgtaaatgctttattatcagtttaaaaagagacaaaaattgttcactcactagctgctcatgtagcagatatttgattacaagaaaactcccctacatttatagtttttaatttttggtccttttttaaaaaaagtcttccccttttttcagtacaattgtcagcatgtttttagtttaacaaaattcaacttgcagtaaatgcatgtgatataaagaaggtgcattgaatttgaagcaaaaattttaaaacccgagttagtgcttcagctttgctacttgttggctttgtgatatatacaaatcaagtaaaatatttgagcctccactttctcttctgtaaaatggggttaataaaaatagttagctccttgggttattgttaggattcaagattaaatgagataatgtgaaaattaaacgagatgtattaaggcattttataaactataaaaccataagcaaatttaacttactgaaagttactagaaaaagatacatgagatatctctgaattatttcctacaaatg

SEQ ID NO: 116040 - DNA, 2037 bp, Homo sapiens
aacttaagagttatctgatatcagcctatattagcaagagttgatcacctgcctctcttccctgaccttcatactgtttctacatctcctaatgtctgccaccatctaaagatagacactcagaatctctaccaaaacaagttaaaactcagtgtgtgttttgttttcaaattaaaagtattttatattgaattagtccctttcatcagaggagttcaaaggatctaggtaggcactgtaatcattgttaaacttcttaaataagctaactaactaatactctgcaaattttctatacagatagtctaaggaaaggacttatgcagaggcccaaatttctggagggaaagagaactacatagaaaaccatttaaacatacaacttacataatgccctctgttcagatgttctgaaacagctcattgactgaatttctaaaccctcaccacactgtttgataccacacagatacagtcttaagcagaaactaaccaaattataatactggagcgaaaacatctaaaattggaagaaaccctttgtactagccctggaatttgacattattggctccttagatcaagattaaggttcagttttgagggaaggttagtgattggggtgtcactacaaatcagttaggtgcacaaatatgctcttatgatttatataatttatctgcaagaacccatttcttttacagtgtaaaaagtgaagattttagttttattgatttatttttgttttctgacgactcaagaacaaaaataaattgttaggataggcgcaatacatgaaaatgagggagtatagtgatatcagaaagtggttctaaagattgattgcaggtcattttggccatctatcaggatatttgtatgaactaatacaaaggaacctagatctccaggctcactgtgatcatattttttgtgacagttgtgatggcaatatactctacttagctaaggtcccagctgagtacataatttattttcatcttttatttaagaacaaatgatccattagctttcacatgtggaaggaagtagtctgaagtttttagtggttaatgctgacattaaccagttaatactgacaaactgtattaactgaacattgtatctaatatactgtaaacatctaaatttttgttaggaccaaactttagccagtatgtgttttcattgtttggaagataatagtagtcctaacctggaagaatttgaatggaattaatttgtgatttatagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatggttagtacagtttatacaggtcccaccttatgaaaagggcggccaggcccagtggctcacacctgtaatcccagcactttgggaggccgaggcaggtggatcacgaggtcaggagatcgagaccatcctggctaacacggtgaaaccccgtctctactaaaaatacgaaaaattagccgggtgtggtggcagccgcctgtagtcccagctactcaggaggccaaggcaggagaatggcgtgaaccctgtagacagagcttgcagtgagccgagatcgcgccactgcactccagcctgggcaacagagcgagactccatctcaaaaaaaaaaaaaaagcttgtttgtaaatttaatattttgaactcataaaatattttcctatggagaaaaaaaaaatctgtggtatttaggcaaagtcactgaaaatatttaatacacaaagtgactagagcattaaattgtaatgaaaatacctgaaagtgctgtcatagtagtgataattaa

SEQ ID NO: 116041 - DNA, 1085 bp, Homo sapiens
cctcaatgtgagcaaatgcagacagcagacttttcctaacagtctaatatgtaatccaatgccattagctactgactgtctggagaaggaaaaaaagaagctctggatcacatctgagtgttttgttcatgtagtggagaaatcagctttatttttcatgacccaatgacagtgaaagtagcttctctgatctgagcagcagactggcctaacagcttgtagtaaaactcctattcattattaaccctatcatattccttaagtgtggaaatgcttcaaataataggatccagttcccagtctccaggagattacggcaaaggcatcataatgtgcaatatatcacgtgacgacaagtaccagaaaacccatttcctataattaggagtgttatctcttattcttaagcaaacttgatgacatattgtatgaataaaagcatgtgatttgtcaaaatggctccttaaccagcccactgttgttattcatattactccagatgacggtagatttctgtgagtagtgaaagcaaaatgcctctttttctgtgcagctatatcaagggaaaaccttcaatacaccagcgtatttcttggttccatgttggtgaggttcctgtttgactgtggttcacagcatacatagtattctccatttaaacacaaactcatcatttcaatgaagtctgtttgtaaacccaggaaaggcagcccctggcatatatagttttgatgcaacattgccacattgttttcaatctctgctttgctttttcaatctctgcacagttgagcaaccagtgtaaaatgttgcagtggtttgaatttggaggttttttctttatttgagacagctaaaaataacaatgggaatgaagttacgattttaattcttgctagaaatatgtcttaatgggatactaaaacacaattttattttattacaaacaacccctcctaattagggacagcagtagtatttgcacttgaggatggcttacctattgagaggtattgaacaaaatgaaataaatggacaggatggattggatgatttggtcctttctagttctagtattctttctt

SEQ ID NO: 116042 - DNA, 1062 bp, Homo sapiens
cagtccccaccgccttccctaagcctcgccttctgggaaggaattcaggtcctggctttgtttctctttgagtttccctcacataagttccagtgaaagaggcagaactgaccacattgactttgagtggtcattaccacattcacagatggtccctttcaagtctggtggtgcctgtttaatgcagggaaaaccatctgccagaatgcctttggccattggatggaagagaatgtctcactgttacttaagagcaggaattgcatacgacagtgttgtagctgattatgcttcataatgcaggttgttttgatgctccttgagcatcttctttcccccaaagagctatgagatcttggtaactacttagggacaggaatccaggagtattgcactcctcctgggctcgaatgaagacactctgggtgcgcttgccagttcttcttgcaaagttgctcctgtacatactttacccgagatgggtccagatctacagaaggatatggagaggaaaagtgagctaggactgtcagcatggttcagagccttgtctttctgaattatccttaagcaagtctgtcccttatttgtagtgtatccactctgttccacaaatggaattcagtgagttgctctccatgaatcctgatgttttactgcaggagacagcacatttcctgacccaaccaatggatctggcagaaactagtttgtggccaattatatatcatggttttgagaaaactatatgcaaatataaaatgaattttaaaatgtttaaatgtatattttctatatataggtatgtattttgttcattaaataactggcactgtaagaagaaaacatctaaacttcactgagttacataaacgaaagcttgaataatagatgtctttctaaataagatgactcacttctgcaattaatttataaacttagcaaaatcctaatgaaatttttctttgaaaagtaactaagcaattctaaagtttatttggaggaaaaaggagatgaggataatcaataaatacttgcagaagatgaagcatggaggataca

SEQ ID NO: 116043 - DNA, 1009 bp, Homo sapiens
ttttttttttttgagaccaggtgtcactctgttgcccaggctggagtgcagtggcacaatcatggctcactgcagtttcaacctcctgggctcaagtgatcctcccacctcagcctcctgagtagctgggaccacagatgtgcactaacacgcttggctaatttttttatttttttgtggagatgggggcctctctttgttgtccatgttggtcttgaactccgagcctcaagtgatcctcccaccttggcctcacaaagtgttggcattacaggcttgaaacatggcactcagcccattcaccagattcttacctagtcggtgcaagccactgtaatctgttgtatggcaaatacaaagatcaaccagatacaaactatctgcaaaagtcacttgtcatcagaatgacacaggaagcaaaggactgagagattcattctgtttgaaggaggagtggatttttaaaaaaggctttcaggagactgtggtatttgagccaggcttcaagttgtggatagaatttggacttgcagagatggagctgggtaaatggtgtttctgaaagacagaacaaactgagcaaaggcacaaaggcatggaaatcttggatggagtattgtgaatagattacagttccagtttgtcgaagtgtagcatgcttacagggaagcaattggaaacgtgggtgggacctacctgttgttggagagcttgaaatgaattcattttggtgccaatggggagtggttgacgtgtgagcagcagaagagtgacatggtgaaatgtcatttgggagactgctgtgtgtggaatggattggacaggcacaaacttgagatgggaatcagctgagacacatctgaaatagtctagccttcaggtgatgagggccttgttgtgagtgatggaggggagaaggtgtttatgggcaaattcctgaaccttaacaaccatgagctatgggtgcagggaggagggccatgtcatatggtactgggacctccagacc

SEQ ID NO: 116044 - DNA, 1099 bp, Homo sapiens
gcgttgctctctctccgttcattttgctttcacgatagcctggagtgaatatatcttcccttccttgtcagcccttacttctctcttaaattatgttctactgtgttctcacaagattttctcgtaaaatataaaaccaccttccttttgggagaatatgtagactgtgggggtttcagtagttctgacatcatgttccagggcagtgccagcgacacttttaaccccgaagaggaaatccctgccccgctcttgagttgctctcaaaggctgacctgtagacactattgcttactaattcctccagcgtgacatttatcctggggatctcattttgtgctaatgtagctgaagtctgaagtcagtactctagtgggcctcccctatttttccctattaattaatgaactgttatttaaagtactgctgacttctctgggttcctgagtcaggcagttctactactctgggcatgaaagaaaaataaaatgaaacaagaggataaaatatattttactggacaaagtagaagaatgaacaattatcccatcaaacactttggaggaaagttctgaatgtgtgttggaaatgatttaatgcaggagcccaggatggtcagcagttggtgaggtctggctggggactctgtttagaagcactccaatttccagaatcactgtggcaatatgatggctgtcattccaatttactgatgtgacgagatgggctcagatctgtatgactagggcactgtgcttagcatctagacatgatgtaatattcacaggaaccctcttagttgtagggggcagggtggtgaaaaactgggaattaagggtattacaaaggcataagtaggtatattttatctcagacttgtcagttaggattttgtttctaaagccgacagaactactggatcaaagaagatagcataaaactgttatgtttctcagtagcactacgggaatccatcaactgcatcaaaccttccccaattaacaaaagcttgggtaaatcctgcatcaactgaagactggcattcataatgcccttaactggttccatcacattaaaccgattaaggaagctcacagac

SEQ ID NO: 116045 - DNA, 1040 bp, Homo sapiens
tttattaaataagcttgtgctgtggggctgttttttcctttgtgaactgccatttccagaatgggttaccacgctggtggtggccctagctgatgggcttgaaggggaggcattcatcttgtcccatcgcggctcacttagctgagacctctgcaggagcttacacgcgggccagcagaatcgcaaatagttctcccaccacccgaggttttatcattgctaagctactgcaagattattgtaattgaaatggttctcaggcttctggggttctttctctctatctctctctctctctctctttctctctctttttttctagcctgtgactcacatttttttctaaggcattgtatcagtggcctttgcaggctgctcaagggatccagacttttgcatttattgaacatgtcaggcattcattaagtactgcaccatcagggagaatttccctgctattaagcgtcgactccagccaaatcagattcacctgggcgtttctcaaagaaaagcctgtcagcatgataatggtttgaacagggctgagctgtatggttgaagtgcgacagggcagaagacaggctgtggtgaccccagagttggtctgtaactcacagaggaatcacacagtggagaggcttcagaaaatcagaaatctgactgtcacaggtagcggggcaagctgcctgatgatgcacttcaggaaggctcagcaggagggtggggaggatggaaaaacccgtaacggagcagctagaaaattaaggcaaggaaaccgtaagtctgccctccagactgccacggttttatgtttgagactgaggtcactcccccagggaaaacaagaggaactgagaggtgagagtaggggagaaacacccctcactcaccccttgaataaaaactttggtgtcagtagcatcctgtactaatgtttattgagcatttattatgtatcatacttcattccaagaagtgaaggtatattctttaatttttacaactcttctatgaagtacgcattaatattatctatgttt

SEQ ID NO: 116046 - DNA, 1103 bp, Homo sapiens
tcccattatccattaaatattcaacattggctttggaaaatattgtagcactgtaatttaaagccaatttgggtagcattttaataagatttgaggcttttgaataattgtgttaataccagcagctgcttttatttggttagtaagatgactaattctataattaatatatttaacaaaaatatactgaaaatatattcatcttgtcattaagatgtccatttgtacaggtttctctttaacatgaaaagatagtgtgaggatatcattgcctccctctgctatgatgaaaatgatggcaggtaggtgtgtgttgctgatgcgcatggctgtgtttttgtgcggcgtcagtggcagcactgagcgagacccaatcgaagactctgcagagccatggggtatataaatcttcagagtctctgactcagtcaaccatacagcagctcaattttgtgccacaatcctggtaatgagatttttccatggtattggcttaacattacccctcaatgggaacgttttattctgaacgtttgctttgtggaatgatctttcagttctctctcaaagtcactcctccacaacatagaaatcaggtgtgaaattcaaataattgaagaccttaattcttcattgtgtacccaagtttcgagggttactgccttggtaaagaaatgttggcaggtgctccatctttgcctcactctcttctccatgtcattctggctgttcttttattgcgcgtcctgctttttttaaaatatgatgaagaaaagttcaaacctaactggtaaattaaataaaatacctaacattgctattatttaacttgatttttgtttcctacatgtgttttaaaccaaaaaaatactttatatttttaaaataggacattagggctctcagcaatgtcctgactgaaatcttgcctctctcctttggcacactgtggtttattgttgttgctgtcatttcacgttgttgttgctacctcatttgcactgaataagcgttctgtggaaacagcatctgagccactgctttccacccgtgttctagatgcatccaataggttttactagaggaaaggtgctatgtgtcca

SEQ ID NO: 116047 - DNA, 1042 bp, Homo sapiens
aaggtaacttagcgctttggtctgtttctctctacaggtaaacaaaataaaaactcctaaacaaatagatgagctgattgaaattgagagtgacacaggaacatggtataggaggtgttttgttcggatccgcaccgagctgtacggagtaagtaacaagtcccatgatgacctgcatgttaatttattgcatttgaggttagtcagaagaggggtttactgggcctgccctatgagcgaggttctttcctgctgcccaggacacctgactcctggactagagccaggtaattggatcccactcgaccagcatttagccaatacattccatctgtgggaagggaaagtgttaggccaggagtcttggcagtggcagggtgccttcaaatcttgagttaccttgtccattgacatccaggaagctgaagaatgaaaattccaattacctttaacttttacattttaaggtgaaatgaatccaacccaatgacaactcagcattttttataatttggtggaaggggtcggggagtggggttgactaagtaactgcatgagaaaactaactctctaatatttcacagatttggttgacttttatgagatgtttcaactacccagtcagggataatacaataaagcttacaattgtttggttcaccctgtcctttgggtaagtgatatttaaattcttggcaagcaaaatcgttcaatgtccacattgtaactcctagccatgctgctttcttttctgatactgcttgatgctgttaacctgctaaggaagaaatttttttcagcttaggtttgctgagagttatggtttttataaaccagttattttatttgttttgtcataaagctaaggtagcaaaaccaattgtatctgcaaaatccagtaaggccctggatgatttgccccatgacttctctgtcctgtcctcctttgcccagccccagccataccagcctctctgctcttctttgaacattctagaacagttcccatctcgggcctttgcggtgttcctctgcctgagtt

SEQ ID NO: 116048 - DNA, 1072 bp, Homo sapiens
cctgggaggcggaggttgcagttagccaagatcatgccactgcactccagtctggacaacaagagtgagactccatctcaaaaaaaaaaaaaaaaaaaaaaaattgctcccaatatggaaacacagagactcatatcagagaaagggctagggcttttgggtatagcttcagcagcttgaatagctaaattaaaataaaagaagctctgctttaccatttgatatgagctaagacaaatggactttgccttcatgtaccactcctgtgctatgttgccatagaagtcctctgtgccagagggtggagtcagtattatctggactttgaaatgtaggagagttttttcctagaactatgccaaaacatttgggatatcaatttgcaactgatcttgagtgcttcctctgggctcattccctttttttattgaccccaaagaggtgtattctgtgtgtgtcctgtcctgtctctaacttatatttcttcttcaacaacatctattactgagcttgcagaaccctgtaggtacccctccatccatctccctgcagaacatctaacactcaaccctggatgtctgcttatcaaatattctagttcagaccctcagtgacccacctattaaatatttaggctctgaaaggaaccatacaatctttgtacggcatctccttcattcattcaacaaatgttaattctctgtctttgtgaacgaggtcctgccagagttggtgcggccaaaagcaagattaagactctgcagcttcattgagctttctttcatcaacctctcattctgcaaacagagcttagatgtggattacactatacgtttaaaatgaacccctcaattgcttgagcccattgtgccactgcactccagcctgagcagcagagagaacctgtctcaaaaaataaataataaaataaaataacctcctcaatgttaaagcaaggctaggtcatagcctccttcctttttcttgtatactataagagtgtgatactgttttaggagaatcagctgcttatccctctgccataaggaatagaaggatgagtattcaccta

SEQ ID NO: 116049 - DNA, 1007 bp, Homo sapiens
tctttacccctcctccgtggcgctcggggccaggagcgcacaccttgtgagatgcagcccacgctctcagggccgtcctgcaactctgcacagactcccagggccaggcaagcctgtctcatggtgtcgtttggccgcatgttcctgcctttctctgcctaccttcttcccttttctttcccccttatgcccccttatgcatgcacagtttcagacatgaggtcagaaaggatttgaggatctgattgttcacacctgccgatccctgagagtcctgggcagctgctgccatcacccagtgcagtgggattggtctcttccttgatgagctaaaatcaaaacattttcccagaattaagcaacccaagcccttcccttaggactgtccttgttttgacagagttctcttgtttcctccccattcttcagttccgaaggtctgtcatcttggatctcttactgaccagctgtgcgacctcagggacaccactcagcctagctgggcctggattgtttgagatttaaatgaggagtatgaaataaatagcatctcagggcctttctagctctagaattctcttcactgtcgtcatctggtattctgtaatggcaatttcattcattctttcttgaatacattctacgtctaatataaagataaatatctcacttatttgtgaagattttggtacagaggaatctttcagctatcgcgactaaccaacctatgtaatccactccatccctggccctctgctctgcttgatttttccttatacgccttatcattatattatatatgtttatgctttggctatccagcaaaagtcagattcattttgtctctggtagttagaagtagagggtgaagggggtggggaatatatgcttcctgctcccacaaccttgccatcaggcaatatattacaatggaagcaaatcctgccaagtgtactagcacaaaaacagtcacaaagtttgtttttgagctccaaggaagtccatct

SEQ ID NO: 116050 - DNA, 1053 bp, Homo sapiens
ttttttttctgtttgatgtcaaaatggcctttacctatttcttcagtaatatacctgatctgttcatgcactaaaggctctggagccaggaatgtctgaatttggccttcacctggtatcacagaaagacaactgggatattggtgttaaggggcatatcggctgtatgttaggttttctttaatcctcacatcgtgccaaacttagtctggttactaagcctaaaaacaccagtattgcaacaacttctgaaactctgaagtggactatatgtttctcacagtttttgtttatgctcagcaaagtatgtattttaagtaaagcttctcttgttatctgtaatgtagacaaaaaaaaaaaaaaacctgttagtatattctggatgtattgtgtgtcccttcattgtttcaggtatggcgtaacagttctccgtgtgatgttcttttgctctaaatgttgaccattcctcttgtcgcccgtctctcaccaaccagtcacagagccattgccagggctcccttcagtctttcttaaacaatatctaaatgcagtttagtaatcccaggattttgagttacaagaatacagtttatgggtctgtttcagctcttacttaaggctagcatggttgggcaggggaagagctgagccgagccttcactgatctcttgtcatttcatatgattatccagtaaatacttattgagcacctcccatgtgatacgtattgagacactgctgtgtgcaataattaagcctatggaggacttaaatgagggcaaggaaaacagaatgagagaagacactctcacactgacccccattacatgtgaaccctccgcgcccccccccataaatacaaagtgttatttttccacatttaaaacaaataatagccttcagcaggcagtgcaggaactattcagtcattgagataacctttgatgagaggagaaagctccttgattacctggtttttgttggagagactattaactagtacttggaaaatgagaaaaatgaaaccacacataagttgttcccttaaataat

SEQ ID NO: 116051 - DNA, 1061 bp, Homo sapiens
aatacacttttaactaaaagagttgacaattttattttcacatttcccaatacaaatgaaaactgcatcttttttgtcccacttctcccctccaaaactattctctttgataggagaggggagcaagacttccttatgctgtttagaaaacccagcatcacagcagcatgatctcctggtgaagcagaacaggtaatataaaaccgacataatgagccctctcctttatccttatctgtctggtcaagtctttctgggccgagtgggcaccatcatgggacaggcaggaggtcttatcactggggacccaggcatcattggcctgtggcctcccataagcggcctcattccaggagcaggtccccctggcatcatcccaggaggaggagggcccatcattggcatcatggcaggacccctcatatggggtgctggcatcataccagggtgaggaggacctggaagactagggggaggtggtatcattgctcctacaggaggaggagcagagaatggagcaggaggtatctttccttgttgaaatgcagccgttgttttgtcaatcaggctctgagcctgctctttcatccatttctgatagtagtctttcacattctctttgtgtttcctaccactgcagtgtgtctttctcacaggaggagagtcatgggtgaggtatgtattgcagtagtcacaataaaacttgggcatgttgctctgcaggccattggccactccattccgtgacacccagaaatgaatgacttgtctaattttactaaagcaaagctctagctccttgaggatggggactgtttaaagtttgtcttaattatctgtatgtattcttttcactgtatctggcattcgataaaaccttagtaactataagttgaatgaatgaatgacccagcaagaccatgaggagtgaccagaagctcatcagaaggatttgagtttcagaatacaaaatgttttcctcattaaggggccaggctggcagcagaggtggactgaaagtgtgcagagggagcccccaagagctgactcatgcttgctga

SEQ ID NO: 116052 - DNA, 1072 bp, Homo sapiens
cttaccagagaatctgggtgacaagtaaaaatgcttatacttttagtgcccttccaagttctgtggaagagaagatatgagaaggatggatttggatggcggcaatgggagggcttcatgaaagttgtgaatttgaaatgaccttgaggaaggtcagaggaaaacctgaaaggcgtgctagtatatttgtactgtggaatcttctatttatataggcaataaaggacaattggagctgtcctgaggagagtcacctgatgcaaccccttactgatgtaccttcttgttctttgagatggtttaaaaaaagaaacaccccaaacttttcattagagacatgggtgagtggcccagtgaagtgagtgacaggggaggcaggtgtggcaagacagcgatgtgagcatttggtgccctgtctgctggctgcttagcggcctcttcactgtgcttctgggtttggctgtcttttggatgaacagctttgccagagggttttgccgaggataggtgaattcaatgagaacaggtaagaaaatgagttgtacttagagcaggacaaggatattgacaactgaattctctagggggtagggtttctctcacctcatttttcttcattctctccattaattgtggcaatgtttacctttcagatttcactgatttacggtcctgcaatgtccagcatcccagttttattgaagaatgacttagactgtgtttccaattcattggcaattgcctgaggaactttcatttagactttttgtgggattttactaagctctaattggaccttcctttaattttataatcgtgtattgtgtatgacttcttcttgccaaggtgcctaagaggagctgacagctgtttatttagtatatgcagtggttttcaaagagcagtctctggagcagcagcagcagtaacagcagcggagcatctcctgagagcttgttggaaaggcagatgcccaggccccactcagacctgccaaatcagaaagcctgtgacggggtctgcagtctgagttttaataggccctccaggtgattctgatgcgctagagcat

SEQ ID NO: 116053 - DNA, 1031 bp, Homo sapiens
acgcccaactctagccctattttctcttcagaatgggaaaattcttaagttatctatatggaaatacttcagtctatcaatttgggtggggaccaaattaatccttgtgtctgtatacttaaaaaactagtatgttctattgtttccagatatagccgaggtggggagaacatttggacttctgtgttgtatattttgccatcttgcaggggatcttggaagtgtcattctgaagttaccaagcattctcttatttcatttaggcttccaagttgaagttggtcgttgctgctgctgttgcttgtctaaaagcctgagggtttataatgctatctagatgggaaggagctacttgaaatgtgtttgaatctttatgcttgcttcagaatgtagagtttgacttagctaccagggtcagccaaccttgtggtcaacccagtcctgtgggagtttagaagggaggtgaggaagaggaagtacacttggtacactgggttcacctaacgtccctcaggcctcaccgcctctacaaagttaatgaaattttgtgttcataagctcagtgaagctcagctgagaggactaactggaatgttgaagccattaggaatcgaaaacctgggccgcaactcacgtgcccactttttaaaaaaattctagtacttttcatagaagatgtttgctagtaacccctctattattcctcacctccccaaaaggggaccattgtaatcagccagtcttggtccttgagattgtcacttttctgttttttgccccagtcctacacgaagcaggcttctcagggtgggatgaggagcctggtaagatagtcacatagtcagcctcatgaaatatgactccccattcacctgccccctaaactgtgcttcctcaggtaagatctagtaaggcagcccaccagagcctcgctgcatgttgaactcttaggaagtttgtccaagaaatggtagttatagagctaatacaaacatgcttttgctctcattctgttctctactaatgagttt

SEQ ID NO: 116054 - DNA, 1031 bp, Homo sapiens
ctggctaattaaaaaaatattttttggttgagacagggtctcactagggttttttgttttgttttgttttgttttatgtagtctcactctgttgcccaggctggagtacagtggcatggtctcagctcactgcaacctccgcctcccaagttcaagcaattctcctgcctcagcctcccaagtagctggaattgcagacacatgccaccacacctggctaattttttgtatttttagtagatacagggtttcaccacgttggccaggctggtctcgaactcctgatctcaagtgatccccccacctcggcctcctaaagtgctgagattacaggtgtgagctaccatgcctgtcctcactagggtattctttttctttttcttttcttttctttttttttttttgtgttttaaacactttcaagctctcaaaacctcaaagaaggatacaatgaacatctattcccttcacttagctttaccacctgttgacatcttgccacaccattccatctacagacattgggatggctcacccctaaatccttcagcacacatctcacatactgagaaagacattcttctctccagcttcatcctcagtgttaccattactgtgtgttcagttccattgttcaatataaattccacactatgatttcccctgctatgctttatagccatgttttaggacccaggtaagtttctcgcattgcctttggctgttattcctcaaggccttccccagcctggaagagtggtctcacctccctctcaatgcaatgaccctgaatcctctgaggagtccaggcctgtttcctccaggtgcatcacatcaggggctacagtgtccaccctcccactactggtgatgaatagatatttttaaaaacctccctaggagattccaatgtgcagccaaggtttgaattcattgaattaattaaatccaccctactttatttgtatgtgtttttttttgtgctaaaatacacataaaattatcattcttaccatttttcagtggacagt

SEQ ID NO: 116055 - DNA, 1041 bp, Homo sapiens
aagtagctgaggctacagttgcttgctaccatgcctggcaactcccttgattttttttaattgggagctgttttaaactaagccttttcatttctttgtcatttaaaataatactaaatggactttttaggtttccttttcaagtaggccctcaaagctaactttatagcttctttgctgtggggcttttgctgaaatgaaactgtacagacaagtctactactaatatgggctttgaaatgtcctctctgatgccagaaatcctactatttaaattaaaggagtaacttttccaaaagaattagtactgctgagtagattttatattaatctgcctaaaatttattcaaataatgaaaatgaatctgttttaagaaattcagtcttttagtttttaggacaactatgcaaaaatgtacgatggagaattctttttggataaactctaggttgaggaacttaatccaaccggagctattgtgaaggtcagaaaacaggagagggaatcttggcaaggaatggagacggagtttgcaaattgcagcttgagtaaatagttatgaatgggactgctattgtgtctcccaaggaaagttcctgtgatattatattccttttttaaggaaagagaaaatgcacagaaaacttttgctgtgcttcctttttctgtcctacctctgaaaataaactaagcaaaaaaaaaaaaaaaaaaaaaacacccttcccttggtgataggcttgtttagaaatattatcttcaaaggtctctttaggtaagccaagccattggctatattggtgagtctgggacagttatatatgtgccctggaaagaaaacaaaacacgggtgtgattccttttgtgtcagtgtttacaactcagataccaaaagaacaccttgttgattaaatcaagtctcaagctctggccttatctagtggtgagttagagaatcagatttgaaaggagaagtgcttcaaatgtttaagcaagtgaaagccatgagttgcttaacagtcaatattcatgattagtttaaa

SEQ ID NO: 116056 - DNA, 1050 bp, Homo sapiens
cattgaaatgtaaattgccttatacccgttttcattcttgcggacttctcaggaggaagacaggttttatgttacaagcattgaagagaaaatctttctcctggtatctctttttttagtatgcaacaagattgaggatgattcatttaggcaactctggtctactctaggagcttgcatatctaacaatatgcagtattctcaggaattttaccagtgtgggattgctggtactttgaggggagaaggataacttcatatctggatttaatttctgagttaataaaccgccatcaccctggaatgcccatttttatttgtttccttatccatttatgaactaccttaaggcatttatcaaatagtgacttaaatctaaaaataaaattaatgtcctttgtttggaatgcttttagagaccattaggacttaggagcagtgcagtggatgtggagagaatgaaagattcaacaataactatataaaaccctaaggtcccactcaagtggggcggcctggccaaaatgtagctcaaaacataatagtggctatgagaaaaaagctattttgttgtcattgttataacacccagcaaggaactgtataggttatagggccttttaaaatttttcagctggataccactttatttttattgtgactttcaaacacgaaaataccattatgttaaaaaaaaatactatggaatctgtgtggcagaatgtatttaagctgaacagattaaggctgtaggaccaaagggctgaacaaccttgagcatttttctttaaatattcaagtttaaaagcatattccttggcacccctaaaaggaaagcccagtaaaatgaatatgacatttagaatatgtagcattggagattttcatcttttttttttttttttttttgagtccttgggtttatcagctggaaactttcatggcattattgcatctttacatagtaataaatgtgtcataattgacatgtgctttaaaatgctctcacttcctctacttcctggaagattgtttctgtcttgcatgttg

SEQ ID NO: 116057 - DNA, 1053 bp, Homo sapiens
tgttcttgttgatgcttctctgaatggttagcactggctctctgggtgtgttttgtttgctaaaccttgaaaaagtcttagtagatggaatacagtggaaagattaggaagatgcctttttccctcatacttcctttaattaaataatgtgaaaatatactgatttaatagatgtttctgtgagttgtgctaaatagaattggtaacagtgttacagttttatagggctttttatctgtttgagaggtatgcaggatttcttttttattattattttttattttttgtagagataagatttcactatattttccaggctggtctcaaactcttgggctcaagtgatcctcccacctcggcctcccaaagtgctgggattacaggcgtgagccaccgcacctggccgatatgcaggatttcttgatgtttctcatcttcccataacttttctcttttcctgacatgtgcttttagcctctgatagccgtcagcaaatacctggctcctgttggttgttcagtcctctttttctcttctctcacatacctaccaccctccaggcaaagcaagtaccctgtggttctctgcctaatttatatgtctcggaacatgctgctcccctcaccttaaatgccctgcataactcacaagactcttaggacctttgagttgtaccttcatctccagaagttctccctggcatttgttctgcacctcccatggctccacatgcccagagttactgatttgtctcctctcgattctcctggaacacccagtccacctttttttttggtttgctcacctgccatctcccatgtcatagaaaggctgcagtgagacacagccctgttcatgaccttagtaataacatcataagcaggttatcagtaaatgttgatcaactgtatgaatctgctgaggttgtgaaaagggattcggagaagtttgagatgcatttggccccagtagttcttacctagggtggggaaatcaggcatgtacctgaggaaggttgctgtgctgctaggcagaggagttgtgaagtgaaac

SEQ ID NO: 116058 - DNA, 1656 bp, Homo sapiens
gagtctgggaaggagaagggtgtttgaaatgagtataaccatcatccctctcctcacaggaccattgtggggtagtgtgttaattcattcttgagtcactataaagaaatacctgaggctgagtaatgtataaagaaaagaggtctaatggcctcatggttctgcaggcaatgcaggaagcacggtgcttgcatctgcttctggagagggcctcagggaacttacaatcatggcggaaggtgaagaggtagcctgtgtaccacatggcaggagagggagagagaagggggaggtcccagctcaaacaaccagatcttgcatgaactacctgggtgagaactcacttatcaccaaggggatggcacaaagccattcttgagggatctgcctccatcatccaatcacctcccaccaggccccacctccaacaccgggaatcacatttcaacatgagatttggagaggacagacatccaaaccgtatcaggtagtgttgaggttgttgaggtaagtgtatacaaagctcttagcacagagtgaagctcagtgaacaaatggctcttcttatgaagagcagccctcagcggaggcatggcacttccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctacttagggtctctcaaggctgccttaaagtgttgactgggactgggttctcatctgtaggctcagctagaaaggcatctggttccttgctcatgtggcggtcagcaacactgtatttcctggggttgaaggattcataggagcttgcacttgaaagccagcaagaaaggagagtgagaaagacaaagcacaagtctgccagtaagacagagtctcatatgatgcaaggtaatcacaagagtacagtctgtcccccttgccatctactgttgggtagaggcaaatcacaggttctgtctgtactcagggagaggggcctacacgaaggtgtgaacattgttgggggatcatgcggagggagtctgtttgctacaaatggtattcatattcacatgtgtttcaaacagtagaggaaaacgtaccaaatatttttctttctttctgtctctttctttctttctttctttcttttctttctttctttctttctttctttctttctttctttctttctttctttctttctttctttctttctctttctttctttctctttctttctttctttttcttttctttcatttattttttgagatagagtcttgctctgttgcccaggctgcagtgcagtggcacgatctcagctcactgcaacctctgcctcctgtgttcaagcgattctcctgtctctgcctcctgagtagctgggattacaggcacatgccaccacacccagctaatttttgtatttttagtagagacagggttttaccgtgttggtcaggctggtcttgaactcctgacctcatgatccacccacctcagcctctcaaagtgctgggattacaggcatgagccactgcgcccggcccaaatctttct

SEQ ID NO: 116059 - DNA, 1116 bp, Homo sapiens
tgtagttcttcttcattgaatgcatccaaattgtgggaatgtggcagatggtgttatatccatttgacagatgaggaaactgaggctcaataacttgacttgcctgaggtcatgtcacacttctgtagcagagacagaaacagagccaagccctcctcattccaaacctcaggcaggagctgtggtgaaaagcagggagtcggtttgcatcttggctctttcatatgccagcattgtgaccttgggctgttactgaacttcaaagcctcagttttctcctttgtgaaatagggagactcccttctcttagggtttttagggttaaatgaaaatttacaaccgtccctaaaccttgcaagcactcagtaaatggcagctactgatgtggtttatgttggttttggcatactgctatttgcacaactgggtgttagttgagcttacctggtgtatctccttaaggcccattggatctgagtatctggcattctaggcccataattcagaatcagtggaagagacaatgttgatacatctctgaggcttggttacctgggagctggcttgatgtctggggttctagatagtgcccccaacaggagagttgttacggggtgggatgaggggctttgcccgcaagaggatgaaaagaaaatagtagaaacaggagagtggcttttgggcaaactcttggatttgctgttcagacatattagcaattcgtttagtgaagaacagagcagggatgtgtgatgggcttccattactgtgacatcaaggatttgaattctgaccacctggcagggaatttgggttctaatttgccaccagtggagatagcacaattatgattgtcttaacacaagaagccgtctcccctaacctactctcaaaatctatctcaggtactaacgctgacacagatctgctgccataaacttggttgtcttttttgtgctggagagggtttcttctgaaatgtaagcacctgggctcactctttctgcccctctgtctttgaatcagacagcagctttacctcttggcctcttagcagatttattcttaagcaatattaaaagtattgttgcttcttgtccaaatctcctttcccca

SEQ ID NO: 116060 - DNA, 1029 bp, Homo sapiens
tataacttaaaatttttttcttatccattgtaaaaagcttataaaatatagaaatgcataaaaaataaattccatttacagccttactctatagaagtagtaagacattttggtgtctttgctctttctttttaacttagatttgtgtgtgaaatagatcatgtctacgaaagtgcatggaacatatatgtatgaattaaggaatactaaatatacgggtaccactttccaatttaagagctagcacattgctagtctctatgagccccttttgtgcctggctcttccatttattattatttttttctagaatcaagttagttctgtttatgtagttttatattgtgtttttgttcctactgtatcataagtatttttcaataatgtcatcattttaggttgctttcttatctttagagctcaaggtaattacagatcatagaatagcctttccggtaccgtgccttatatactcatttaattttacaacatgctgtgagctgcagcagctccccattttacagatgtgaaacctacatttcagaatgtttaggtaaattgccttgatgacagagtatgccaaaggactgagattagagtccaagtctgtgtttccaaaacccttgccatttctaccatggacaggctgactttatggggctgtatgttggaggcaccgtgtacatttaaggaattgaccattaaatgtgatgatgacgttatgggaacttgcttaatgataaagtaggaacaaaaacacagtccgaaactacataaacagaaatatagtatttctgcctaattctaaacaagaataacacatgactaagttctagtttttaagtggtactggtgccagaaaattccagatgaaggcaagcttccacaaggaatgtggaaaaacaaaaataatttcttgaccaggttcagtgactcatgcttgtaatcctagccctttgggaagctgaggtgggggggcatcacttgagctcagaagttcaagaacagcctgggcaacatagtaagaac

SEQ ID NO: 116061 - DNA, 1701 bp, Homo sapiens
agcctcccaaagtgctgggattacaggtgtgagccaccgcacctgacctcagcttacttttcttttaggccagacagatattcatttgtggagtacagatattcttctgttggttggtgctgtttagcagtatctacctagaatcttgtgtctcacaagacttgaccagattgataggcacttttcaaatgccctgctaaagctgctgaatccctgaatgatcaaagctggcactgactttggcagcggccttgacttttagagcatagcgtgctaacaaagaggagcttgcttcctccaaacagtaatagggtaatgtccagggatcagtgagcgtgttcctttcacccagtactctgcaccttgcatctcttcagcctcctgccaccttctactgttcgacacctcttgtcctggtggtgagggagcaggcagagtctttggatacagctcagctaagtggcttcaaagtcaggcaggggaactggtagctgagcctccattgcctggggttatctacttgtaaggtttttctgccttcctaattcttattactactattttactgccactctccctccatttgtgttactctgtataaccaacacctaagtgcgaaagtcctgggcttcagtctgtaccttctctatatggtatagatggatgcaggtgagatttcctgccaactcccaaatgtgtagctccagcccaggccacttccgtgagccccagatctgtgtgtgtgattgcaaactcaacattctccgccactgtgtactatttcaaactttaaatgtttaaatccaaactcattattttgtaaccctccctcctacctataagccttcccccgacaacaaaataacatatttggtctctttcacgtccttatcatgtgaaggacgctctcatccacttaactttgcaagctgggagttaataccgtaatctcttgctttccctctgtattcagtacattttatcagtttagattcttaaatctctgtccttaggcccagcatgatctagccctggcctcactcactagcctgatttccagctgtccctctctgccctgcttaggtggaccctcctccccttagaggccttacaccagcccccacttgctgaaatccaccccacctccccactgcccaccatcctcctgatttcatgttcaaaggtcatgtcctctggggaggcttcccttgatgctcaaatgaggtcagtgtctaggggggtaagctcttgtggcctgtatggcaccctcactagagtcttaagtcccacagcaataagggctttgtctttgcttacagtatatgctcagtgcctagggcagacccctcaccaggtgagcatttgacagatatttgtctagtgaaggaatgagcggatgaatgaatgagtgaatgaatgtcaggcactgtgccaagcaatttgtacacatctcatttaatccaggaaaccgtcgaaactgcaaatctcaactggggagtcaacccagagctgagccaacacccaagcccaggctctttctgctgctaccactggcttccttgagggagagacagttgctgctatttgattttactgataaaaatctgtgatgctacagggagaatggagcaggacttcttctagtagagaaattagggagacattgaggagacttgcattttaccgatgctaatttcctta

SEQ ID NO: 116062 - DNA, 1422 bp, Homo sapiens
tgttcagacactcttgcattaaacatcacgttgtacttgcctccccctccccctcagttggactgtaggttacctgatggttaagactaagactgttttccctccaccttggtttttgaatcacctggagtgcttttaatacagtgggtccttgaaaaatgcattcagctgaattcagtgtgtctgtgttctcagtctatccagagctctgctattaggtgaaatggaagagaaactcattgcctatatgactgttattgtgacgtacagtgcaatagctgatatgtttctgacattagaatgctctcatttattggtatttgatcactggcatattatatttgggatttgtagccctactttgactgctctactatgtattgaatgaagagtttagattggtattaatatgttttaaccagtacattttaaaccagtcaaacatctaaccacatgcaaaagaagggcacgtacttatcatgcttcttcacatgcttaccatgcttgttacatgacaaagggttgcctttacctatttttccttttagaagattgaaaatatttaaatgatgctgttgttttgatcactgttttacattctttgaagattgaggaatctggtgactattttatcaagcgatttttctcctggagttttcttttttaaccttttgtggcttaattccagtaaaagattttcaagtaagtgaaaatgagttgcatatatccattaagtctttttctttatcttaagtaaaaggggagatgaagtagaaatatttagcaactcagttattgcctctagcatttaagagttcagcttgaagaaaagtagttgacttgaaagaatatgacttaaggacagaggtgagaaggagataaagaagtgcatctataggaacaaatttgtttcttatttgctttaaaaattgtttaagtaaagcacatttcaccaagttgaatttcagcttgagagatgtccagatgtgaaacggcaaaactccaaatactgcatatactgtgcttttagaaaaataaagtagtttttttgttttgttttctttttattctttaaaaatgaaggtcaagaaaaatatcagcaggaaagtcagaagtggatttagatatataaatgtcctcattgaggaacaagggggtgatctttttttttttttttttttttttgagatagagtcttactctgttacccaggctggagtgcaatggcgagatcatggctcactgcagccttgacctcccaggctcaagcaattgttccacttcagcctcttgagtagctgggactatgcgtgtgccaccatgcctggataatgtttgtgttttttacagagacggggttttgccatgttgtccaggctgtctagaactccagggcttaagcaatcctcccgcctcagcctc

SEQ ID NO: 116063 - DNA, 1018 bp, Homo sapiens
aggtatatgttcccttttgcatgtctgcttgctttccaaagactagctgctatcttaacttaaaaaattttatttttcatgccagaaaacattgtattttaaaaattgataaagacactccatttgtaagtacttgttttaaagtaatatatctagaaggcaagatagtggccccctttcctgtcaatgtggagttccaaagcagctgaaggtagaaattaacagtcggtaagagagctatcaaaagaaaaccaggagccagagaccaactactggtagtcagtagtaattctgattgtctactcaatctgccaaggaaaactaaatacattttttcccctgagtcaggttaacacttaaagtataaaaggaagtacattcaggatctcatatgccatagttcaaaatatttttttactttatatatcatcagatacatacgtgcacacacatgtaaatatgcatcatccatgggatgtgatctcagggagataagtaccaactcatatattccttttaaacccactcaccattgccccaatttttgttccttctaactgcattcaactcttcaattcataatcatacagattcatgcaaataacagtaacgtgtttacctggttttacattctaatgttctatttctagaactgcttaaaatgttaagtagcacgcattcctgtagtcttagttactcatgagtctgagttgggaggatcgcttgaggttgaggctgcagtgagctgtgaatgtgccactgcacactagcctgggtgacaaagtgagaccctgtttcaaaaaaaaaaaaaaaaaaagtaagtatataagaaagacactgtaaagcagaagtttttcatttcttgtaagttcaccagaggagttgggaattgggaagagagttgggtagcaacaactagaagttagatccatcgcatacgagtatgcgattgttgaattacatccttacctggaaaatgagctgttgtaagggttaaatgaaaacctatctaaagcac

SEQ ID NO: 116064 - DNA, 1533 bp, Homo sapiens
aaatatagttaataaaaaatggcttttgggtccagtgttaacgttagtaaattaatgtgattgagtttcaagtttttggcttgtgcatgcttaaaactttgtgagtcaagaaattcctattataaatttattatcttaaaaataagatctgctcccataccagagaagatgagacaatgagtctaccatcctaacaaacccaacacagatatgtttcaaatctttttccatctctttttattatttttttaagtttacatacatgaattcattttttggtgtaaaattgcacaagttttaacttatatattcctgtaatcaccaccaccacactaaggatactaaactgctacattattcctaaaagtagcccttgtgctacttctcagtaattaagcacaaccttcctctactccaaacccttggcaactactgatctatggttttactttttccagaatatcacatgaatggattcataaagcatgtaatcttttaagactggcagcctttattcaacgtagtgcatttgagatttatccatgttgtgtgtaatgatatgttcctttttattgctggatagtattgccttggagagagataccacagtttgtttggaggacatgtgggatgttttcagttattgctgattatgaatagagctgtcatagacattcgtatacagagttttgtgtgaatatagttttttatttctatgggataagtatctagcagtactgggtcatatggaagatgtatggttaactttataataaatgaacaaaccattttccaggatggccgtgccattttgcattcgtgccagcaatatatgtgagttctatttttttctgcaacttcctcacacttgatattaagctttttgttttagccattctaacagatatgtggtagtatctcagtgtagtttattgttttgcatttttctaatggctgattattttagctatttaaactcctttgacatttcatatagaagttttatttgctcatttggtaaactatctgctcaactcttttgcccattctttaaaattcggctttcttattgttgagttctgtgagttcttcgtatatttggattcaagttctttgttggatatataaaaagcaagtattttcttttagtgtgtagcttgtctttttactcttatcagaatctttcaaagagcaaaagtctttaatttcaataaagtccaatttatctttttttttttcattaatggtttgtgcttttggtgtcatatctaaaaactctttgcctaatccaaagccacagagattccctgggtgtttttttttcccaagagttttatgttttacatgtaggtctgtaacaatttcgggttaatttttatataagatgtaaggtataagttaaggggggttttttgcctgtggatttttaattatctcagcaccacttgttgaaaagactactccttctccattgaattgcctttatacctttgtcaaaaaccagttgaccatatttagtagagacggggtttc
